United States Patent 12,508,308 (INFLUENZA mRNA VACCINES) - sequence listing, part 35

SEQ ID NO: 132444 - RNA, 1701 nt, Artificial Sequence
  derived and/or modified sequence opt3 from hemagglutinin__InfluenzaA__AGU01879
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugagaaacuguguaagcuaagagggguggcuccccuccaucugggaaaaugcaacauagccgguuggauccuuggcaauccugaaugugagucucugucaacagcaaguagcugguccuacauuguugaaaccucugggucggacaacggaacuugcuauccaggcgauuuuaucgacuacgaggaguugagggaacagcucucaagcgugaguuccuucgagcgguuugaaauuuucccgaagacaucuagcuggcccaaucacgauuccaacaagggugucaccgccgcuuguccucaagcaggggccaaaggauuuuauaagaaucugaucuggcuggugaaaaagggcaacucauacccaaaacucaguaagagcuauauaaaugacaagggcaaagagguauuaguucugugggggauccaucaccccucuacgacugcugaucagcagucccuuuaccagaacgccgacaccuacguguucgucggaacaucacgcuauagcaagaaauuuaagccugagauugcgauccgaccaaaagugcgugaucaagaagguagaaugaauuacuauuggacuuugguggagcccggcgacaagauuaccuucgaagcaacagggaaccuggucguuccuagguacgccuuugcuauggagcggaacgccggaaguggcaucauaauuucugauaccccagugcacgacugcaauacgacuugucagacaccgaaaggugcaaucaacaccucccuacccuuccagaauauucauccuaucacuaucgggaagugcccaaaguauguaaaaagcacaaagcuccgccuggcuaccggacuuagaaacgugcccucgauucagucuaggggccuguuuggcgccauagcgggguucaucgaaggagguuggacgggcauggucgacgggugguacggauaucaccaucaaaaugagcagggcuccgguuacgccgcagauuugaaaucaacccagaacgcuauugacaagaucacaaauaaagugaacaguguuauagagaagaugaauacucaguuuaccgccguggggaaggaguucaaccaccucgaaaaacggauugaaaaucugaacaagaaagucgaugacggcuucuuagauaucuggacauacaaugcugagcugcucgugcuucuggaaaacgagcgcacuuuggacuaucacgauagcaauguaaagaaccuauacgagaaaguucgaaaccaacugaagaauaacgccaaggaaaucggaaauggcuguuuugaguucuaucauaaaugcgacaacaccuguauggaauccgugaagaaugggacauacgauuauccuaaauacucugaggaagcaaagcucaacagagaggagauugacggagucaaacuggaaagcaccaggaucuaucagauucuugccauauacucaacuguggcuaguucccuggucuuggugguuagccucggugcgaucucuuuuuggaugugcucaaauggcagucugcagugccggauuuguaucuga

SEQ ID NO: 132445 - RNA, 1701 nt, Artificial Sequence
  derived and/or modified sequence opt3 from hemagglutinin__InfluenzaA__AGU01881
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggagugacaccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaagaacucagggagcagcugagcaguguguccucuuucgaacgguuugagauguucccgaagaccagcuccuggcccaaccacgacucaaauaagggugucacggcagccuguccucaagcuggggcaaaaaguuuuuauaagaaccugauuuggcucgugaaaaagggaaauagcuacccaaaauuaucuaaguccuauaucaacgauaagggcaaagaaguacugguucuuuggggcauacaucaccccucaacuaccgccgaccagcagagcuuguaccagaaugcugaugccuacguguucgucgggacaagucgcuauucuaagaaauuuaagccugagaucgcgauucgaccaaaagugcgugaccaagagggaagaaugaacuacuauuggacucugaucgaacccggugauaagauuaccuucgaggcaacaggcaaccuaguggucccuagguacgccuuugcuauggaacggaaugccggguccggaaucauaauuagcgacaccccaguucacgauugcaacacgacuugucagacaccggagggcgcaaucaauaccucgcuccccuuccagaacauucauccuaucacuaucgguaaaugcccaaaguaugugaagucuacaaaacugcgccuugcuaccgggcugagaaauguacccuccauucagucaaggggauuguuuggcgccauagcgggcuucaucgaagggggauggacggguaugguggacggcugguacggguaucaccaucaaaacgagcagggaaguggcuacgccgcagaccucaagagcacccagaaugcuauugauaaaaucacaaacaaggucaauuccgugauagagaaaaugaacacucaguuuaccgccguugguaaggaguucaaucaccuggagaagcggauugaaaacuuaaauaaaaagguggacgauggguuccuggacaucuggacauacaacgcugagcuccuuguccuguuggaaaaugagcgcacucuagauuaucacgacucuaacgugaaaaaccuguacgagaagguacgaaaucaacucaaaaacaaugccaaggaaaucggcaacggauguuuugaguucuaucauaagugcgauaauaccuguauggaaagcguuaaaaacggcacauacgacuauccuaaguacucagaggaagcaaaacugaauagagagaagauugauggggugaaacuugagaguaccaggaucuaucagauucuggccauauacuccacugucgcuagcucuuuggugcucgucgugucacugggagcgaucaguuuuuggaugugcagcaacgguuccuuacagugccggauuuguaucuga

SEQ ID NO: 132446 - RNA, 1701 nt, Artificial Sequence
  derived and/or modified sequence opt3 from hemagglutinin__InfluenzaA__AGU01883
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuggaucggacaacggcacuugcuauccaggugauuuuaucgacuacgaagaguugagggagcagcucucaagcgugaguuccuucgaacgguuugagauuuucccgaagacaucuagcuggcccaaucacgauuccaacaagggggucaccgccgcuuguccucaugcaggagccaaaggcuuuuauaagaaucugaucuggcuggugaaaaagggcaacucauacccaaaacucaguauaagcuauaucaauaacaaggaaaaggagguauuaguucugugggggauucaccaccccucuacgacugcugaccaacagucccuuuaccagaaugccgauaccuacguguucgucggaacaucacgcuauagcaaaaaguuuaaaccugagaucgcgauucgaccaaaggugcgugaccaggaagguagaaugaacuacuauuggacuuugguggagcccggcgauaaaaucaccuucgaagcaacagggaaccuggucguuccuagguacgccuuugcuauggagcggaaugccggaaguggcauaauuaucucugacaccccagugcaugauugcaacacgacuugucaaacaccgaagggugcaauuaauaccucccuacccuuccagaacauccacccuaucacuauugggaaaugcccaaaguauguaaagagcacaaaacuccgccuggcuaccggacuuagaaaugugcccucgauacagucuaggggccuguuuggcgccaucgcgggguucauugaaggagguuggacgggcauggucgacgggugguacggauaucaucaccagaacgagcaaggcuccgguuacgccgcagacuugaagucaacccagaaugcuaucgauaaaauaacaaacaaggugaauaguguuauugagaaaaugaacacucaguuuaccgccguggggaaggaguucaaucaccucgaaaagcggaucgaaaaccugaauaaaaaggucgacgauggcuucuuagacaucuggacauacaacgcugagcugcucgugcuucuggaaaaugagcgcacuuuggauuaucaugacagcaacguuaaaaaccuauacgagaagguacgaaaucagcugaaaaacaaugccaaggaaauuggaaacggcuguuuugaguucuaucacaagugcgauaauaccuguauggaauccgugaaaaacgggacauacgacuauccuaaguacucugaggaagcaaaacucaauagagaggagaucgauggagucaagcuggaaagcaccaggauuuaucaaauacuugccaucuacucaacugcugcgaguucccugguguuggucgugagccucggugcaauuucuuuuuggaugugcucaaacggcagucugcagugccggaucuguaucuga

SEQ ID NO: 132447 - RNA, 1701 nt, Artificial Sequence; identical to SEQ ID NO: 132076
  derived and/or modified sequence opt3 from hemagglutinin__InfluenzaA__AGU01884

SEQ ID NO: 132448 - RNA, 1701 nt, Artificial Sequence
  derived and/or modified sequence opt3 from hemagglutinin__InfluenzaA__AGU01885
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugagaaacuguguaagcuaagagggguggcuccccuccaucugggaaaaugcaacauagccgguuggauccuuggcaauccugaaugugagucucugucaacagcaaguagcugguccuacauuguugaaaccucugggucggacaacggaacuugcuauccaggcgauuuuaucgacuacgaggaguugagggaacagcucucaagcgugaguuccuucgagcgguuugaaauuuucccgaagacaucuagcuggcccaaucacgauuccaacaagggugucaccgccgcuuguccucaagcaggggccaaaggauuuuauaagaaucugaucuggcuggugaaaaagggcaacucauacccaaaacucaguaagagcuauauaaaugacaagggcaaagagguauuaguucugugggggauccaucaccccucuacgacugcugaucagcagucccuuuaccagaacgccgacaccuacguguucgucggaacaucacgcuauagcaagaaauuuaagccugagauugcgauccgaccaaaagugcgugaucaagaagguagaaugaauuacuauuggacuuugguggagcccggcgacaagauuaccuucgaagcaacagggaaccuggucguuccuagguacgccuuugcuauggagcggaacgccggaaguggcaucauaauuucugauaccccagugcacgacugcaauacgacuugucagacaccgaaaggugcaaucaacaccucccuacccuuccagaauguacauccuauuacuaucgggaagugcccaaaguaugugaaaagcacaaagcuccgccuggcuaccggacuuagaaacguccccucgauccagucuaggggccuguuuggcgccauugcgggguucauagaaggagguuggacgggcaugguggacgggugguacggauaucaccaucaaaaugagcagggcuccgguuacgccgcagauuugaaaucaacccagaacgcuaucgacaagauuacaaauaaaguuaacagugugaucgagaagaugaauacucaguuuaccgccgucgggaaggaguucaaccaccucgaaaaacggauagaaaaucugaacaagaaaguggaugacggcuucuuagauauuuggacauacaaugcugagcugcucguacuucuggaaaacgagcgcacuuuggacuaucacgauagcaauguuaagaaccuauacgagaaagugcgaaaccaacugaagaauaacgccaaggaaaucggaaauggcuguuuugaguucuaucauaaaugcgacaacaccuguauggaauccgucaagaaugggacauacgauuauccuaaauacucugaggaagcaaagcucaacagagaggagaucgacggagugaaacuggaaagcaccaggauuuaucagauccuugccauuuacucaacugucgcuaguucccugguguugguugugagccucggugcgauaucuuuuuggaugugcucaaauggcagucugcagugccggaucuguauuuga

SEQ ID NO: 132449 - RNA, 1701 nt, Artificial Sequence
  derived and/or modified sequence opt3 from hemagglutinin__InfluenzaA__AGU01887
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcgugaccaggagggaagaaugaacuacuauuggacacugauugaacccggugauaagaucacuuucgaggccaccggcaaccuaguggucccuagguacgcuuuugccguugaacggaaugcaggguccggaauaauuaucagcgacacaccagugcauaacugcaauaccacgugucaaacuccggagggcgcuauuaacacaucgcuccccuuccagaauauccacccuaucaccauugguaaaugcccaaaguauguaaagucuacuaaacugcgccuugccacagggcugagaaacgugcccuccauacagucaaggggauuguuuggcgcgaucgccggcuucauugaagggggauggaccgguauggucgauggcugguacggguaucaucaccagaaugagcaaggaaguggcuacgcagcugaccucaagagcacgcagaacgccaucgacaaaauaaccaauaaggugaacuccguuauugagaaaaugaauacacaguuuacugcuguggguaaggaguucaaccaccuggagaagcggaucgaaaauuuaaacaaaaaggucgaugacggguuccuggauaucuggaccuacaaugccgagcuccuugugcuguuggaaaacgagcgcacacuagacuaucaugauucuaacguuaaaaaucuguacgagaagguacgaaaccagcucaaaaauaacgcaaaggaaauuggcaauggauguuuugaguucuaucacaagugcgacaacacuuguauggaaagcgugaaaaauggcaccuacgauuauccuaaguacucagaggaagccaaacugaacagagagaagaucgacggggucaaacuugagaguacaaggauuuaucaaauacuggcuaucuacuccaccguggcgagcucuuugguccucgugguuucacugggagcaauuaguuuuuggaugugcagcaaugguuccuuacagugccggaucuguaucuga

SEQ ID NO: 132450 - RNA, 1701 nt, Artificial Sequence
  derived and/or modified sequence opt3 from hemagglutinin__InfluenzaA__AGU01888
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuggaucggacaacggcacuugcuauccaggugauuuuaucgacuacgaagaguugagggagcagcucucaagcgugaguuccuucgaacgguuugagauuuucccgaagacaucuagcuggcccaaucacgauuccaacaagggggucaccgccgcuuguccucaagcaggagccaaaggcuuuuauaagaaucugaucuggcuggugaaaaagggcaacucauacccaaaacucaguaagagcuauauaaaugacaaggggaaagaaguauuaguucuguggggaauccaucaccccucuacgacugcugaucagcagucccuuuaccagaacgccgacaccuacguguucgucgguacaucacgcuauagcaagaaauuuaagccugagauugcgauccgaccaaaagugcgugaucaagagggcagaaugaauuacuauuggacuuugguggaacccggggacaagauuaccuucgaggcaacaggaaaccuggucguuccuagguacgccuuugcuauggaacggaacgccggcagugguaucauaauuucugauaccccagugcacgacugcaauacgacuugucagacaccgaaaggggcaaucaacaccucccuacccuuccagaauauucauccuaucacuaucggaaagugcccaaaguauguaaaaagcacaaagcuccgccuggcuaccggccuuagaaacgugcccucgauucagucuaggggccuguuuggggccauagcgggauucaucgaggguggcuggacggggauggucgacggaugguacggcuaucaccaucaaaaugaacaggguuccggguacgccgcagauuugaaaucaacccagaacgcuauugacaagaucacaaauaaagugaacaguguuauagagaagaugaauacucgguuuaccgccgugggcaaggaguucaaccaccucgaaaaacgcauugagaaucugaacaagaaagucgaugacggauucuuagauaucuggacauacaaugcugaacugcucgugcuucuggagaacgaacgaacuuuggacuaucacgauagcaauguaaagaaccuauacgagaaaguuagaaaccagcugaagaauaacgccaaggagaucggcaauggguguuuugaguucuaucauaaaugcgacaacaccuguauggaauccgugaagaauggaacauacgauuauccuaaauacucugaagaggcaaagcucaacagggaagagauugacggugucaaacuggagagcacccggaucuaucaaauucuugccauauacucaacuguggcuaguucccuggucuuggugguuagccucggcgcgaucucuuuuuggaugugcucaaaugggagucugcagugccguauuuguaucuga

SEQ ID NO: 132451 - RNA, 1701 nt, Artificial Sequence; identical to SEQ ID NO: 132442
  derived and/or modified sequence opt3 from hemagglutinin__InfluenzaA__AGU01889

SEQ ID NO: 132452 - RNA, 1701 nt, Artificial Sequence
  derived and/or modified sequence opt3 from hemagglutinin__InfluenzaA__AGU01890
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuggaucggacaacggcacuugcuauccaggugauuuuaucgacuacgaagaguugagggagcagcucucaagcgugaguuccuucgaacgguuugagauuuucccgaagacaucuagcuggcccaaucacgauuccaacaagggggucaccgccgcuuguccucaagcaggagccaaaggcuuuuauaagaaucugaucuggcuggugaaaaagggcaacucauacccaaaacucaguaagagcuauauaaaugacaaggggaaagaaguauuaguucuguggggaauccaucaccccucuacgacugcugaucagcagucccuuuaccagaacgccgacaccuacguguucgucgguacaucacgcuauagcaagaaauuuaagccugagauugcgauccgaccaaaagugcgugaucaagagggcagaaugaauuacuauuggacuuugguggaacccggggacaagauuaccuucgaggcaacaggaaaccuggucguuccuagguacgccuuugcuauggaacggaacgccggcagugguaucauaauuucugauaccccagugcacgacugcaauacgacuugucagacaccgaaaggggcaaucaacaccucccuacccuuccagaauauucauccuaucacuaucggaaagugcccaaaguauguaaaaagcacaaagcuccgccuggcuaccggccuuagaaacgugcccucgauucagucuaggggccuguuuggggccauagcgggauucaucgaggguggcuggacggggauggucgacggaugguacggcuaucaccaucaaaaugaacaggguuccggguacgccgcagauuugaaaucaacccagaacgcuauugacaagaucacaaauaaagugaacaguguuauagagaagaugaauacucaguuuaccgccgugggcaaggaguucaaccaccucgaaaaacggauugagaaucugaacaagaaagucgaugacggauucuuagauaucuggacauacaaugcugaacugcucgugcuucuggagaacgaacgcacuuuggacuaucacgauagcaauguaaagaaccuauacgagaaaguucgaaaccaacugaagaauaacgccaaggagaucggcaauggguguuuugaguucuaucauaaaugcgacaacaccuguauggaauccgugaagaauggaacauacgauuauccuaaauacucugaagaggcaaagcucaacagagaagagauugacggugucaaacuggagagcaccaggaucuaucagauucuugccauauacucaacuguggcuaguucccuggucuuggugguuagccucggcgcgaucucuuuuuggaugugcucaaaugggagucugcagugccggauuuguaucuga

SEQ ID NO: 132453 - RNA, 1701 nt, Artificial Sequence
  derived and/or modified sequence opt3 from hemagglutinin__InfluenzaA__AGU92645
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaacauugucuaccgcaucaaguuggagcuacauuguugagacuuccucuucggacaacggaacaugcuauccaggcgauuuuaucgacuacgaagaacucagggagcagcugucaagcgugaguuccuucgaacgguuugagauuuucccgaagaccucuagcuggcccaaucacgauuccaacaagggugucacggccgcuuguccucaugcaggggccaaaggauuuuauaagaaucugaucuggcucgugaaaaagggcaacucauacccaaaauuaaguaagagcuauauaaaugacaagggcaaagaaguacugguucuuugggggauccaccaccccucuacuaccgcugaucaacaguccuuguaccagaacgccgacacauacguguucgucggaacuucacgcuauagcaagaaauuuaagccugagauugagacccgaccaaaagugcgugaucaggaagguagaaugaauuacuauuggacacugguggagcccggcgacaagaucaccuucgaagcgacggggaaccuagucguuccuagguacgcauuugccauggagcgggaugcuggaaguggcauuaucauaucugacacuccagugcaugacugcaacacaaccugucaaacuccgaaaggugccauuaauacaucccuccccuuccagaacauccacccuauuaccaucgggaagugcccaaaguauguaaaaagcacgaagcugcgccuugcaaccggacugagaaaugugcccucgauccagucuaggggcuuguuuggcgcuauugccggguucauagaaggagguuggacaggcauggucgaugggugguacggauaucaucaccagaacgagcaaggcuccgguuacgcggccgaccucaaaucaacucagaaugcaaucgauaagauuaccaacaaagugaauaguguuaucgagaagaugaacacacaguuuacugcuguggggaaggaguucaaucaccuggagaaacggauagaaaacuuaaauaagaaagucgacgauggcuuccuggacauuuggaccuacaacgccgagcuccuugugcuguuggaaaaugagcgcacacuagauuaucaugacagcaacguaaagaaucuguacgagaaaguucgaaaccagcucaagaacaaugcuaaggaaaucggaaacggcuguuuugaguucuaucacaaaugcgauaauaccuguauggaauccgugaagaacgggacuuacgacuauccuaaauacucugaggaagccaagcugaauagagaggagaucgauggagucaaacuugaaagcacgaggauuuaucaaauccuggcaauuuacucaacagccgcuaguuccuuggugcucgucgugagccugggugcgauaucuuuuuggaugugcucaaacggcaguuuacagugccggaucuguauuuga

SEQ ID NO: 132454 - RNA, 1701 nt, Artificial Sequence
  derived and/or modified sequence opt3 from hemagglutinin__InfluenzaA__AGU92667
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaacauugucuaccgcaucaaguuggagcuacauuguugagacuuccucuucggacaacggaacaugcuauccaggcgauuuuaucgacuacgaagaacucagggagcagcugucaagcgugaguuccuucgaacgguuugagauuuucccgaagaccucuagcuggcccaaucacgauuccaacaagggugucacggccgcuuguccucaugcaggggccaaaggauuuuauaagaaucugaucuggcucgugaaaaagggcaacucauacccaaaauuaaguaagagcuauauaaaugacaagggcaaagaaguacugguucuuugggggauccaccaccccucuacuaccgcugaucaacaguccuuguaccagaacgccgacacauacguguucgucggaacuucacgcuauagcaagaaauuuaagccugagauugcgacccgaccaaaagugcgugaucaggaggguagaaugaauuacuauuggacacugguggaacccggcgacaagaucaccuucgaggcaacggggaaccuagucguuccuagguacgccuuugcuauggaacgggaugccggaaguggcauuaucauaucugacacuccagugcaugacugcaacacaaccugucaaacuccgaaaggugcaauuaauacaucccuccccuuccagaacauccacccuauuaccaucgggaagugcccaaaguauguaaaaagcacgaagcugcgccuugcuaccggacugagaaaugugcccucgauccagucuaggggcuuguuuggcgccauugcgggguucauagagggagguuggacaggcauggucgaugggugguacggauaucaucaccagaacgaacaaggcuccgguuacgccgcagaccucaaaucaacucagaaugcuaucgauaagauuaccaacaaagugaauaguguuaucgagaagaugaacacacaguuuacugccguggggaaggaguucaaucaccuggaaaaacggauagagaacuuaaauaagaaagucgacgauggcuuccuggacauuuggaccuacaacgcugaacuccuugugcuguuggagaaugaacgcgcccuagauuaucaugacagcaacguaaagaaucuguacgagaaaguucgaaaccagcucaagaacaaugcaaaggagaucggaaacggcuguuuugaguucuaucacaaaugcgauaauacauguauggaguccgugaagaacgggaccuacgacuauccuaaauacucugaagaggccaagcugaauagagaagagaucgauggagucaaacuugagagcacuaggauuuaucaaauccuggcuauuuacucaacggcggcaaguuccuuggugcucgucgugagccugggugccauaucuuuuuggaugugcucaaacggcaguuuacagugccggaucuguauuuga

SEQ ID NO: 132455 - RNA, 1701 nt, Artificial Sequence
  derived and/or modified sequence opt3 from hemagglutinin__InfluenzaA__AGU92678
augaaggccauccuggugguccuccuuuacaccuucgcuacagcaaacgccgacacucugugcauuggccaccaugcgaauaacagcacggauaccguugacacaguguuggagaaaaauguaacugugacccacuccgucaacuuacuggaagauaagcauaaugggaaacuauguaagcucagaggaguggcuccccugcaccuugguaaaugcaacauagccggcuggauccuggggaauccugagugugaaacauugucuaccgcaucaaguuggagcuauauuguugagacuuccucuucggacaacggaacaugcuacccaggcgauuuuaucgacuaugaagaacucagggagcagcugucaagcgugaguuccuucgaacgguuugagauuuucccgaagaccucuagcuggcccaaucaugauuccaacaagggugucacggccgcuuguccucacgcaggggccaaaggauuuuacaagaaucugaucuggcucgugaaaaagggcaacucauauccaaaauuaaguaagagcuacauaaaugacaagggcaaagaaguacugguucuuugggggauccaccaucccucuacuaccgcugaucaacaguccuuguaucagaacgccgacacauacguguucgucggaacuucacgcuacagcaagaaauuuaagccugagauugcgacccgaccaaaagugcgugaucaggaggguagaaugaauuauuacuggacacugguggaacccggcgacaagaucaccuucgaggcaacggggaaccuagucguuccuagguaugccuuugcuauggaacgggaugccggaaguggcauuaucauaucugacacuccagugcacgacugcaacacaaccugucaaacuccgaaaggugcaauuaauacaucccuccccuuccagaacauccauccuauuaccaucgggaagugcccaaaguacguaaaaagcacgaagcugcgccuugcuaccggacugagaaaugugcccucgauccagucuaggggcuuguuuggcgccauugcgggguucauagagggagguuggacaggcauggucgaugggugguauggauaccaccaccagaacgaacaaggcuccgguuaugccgcagaccucaaaucaacucagaaugcuaucgauaagauuaccaacaaagugaauaguguuaucgagaagaugaacacacaguuuacugccguggggaaggaguucaaucaucuggaaaaacggauagagaacuuaaauaagaaagucgacgauggcuuccuggacauuuggaccuacaacgcugaacuccuugugcuguuggagaaugaacgcacacuagauuaccacgacagcaacguaaagaaucuguaugagaaaguucgaaaccagcucaagaacaaugccaaggagaucggaaacggcuguuuugaguucuaccauaaaugcgauaauaccuguauggaguccgugaagaacgggacuuaugacuacccuaaauauucugaagaggcaaagcugaauagagaagagaucgauggagucaaacuugagagcacgaggauuuaccaaauccuggccauuuauucaacagcugcgaguuccuuggugcucgucgugagccugggugcaauaucuuuuuggaugugcucaaacggcaguuuacagugccggaucuguauuuga

SEQ ID NO: 132456 - RNA, 1701 nt, Artificial Sequence
  derived and/or modified sequence opt3 from hemagglutinin__InfluenzaA__AGU92711
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaacaaggaaacagcuacccaaaguuaucuaaauccuauauaaaugacaagggcaaggaaguacugguucuuuggggcauccaccaccccucaacgagcgcugaucagcagaguuuguaccagaacgccgacgcguacguguucgucgggucuucccgcuauagcaaaaaguuuaaaccugagauugcaauccgaccaaaggugcgugaucaagagggaagaaugaauuacuauuggacucugguggaacccggugacaaaauuaccuucgaggccacaggcaaccuagucguuccuagguacgcuuuugccauggaacggaacgcagggucgggaaucauaauuucugauacuccagugcaugacugcaauaccacaugucagaccccgaagggcgcuaucaacacgucccuccccuuccagaauauucacccuaucacuaucgguaaaugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaucaccaaaaugaacagggauccggcuacgcagcugaucucaagucuacacagaacgccauugacgagaucaccaauaaagugaacagcguuauagagaagaugaauacgcaguuuaccgcuguggguaaagaguucaaccaccuggaaaagcggauugaaaauuuaaacaagaaagucgaugacggguuccuggauaucuggacauacaaugccgagcuccuugugcuguuggaaaacgagcgcacucuagacuaucaugauucaaauguaaagaaccuguacgagaaaguucgaagucaacucaagaacaaugcaaaagaaaucggcaacggauguuuugaguucuaucacaagugcgacaauaccuguauggaauccgugaagaacggcacauacgauuauccuaaauacagcgaggaagccaagcugaauagagaggagauugacggggucaaacuugaaucuacuaggaucuaucagauucuggcuauauacucaaccguggcgaguagcuugguccucgugguuucccugggagcaaucucuuuuuggaugugcucgaacgguagcuuacagugccggauuuguaucuga

SEQ ID NO: 132457 - RNA, 1701 nt, Artificial Sequence
  derived and/or modified sequence opt3 from hemagglutinin__InfluenzaA__AGU92722
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucagacaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggucuucccgcuauagcaagaaauuuaagccugagauugcaauccgaccaaaagugcgugaccaggagggaagaaugaacuacuauuggacucugguggaacccggugauaagauuaccuucgaggccacaggcaaucuagucguuccuagguacgcuuuugccauggaacggaacgcagggucgggaaucauaauuucugacacuccagugcaugacugcaacaccacaugucaaaccccgaaaggcgcuaucaauacgucccuccccuuccagaacauucacccuaucacuaucgguaagugcccaaaguauguaaaaucaacaaagcugcgccuugccaccgggcugagaaaugugcccaguauucagagcaggggauuguuuggcgcgauagccggcuucaucgaagggggauggacugguauggucgauggcugguacggguaucaucaccagaacgaacaaggauccggcuacgcagcugaccucaaaucuacacagaaugccauugaugagaucaccaacaaggugaauagcguuauagagaaaaugaacacgcaguuuaccgcuguggguaaggaguucaaucaccuggaaaagcggauugaaaacuuaaauaaaaaggucgacgauggguuccuggacaucuggacauacaacgccgagcuccuugugcuguuggaaaaugagcgcacucuagauuaucaugacucaaacguaaagaaucuguacgagaagguucgaagucagcucaaaaacaacgcaaaggaaaucggcaauggauguuuugaguucuaucacaagugcgauaacaccuguauggaauccgugaaaaauggcacauacgacuauccuaaguacagcgaggaagccaaacugaacagagaggagauugauggggucaaacuugaaucuacuaggaucuaucaaauucuggcuauauacucaaccguggcgaguagcuugguccucgugguuucccugggagcaaucucuuuuuggaugugcucgaaugguagcuuacagugccggauuuguaucuga

SEQ ID NO: 132458 - RNA, 1701 nt, Artificial Sequence; identical to SEQ ID NO: 132457
  derived and/or modified sequence opt3 from hemagglutinin__InfluenzaA__AGU92733

SEQ ID NO: 132459 - RNA, 1701 nt, Artificial Sequence
  derived and/or modified sequence opt3 from hemagglutinin__InfluenzaA__AGU92744
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucagacaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggucuucccgcuauagcaagaaauuuaagccugagauugcaauccgaccaaaagugcgugaccaggagggaagaaugaacuacuauuggacucugguggaacccggugauaagauuaccuucgaggccacaggcaaucuagucguuccuagguacgcuuuugccauggaacggaacgcagggucgggaaucauaauuucugacacuccagugcaugacugcaacaccacaugucaaaccccgaaaggcgcuaucaauacgucccuccccuuccagaacauucacccuaucacuaucgguaagugcccaaaguauguaaaaucaacaaagcugcgccuugccaccgggcugagaaaugugcccaguauucagagcaggggauuguuuggcgcgauagccggcuucaucgaagggggauggacugguauggucgauggcugguacggguaucaucaccagaacgaacaaggauccggcuacgcagcugaccucaaaucuacacagaaugccauugaugagaucaccaacaaggugaauagcguuauagagaaaaugaacacgcaguuuaccgcuguggguaaggaguucaaucaccuggaaaagcggauugaaaacuuaaauaaaaaggucgacgauggguuccuggacaucuggacauacaacgccgagcuccuugugcuguuggaaaaugagcgcacucuagauuaucaugacucaaacguaaagaaucuguacgagaagguucgaagucagcucaaaaacaacgcaaaggaaaucggcaauggauguuuugaguucuaucacaagugcgauaacaccuguauggaauccgugaaaaauggcgccuacgacuauccuaaguacagcgaggaagcuaaacugaacagagaggagauugauggggucaaacuugaaucuacaaggaucuaucaaauucuggcgauauacucaacuguggcaaguagcuugguccucgugguuucccugggagccaucucuuuuuggaugugcucgaaugguagcuuacagugccggauuuguaucuga

SEQ ID NO: 132460 - RNA, 1701 nt, Artificial Sequence
  derived and/or modified sequence opt3 from hemagglutinin__InfluenzaA__AGU92755
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaaggaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcaugacugcaauaccacaugucaaaccccgaagggcgcuaucaacacgucccuccccuuccagaauauucacccuaucacuaucgguaaaugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaucaccagaaugagcaaggauccggcuacgcagcugaucucaagucuacacagaacgccauugacgagaucaccaauaaagugaacagcguuauagaaaagaugaauacgcaguuuaccgcuguggguaaagaguucaaccaccuggaaaagcggauugagaauuuaaacaagaaagucgaugacggguuccuggauaucuggacauacaaugccgaacuccuugugcuguuggagaacgagcgcacucuagacuaucaugauucaaauguaaagaaccuguacgaaaaaguucgaagucagcucaagaacaaugcaaaagagaucggcaacggauguuuugaguucuaucacaagugcgacaauaccuguauggaguccgugaagaacggcacauacgauuauccuaaauacagcgaagaggccaagcugaauagagaggaaauugacggggucaaacuugagucuacuaggaucuaucaaauucuggcuauauacucaaccguggcgaguagcuugguccucgugguuucccugggagcaaucucuuuuuggaugugcucgaacgguagcuuacagugccggauuuguaucuga

SEQ ID NO: 132461 - RNA, 1701 nt, Artificial Sequence
  derived and/or modified sequence opt3 from hemagglutinin__InfluenzaA__AGU92766
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaacauugucuaccgcaucaaguuggagcuacauuguugagacuuccucuucggacaacggaacaugcuauccaggcgauuuuaucgacuacgaagaacucagggagcagcugucaagcgugaguuccuucgaacgguuugagauuuucccgaagaccucuagcuggcccaaucacgaauccaacaagggugucacggccgcuuguccucaugcaggggccaaaggauuuuauaagaaucugaucuggcucgugaaaaagggcaacucauacccaaaauuaaguaagagcuauauaaaugauaagggcaaagagguacugguucuuugggggauccaccaccccucuacuaccgcugaccaacaguccuuguaccagaacgccgaugcguacguguucgucggaacaucacgcuauagcaagaaauuuaagccugagauugcaacucgaccaaaagugcgugaccaggaagguagaaugaauuacuauuggacccugguggagcccggcgauaagaucacauucgaagccaccgggaaccuagucguuccuagguacgcuuuugccauggagcgggacgcaggaaguggcauuaucauaucugauacgccagugcaugacugcaacacuacaugucaaaccccgaaaggugcuauuaauacuucccuccccuuccagaacauccacccuauuacaaucgggaagugcccaaaguauguaaaaagcaccaagcugcgccuugccacgggacugagaaaugugcccucgauccagucuaggggcuuguuuggcgcgauugccggguucauagaaggagguuggaccggcauggucgacgggugguacggauaucaucaccagaacgagcaaggcuccgguuacgcagcugaucucaaaucaacacagaaugccaucgacaagauuacuaacaaagugaauaguguuaucgagaagaugaacacccaguuuacagcuguggggaaggaguucaaucaccuggagaaacggauagaaaacuuaaauaagaaagucgaugacggcuuccuggauauuuggacuuacaacgccgagcuccuugugcuguuggaaaaugagcgcacccuagacuaucaugauagcaacguaaagaaucuguacgagaaaguucgaaaccagcucaagaacaaugcaaaggaaaucggaaacggcuguuuugaguucuaucacaaaugcgacaauacauguauggaauccgugaagaacgggaccuacgauuauccuaaauacucugaggaagccaagcugaauagagaggagaucgacggagucaaacuugaaagcacuaggauuuaucaaauccuggcuauuuacucaacggcggcaaguuccuuggugcucgucgugagccugggugccauaucuuuuuggaugugcucaaacggcaguuuacagugccggaucuguauuuga

SEQ ID NO: 132462 - RNA, 1701 nt, Artificial Sequence
  derived and/or modified sequence opt3 from hemagglutinin__InfluenzaA__AGU92777
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaacauugucuaccgcaucaaguuggagcuacauuguugagacuuccucuucggacaacggaacaugcuauccaggcgauuuuaucgacuacgaagaacucagggagcagcugucaagcgugaguuccuucgaacgguuugagauuuucccgaagaccucuagcuggcccaaucacgaauccaacaagggugucacggccgcuuguccucaugcaggggccaaaggauuuuauaagaaucugaucuggcucgugaaaaagggcaacucauacccaaaauuaaguaagagcuauauaaaugauaagggcaaagagguacugguucuuugggggauccaccaccccucuacuaccgcugaccaacaguccauuuaccagaacgccgauacauacguguucgucggaacuucacgcuauagcaagaaauuuaagccugagaucgcgacccgaccaaaagugcgugaccaggaagguagaaugaauuacuauuggacauugguggagcccggcgauaagauuaccuucgaagcaacggggaaccuggucguuccuagguacgccuuugcuauggagcgggacgccggaaguggcaucauaauuucugauacuccagugcaugacugcaacacaaccugucaaacuccgaaaggugcaaucaauacaucccuacccuuccagaacauucacccuaucaccaucgggaagugcccaaaguauguaaaaagcacgaagcuccgccuggcuaccggacuuagaaaugugcccucgauucagucuaggggccuguuuggcgccauagcgggguucaucgaaggagguuggacaggcauggucgacgggugguacggauaucaucaccagaacgagcaaggcuccgguuacgccgcagauuugaaaucaacucagaaugcuauugacaagaucaccaacaaagugaauaguguuauagagaagaugaacacacaguuuacugccguggggaaggaguucaaucaccucgagaaacggauugaaaaccugaauaagaaagucgaugacggcuucuuagauaucuggaccuacaacgcugagcugcucgugcuucuggaaaaugagcgcacauuggacuaucaugauagcaacguaaagaaucuauacgagaaaguucgaaaccagcugaagaacaaugccaaggaaaucggaaacggcuguuuugaguucuaucacaaaugcgacaauaccuguauggaauccgugaagaacgggacuuacgauuauccuaaauacucugaggaagcaaagcucaauagagaggagauugacggagucaaacuggaaagcacgaggaucuaucaaauucuugccauauacucaacagcugcgaguucccugguguuggucgugagccucggugcaaucucuuuuuggaugugcucaaacggcagucugcagugccggauuuguaucuga

SEQ ID NO: 132463 - RNA, 1701 nt, Artificial Sequence
  derived and/or modified sequence opt3 from hemagglutinin__InfluenzaA__AGU92788
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaacauugucuaccgcaucaaguuggagcuacauuguugagacuuccucuucggacaacggaacaugcuauccaggcgauuuuaucgacuacgaagaacucagggagcagcugucaagcgugaguuccuucgaacgguuugagauuuucccgaagaccucuagcuggcccaaucacgauuccgacaagggugucacggccgcuuguccucaugcaggggccaaaggauuuuauaagaaccugaucuggcucgugaaaaagggcaauucauacccaaaauuaaguaagagcuauauaaacgauaagggcaaagaaguacugguucuuugggggauccaccaccccucuacuaccgcugaccaacaguccuuguaccagaaugccgaugcguacguguucgucggaacaucacgcuauagcaagaaauuuaagccugagauugcaacucgaccaaaagugcgugacagagaggguaggaugaacuacuauuggacccugguggaacccggcgauaagaucacauucgaggccaccgggaaucuagucguuccucgguacgcuuuugccauggaacgcgacgcaggaaguggcauuaucauaucugacacgccagugcaugauugcaacacuacaugucagaccccgaaaggugcuauuaacacuucccuccccuuccaaaauauccacccuauuacaaucgggaagugcccaaaguauguaaaaagcaccaagcugagacuugccacgggacugaggaacgugcccucgauccagucucggggcuuguuuggcgcgauugccggguucauagagggagguuggaccggcaugcucgacgggugguacggauaucaucaccagaaugaacagggcuccgguuacgcagcugaucugaaaucaacacaaaacgccaucgacaagauuacuaauaaagucaacagugugaucgagaagaugaauacccaguuuacagcuguugggaaggaguucaaccacuuagaaaaacgcauagagaaucugaacaagaaaguggaugacggcuuccucgauauuuggacuuacaaugccgaacuucuggucuugcuagagaacgaacgaacccuggacuaucaugauagcaaugugaagaaccucuacgagaaaguaagaaaucagcugaagaacaacgcaaaggagaucggaaauggcuguuuugaguucuaucacaaaugcgacaacacauguauggaguccguuaagaaugggaccuacgauuauccuaaauacucugaagaggccaaacuuaacagggaagagaucgacggagugaagcuggagagcacucggauuuaucagaucuuggcuauuuacucaacggcggcaaguucccucguccugguggucagcuuaggugccauaucuuuuuggaugugcucaaauggcagucugcaaugccguaucuguauuuga

SEQ ID NO: 132464 - RNA, 1701 nt, Artificial Sequence
  derived and/or modified sequence opt3 from hemagglutinin__InfluenzaA__AGU92799
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaacauugucuaccgcaucaaguuggagcuacauuguugagacuuccucuucggacaacggaacaugcuauccaggcgauuuuaucgacuacgaagaacucagggagcagcugucaagcgugaguuccuucgaacgguuugagauuuucccgaagaccucuagcuggcccgaucacgacuccaauaagggugucacggccgcuuguccucaugcaggggccaaaggauuuuauaagaaccugaucuggcucgugaaaaagggcaauucauacccaaaauuaaguaagagcuauauaaacgauaagggcaaagaaguacugguucuuugggggauccaccaccccucuacuaccgcugaccaacaguccuuguaccagaaugccgaugcguacguguucgucggaacaucacgcuauagcaagaaauuuaagccugagauugcaacucgaccaaaagugcgugacagagaggguaggaugaacuacuauuggacccugguggaacccggcgauaagaucacauucgaggccaccgggaaucuagucguuccucgguacgcuuuugccauggaacgcgacgcaggaaguggcauuaucauaucugacacgccagugcaugauugcaacacuacaugucagaccccgaaaggugcuauuaacacuucccuccccuuccaaaauauccacccuauuacaaucgggaagugcccaaaguauguaaaaagcaccaagcugagacuugccacgggacugaggaacgugcccucgauccagucucggggcuuguuuggcgcgauugccggguucauagagggagguuggaccggcauggucgacgggugguacggauaucaucaccagaaugaacagggcuccgguuacgcagcugaucucaaaucaacacaaaacgccaucgacaagauuacuaauaaagugaacaguguuaucgagaagaugaauacccaguuuacagcuguggggaaggaguucaaccaccuggaaaaacgcauagagaauuuaaacaagaaagucgaugacggcuuccuggauauuuggacuuacaaugccgaacuccuugugcuguuggagaacgaacgaacccuagacuaucaugauagcaauguaaagaaccuguacgagaaaguuagaaaucagcucaagaacaacgcaaaggagaucggaaauggcuguuuugaguucuaucacaaaugcgacaacacauguauggaguccgugaagaaugggaccuacgauuauccuaaauacucugaagaggccaagcugaacagggaagagaucgacggagucaaacuugagagcacucggauuuaucagauccuggcuauuuacucaacggcggcaaguuccuuggugcucgucgugagccugggugccauaucuuuuuggaugugcucaaauggcaguuuacaaugccguaucuguauuuga

SEQ ID NO: 132465 - RNA, 1701 nt, Artificial Sequence
  derived and/or modified sequence opt3 from hemagglutinin__InfluenzaA__AGU92821
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaacauugucuaccgcaucaaguuggagcuacauuguugagacuuccucuucggacaacggaacaugcuauccaggcgauuuuaucgacuacgaagaacucagggagcagcugucaagcgugaguuccuucgaacgguuugagauuuucccgaagaccucuagcuggcccaaucacgauuccaacaagggugucacggccgcuuguccucaugcaggggccaaaggauuuuauaagaaucugaucuggcucgugaaaaagggcaacucauacccaaaauuaaguaagagcuauauaaaugacaagggcaaagaaguacugguucuuugggggauccaccaccccucuacuaccgcugaucaacaguccuuguaccagaacgccgacacauacguguucgucggaacuucacgcuauagcaagauguuuaaaccugagauugcgacccgaccaaaggugcgugauagagaggguaggaugaauuacuauuggacacugguggaacccggcgacaaaaucaccuucgaggcaacggggaaccuagucguuccucgguacgccuuugcuauggaacgcgaugccggaaguggcauuaucauaucugacacuccagugcaugacugcaacacaaccugucagacuccgaagggugcaauuaauacaucccuccccuuccaaaacauccacccuauuaccaucgggaaaugcccaaaguauguaaagagcacgaaacugagacuugcuaccggacugaggaaugugcccucgauccagucucggggcuuguuuggcgccauugcgggguucauagagggagguuggacaggcauggucgaugggugguacggauaucaucaccagaacgaacagggcuccgguuacgccgcagaccucaagucaacucaaaaugcuaucgauaaaauuaccaacaaggugaauaguguuaucgagaaaaugaacacacaguuuacugccguggggaaggaguucaaucaccuggaaaagcgcauagagaacuuaaauaaaaaggucgacgauggcuuccuggacauuuggaccuacaacgcugaacuccuugugcuguuggagaaugaacgaacacuagauuaucaugacagcaacguaaagaaucuguacgagaagguuagaaaccagcucaaaaacaaugccaaggagaucggaaacggcuguuuugaguucuaucacaagugcgauaauaccuguauggaguccgugaaaaacgggacuuacgacuauccuaaguacucugaagaggcaaaacugaauagggaagagaucgauggagucaaacuugagagcacgcggauuuaucagauccuggccauuuacucaacagcugcgaguuccuuggugcucgucgugagccugggugcaauaucuuuuuggaugugcucaaacggcaguuuacaaugccguaucuguauuuga

SEQ ID NO: 132466 - RNA, 1701 nt, Artificial Sequence
  derived and/or modified sequence opt3 from hemagglutinin__InfluenzaA__AGU92843
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggagacagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggucuucccgcuauagcaagaaauuuaagccugagauugcaauccgaccaaaagugcgugacagagagggaaggaugaacuacuauuggacucugguggaacccggugauaagauuaccuucgaggccacaggcaaucuagucguuccucgguacgcuuuugccauggaacgcaacgcagggucgggaaucauaauuucugacacuccagugcaugacugcaacaccacaugucagaccccgaaaggcgcuaucaauacgucccuccccuuccaaaacauucacccuaucacuaucgguaagugcccaaaguauguaaaaucaacaaagcugagacuugccaccgggcugaggaaugugcccaguauucagagccggggauuguuuggcgcgauagccggcuucaucgaagggggauggacugguauggucgauggcugguacggguaucaucaccagaacgaacagggauccggcuacgcagcugaccucaaaucuacacaaaaugccauugaugagaucaccaacaaggugaauagcguuauagagaaaaugaacacgcaguuuaccgcuguggguaaggaguucaaucaccuggaaaagcgcauugaaaacuuaaauaaaaaggucgacgauggguuccuggacaucuggacauacaacgccgagcuccuugugcuguuggaaaaugagcgaacucuagauuaucaugacucaaacguaaagaaucuguacgagaagguuagaagucagcucaaaaacaacgcaaaggaaaucggcaauggauguuuugaguucuaucacaagugcgauaacaccuguauggaauccgugaaaaauggcacauacgacuauccuaaguacagcgaggaagccaaacugaacagggaggagauugauggggucaaacuugaaucuacucggaucuaucagauucuggcuauauacucaaccguggcgaguagcuugguccucgugguuucccugggagcaaucucuuuuuggaugugcucgaaugguagcuuacaaugccguauuuguaucuga

SEQ ID NO: 132467 - RNA, 1710 nt, Artificial Sequence
  derived and/or modified sequence opt3 from hemagglutinin__InfluenzaA__AGU92854
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucagacaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggucuucccgcuauagcaagaaauuuaagccugagauugcaauccgaccaaaagugcgugacagagagggaaggaugaacuacuauuggacucugguggaacccggugauaagauuaccuucgaggccacaggcaaucuagucguuccucgguacgcuuuugccauggaacgcaacgcagggucgggaaucauaauuucugacacuccagugcaugacugcaacaccacaugucagaccccgaaaggcgcuaucaauacgucccucacuucacugcccuuccaaaacauucacccuaucacaaucgguaagugcccaaaguauguaaaaaguaccaaacuuagacuggccacuggguugaggaaugugcccagcauucagucccggggacucuuuggcgcgauagccggcuucaucgaagggggauggacagguauggucgauggcugguacggguaucaucaccagaacgaacagggaucuggcuacgcagcugaccugaaaagcacccaaaaugccauugaugagaucacgaacaagguuaauucagugauagagaaaaugaacacccaguuuacagcuguggguaaggaguucaaucacuuagaaaagcgcauugaaaaccugaauaaaaaggucgacgauggguuccucgacaucuggacuuacaacgccgagcuucugguguugcuagaaaaugagcgaacccuggauuaucaugacaguaacguaaagaaucucuacgagaagguuagaucccagcugaaaaacaacgcaaaggaaaucggcaauggauguuuugaguucuaucacaagugcgauaacacauguauggaaagcgugaaaaauggcacuuacgacuauccuaaguacucugaggaagccaaacuuaacagggaggagauugauggggucaagcuggaaucaacccggaucuaucagauuuuggcuauauacaguacaguggcgagcucccucguccuggugguuucuuuaggagcaaucucguuuuggaugugcagcaaugguucccugcaaugccguauuuguaucuga

SEQ ID NO: 132468 - RNA, 1701 nt, Artificial Sequence
  derived and/or modified sequence opt3 from hemagglutinin__InfluenzaA__AGU92887
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgaugaccaacagaguuuguaccagaacgcugaugccuacguguucgucgggucuucccgcuauagcaagaaauuuaagccugagauugcgauccgaccaaaagugcgugacagagagggaaggaugaauuacuauuggacucugguggaacccggugauaagauuaccuucgaggcaacaggcaaccuagucguuccucgguacgccuuugcuauggaacgcaacgccgggucgggaaucauaauuucugacacuccagugcaugacugcaauaccacaugucagaccccgaaaggcgcaaucaacacgucccuccccuuccaaaauauucacccuaucacuaucgguaagugcccaaaguauguaaaaucaacaaagcugagacuugcuaccgggcugaggaacgugcccaguauucagagccggggauuguuuggcgccauagcgggcuucaucgaagggggauggacugguauggucgauggcugguacggguaucaucaccagaaugaacagggauccggcuacgccgcagaccucaaaucuacacaaaacgcuauugaugagaucaccaauaaggugaacagcguuauagagaaaaugaauacgcaguuuaccgccguggguaaggaguucaaccaccuggaaaagcgcauugaaaauuuaaacaaaaaggucgacgauggguuccuggacaucuggacauacaaugcugagcuccuugugcuguuggaaaacgagcgaacucuagauuaucaugacucaaauguaaagaaccuguacgagaagguuagaagucagcucaaaaacaaugccaaggaaaucggcaacggauguuuugaguucuaucacaagugcgauaauaccuguauggaauccgugaaaaacggcacauacgacuauccuaaguacagcgaggaagcaaaacugaauagggaggagauugauggggucaaacuugaaucuacucggaucuaucagauucuggccauauacucaaccguggcuaguagcuugguccucgugguuucccugggagcgaucucuuuuuggaugugcucgaacgguagcuuacaaugccguauuuguaucuga

SEQ ID NO: 132469 - RNA, 1701 nt, Artificial Sequence; identical to SEQ ID NO: 132453
  derived and/or modified sequence opt3 from hemagglutinin__InfluenzaA__AGU92898

SEQ ID NO: 132470 - RNA, 1701 nt, Artificial Sequence; identical to SEQ ID NO: 132454
  derived and/or modified sequence opt3 from hemagglutinin__InfluenzaA__AGU92909

SEQ ID NO: 132471 - RNA, 1701 nt, Artificial Sequence; identical to SEQ ID NO: 132456
  derived and/or modified sequence opt3 from hemagglutinin__InfluenzaA__AGU92931

SEQ ID NO: 132472 - RNA, 1701 nt, Artificial Sequence; identical to SEQ ID NO: 132457
  derived and/or modified sequence opt3 from hemagglutinin__InfluenzaA__AGU92942

SEQ ID NO: 132473 - RNA, 1701 nt, Artificial Sequence; identical to SEQ ID NO: 132457
  derived and/or modified sequence opt3 from hemagglutinin__InfluenzaA__AGU92953

SEQ ID NO: 132474 - RNA, 1701 nt, Artificial Sequence
  derived and/or modified sequence opt3 from hemagglutinin__InfluenzaA__AGU92964
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaacauugucuaccgcaucaaguuggagcuacauuguugagacuuccucuucggacaacggaacaugcuauccaggcgauuuuaucgacuacgaagaacucagggagcagcugucaagcgugaguuccuucgaacgguuugagauuuucccgaagaccucuagcuggcccaaucacgauuccaacaagggugucacggccgcuuguccucaugcaggggccaaaggauuuuauaagaaucugaucuggcucgugaaaaagggcaacucauacccaaaauuaaguaagagcuauauaaaugacaagggcaaagaaguacugguucuuugggggauccaccaccccucuacuaccgcugaucaacaguccuuguaccagaacgccgacgcguacguguucgucggaacaucacgcuauagcaagaaauuuaagccugagauugcaacucgaccaaaagugcgugauagagaggguaggaugaauuacuauuggacccugguggaacccggcgacaagaucacauucgaggccaccgggaaccuagucguuccucgguacgcuuuugccauggaacgcgaugcaggaaguggcauuaucauaucugacacgccagugcaugacugcaacacuacaugucagaccccgaaaggugcuauuaauacuucccuccccuuccaaaacauccacccuauuacaaucgggaagugcccaaaguauguaaaaagcaccaagcugagacuugccacgggacugaggaaugugcccucgauccagucucggggcuuguuuggcgcgauugccggguucauagagggagguuggaccggcaugcucgaugggugguacggauaucaucaccagaacgaacagggcuccgguuacgcagcugaccugaaaucaacacaaaaugccaucgauaagauuacuaacaaagucaauagugugaucgagaagaugaacacccaguuuacagcuguugggaaggaguucaaucacuuagaaaaacgcauagagaaccugaauaagaaaguggacgauggcuuccucgacauuuggacuuacaacgccgaacuucuggucuugcuagagaaugaacgaacccuggauuaucaugacagcaacgugaagaaucucuacgagaaaguaagaaaccagcugaagaacaaugcaaaggagaucggaaacggcuguuuugaguucuaucacaaaugcgauaauacauguauggaguccguuaagaacgggaccuacgacuauccuaaauacucugaagaggccaaacuuaauagggaagagaucgauggagugaagcuggagagcacucggauuuaucagaucuuggcuauuuacucaacggcggcaaguucccucguccugguggucagcuuaggugccauaucuuuuuggaugugcucaaacggcagucugcaaugccguaucuguauuuga

SEQ ID NO: 132475 - RNA, 1701 nt, Artificial Sequence
  derived and/or modified sequence opt3 from hemagglutinin__InfluenzaA__AGU92975
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaacauugucuaccgcaucaaguuggagcuacauuguugagacuuccucuucggacaacggaacaugcuauccaggcgauuuuaucgacuacgaagaacucagggagcagcugucaagcgugaguuccuucgaacgguuugagauuuucccgaagaccucuagcuggcccaaucacgauuccaacaagggugucacggccgcuuguccucaugcaggggccaaaggauuuuauaagaaucugaucuggcucgugaaaaaggaaaacucauacccaaaauuaaguaagagcuauauaaaugacaagggcaaagagguacugguucuuuggggcauccaccaccccucuacuaccgcugaucaacaguccuuguaccagaacgccgacacauacguguucgucgggacuucacgcuauagcaagaaauuuaagccugagauugcgacccgaccaaaagugcgugauagagaaggaaggaugaauuacuauuggacacugguggagcccggugacaagaucaccuucgaagcaacgggcaaccuagucguuccucgguacgccuuugcuauggagcgcgaugccgggaguggaauuaucauaucugacacuccagugcaugacugcaacacaaccugucagacuccgaaaggcgcaauuaauacaucccuccccuuccaaaacauccacccuauuaccaucgguaagugcccaaaguauguaaaaagcacgaagcugagacuugcuaccgggcugaggaaugugcccucgauccagucucggggauuguuuggcgccauugcgggcuucauagaagggggauggacagguauggucgauggcugguacggguaucaucaccagaacgagcagggauccggcuacgccgcagaccucaaaucaacucaaaaugcuaucgauaagauuaccaacaaagugaauaguguuaucgagaagaugaacacacaguuuacugccguggguaaggaguucaaucaccuggagaaacgcauagaaaacuuaaauaagaaagucgacgauggguuccuggacauuuggaccuacaacgcugagcuccuugugcuguuggaaaaugagcgaacacuagauuaucaugacagcaacguaaagaaucuguacgagaaaguuagaaaccagcucaagaacaaugccaaggaaaucggcaacggauguuuugaguucuaucacaaaugcgauaauaccuguauggaauccgugaagaacggcacuuacgacuauccuaaauacucugaggaagcaaagcugaauagggaggagaucgauggggucaaacuugaaagcacgcggauuuaucagauccuggccauuuacucaacagcugcgaguuccuuggugcucgucgugagccugggagcaauaucuuuuuggaugugcucaaacgguaguuuacaaugccguaucuguauuuga

SEQ ID NO: 132476 - RNA, 1701 nt, Artificial Sequence; identical to SEQ ID NO: 132466
  derived and/or modified sequence opt3 from hemagglutinin__InfluenzaA__AGU92986

SEQ ID NO: 132477 - RNA, 1701 nt, Artificial Sequence
  derived and/or modified sequence opt3 from hemagglutinin__InfluenzaA__AGU92997
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagauguuuaaaccugagauugcaauccgaccaaaggugcgugauagagagggaaggaugaauuacuauuggacucugguggaacccggugacaaaauuaccuucgaggccacaggcaaccuagucguuccucgguacgcuuuugccauggaacgcaacgcagggucgggaaucauaauuucugauacuccagugcaugacugcaauaccacaugucagaccccgaagggcgcuaucaacacgucccuccccuuccaaaauauucacccuaucacuaucgguaaaugcccaaaguauguaaagucaacaaaacugagacuugccaccgggcugaggaacgugcccaguauucagagccggggauuguuuggcgcgauagccggcuucaucgaagggggauggacugguauggucgacggcugguacggguaucaucaccagaaugaacagggauccggcuacgcagcugaucucaagucuacacaaaacgccauugacgagaucaccaauaaagugaacagcguuauagagaagaugaauacgcaguuuaccgcuguggguaaagaguucaaccaccuggaaaagcgcauugaaaauuuaaacaagaaagucgaugacggguuccuggauaucuggacauacaaugccgagcuccuugugcuguuggaaaacgagcgaacucuagacuaucaugauucaaauguaaagaaccuguacgagaaaguuagaagucagcucaagaacaaugcaaaagaaaucggcaacggauguuuugaguucuaucacaagugcgacaauaccuguauggaauccgugaagaacggcacauacgauuauccuaaauacagcgaggaagccaagcugaauagggaggagauugacggggucaaacuugaaucuacucggaucuaucagauucuggcuauauacucaaccguggcgaguagcuugguccucgugguuucccugggagcaaucucuuuuuggaugugcucgaacgguagcuuacaaugccguauuuguaucuga

SEQ ID NO: 132478 - RNA, 1701 nt, Artificial Sequence; identical to SEQ ID NO: 132468
  derived and/or modified sequence opt3 from hemagglutinin__InfluenzaA__AGU93008

SEQ ID NO: 132479 - RNA, 1698 nt, Artificial Sequence; identical to SEQ ID NO: 128570
  derived and/or modified sequence opt3 from hemagglutinin__InfluenzaA__AGU93019

SEQ ID NO: 132480 - RNA, 1701 nt, Artificial Sequence; identical to SEQ ID NO: 129066
  derived and/or modified sequence opt3 from hemagglutinin__InfluenzaA__AGU93031

SEQ ID NO: 132481 - RNA, 1701 nt, Artificial Sequence
  derived and/or modified sequence opt3 from hemagglutinin__InfluenzaA__AGU93042
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaacauugucuaccgcaaacucauggaguuacauuguugagacuagcuccucugacaauggaacaugcuauccaggcgauuuuaucgacuacgaagaacucagggagcagcugucgucagugagcaguuucgaacgguuugagauuuucccgaagaccuccucuuggcccaaccacgauagcaauaagggugucacggccgcuuguccucaugcaggggccaaaggauuuuauaagaaccugaucuggcucgugaaaaagggcaauuccuacccaaaauuaucaaagaguuauauaaacgacaagggcaaagaaguacugguucuuugggggauccaccaccccagcacuaccgcugaucaacagucuuuguaccagaaugccgacacauacguguucgucggaacuucccgcuauucaaagaaauuuaagccugagauugcgauccgaccaaaagugcgugaucaggaggguagaaugaacuacuauuggacccugguggaacccggcgacaagauuacauucgaggcaaccgggaaccuagucguuccuagguacgccuuugcuauggaacgggaugccggaagcggcaucauaauuagugacacgccagugcaugacugcaauacuacaugucaaaccccgaaaggugcaaucaacacuucucuccccuuccagaauauucacccuaucacaaucgggaagugcccaaaguauguaaaauccaccaagcugcgccuugcuacgggacugagaaacgugcccagcauucagucgaggggcuuguuuggcgccauagcgggguucaucgagggagguuggaccggcauggucgaugggugguacggauaucaucaccagaaugaacaaggcucugguuacgccgcagaccucaaauccacacagaacgcuauugauaagaucacuaauaaagugaacucaguuauagagaagaugaauauucaguuuaccgccguggggaaggaguucaaccaccuggaaaaacggaucgagaauuuaaacaagaaagucgacgauggcuuccuggacaucuggacauacaaugcugaacuccuugugcuguuggagaacgaacgcacucuagauuaucaugacaguaauguaaagaaccuguacgagaaaguucgaaaccagcucaagaauaacgccaaggagauuggaaauggcuguuuugaguucuaucacaaaugcgauaacaccuguauggagagcgugaagaaugggacauacgacuauccuaaauacuccgaagaggcaaagcugaacagagaagagaucgauggagucaaacuugagucuaccaggauuuaucaaauacuggccaucuacagcacugcugcgucaaguuuggugcucgucgugucccugggugcaauuagcuuuuggaugugcucuaauggcucauuacagugccggaucuguaucuga

SEQ ID NO: 132482 - RNA, 1701 nt, Artificial Sequence
  derived and/or modified sequence opt3 from hemagglutinin__InfluenzaA__AGU93053
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaacauugucuaccgcaucaaguuggagcuacauuguugagacuuccucuucggacaacggaacaugcuauccaggcgauuuuaucgacuacgaagaacucagggagcagcugucaagcgugaguuccuucgaacgguuugagauuuucccgaagaccucuagcuggcccaaucacgauuccaacaagggugucacggccgcuuguccucaugcaggggccaaaggauuuuauaagaaucugaucuggcucgugaaaaagggcaacucauacccaaaauuaaguaagagcuauauaaaugacaagggcaaagaaguacugguucuuugggggauccaccaccccucuacuaccgcugaucaacaguccuuguaccagaacgccgacacauacguguucgucggaacuucacgcuauagcaagaaauuuaagccugagauugcgacccgaccaaaagugcgugaucaggaggguagaaugaauuacuauuggacacugguggaacccggcgacaagaucaccuucgaggcaacggggaaccuagucguuccuagguacgccuuugcuauggaacgggaugccggaaguggcauuaucauaucugacacuccagugcaugacugcaacacaaccugucaaacuccgaaaggugcaauuaauacaucccuccccuuccagaacauccacccuauuaccaucgggaagugcccaaaguauguaaaaagcacgaagcugcgccuugcuaccggacugagaaaugugcccucgauccagucuaggggcuuguuuggcgccauugcgggguucauagagggagguuggacaggcauggucgaugggugguacggauaucaucaccagaacgaacaaggcuccgguuacgccgcagaccucaaaucaacucagaaugcuaucgauaagauuaccaacaaagugaauaguguuaucgagaagaugaacacacaguuuacugccguggggaaggaguucaaucaccuggaaaaacggauagagaacuuaaauaagaaagucgacgauggcuuccuggacauuuggaccuacaacgcugaacuccuugugcuguuggagaaugaacgcacacuagauuaucaugacagcaacguaaagaaucuguacgagaaaguucgaaaccagcucaagaacaaugccaaggagaucggaaacggcuguuuugaguucuaucacaaaugcgauaauaccuguauggaguccgugaagaacgggacuuacgacuauccuaaauacucugaagaggcaaagcugaauagagaagagaucgauggagucaaacuugagagcacgaggauuuaucaaauccuggccauuuacucaacagcugcgaguuccuuggugcucgucgugagccugggugcaauaucuuuuuggaugugcucaaacggcaguuuacagugccggaucuguauuuga

SEQ ID NO: 132483 - RNA, 1701 nt, Artificial Sequence
  derived and/or modified sequence opt3 from hemagglutinin__InfluenzaA__AGV99014
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauaacuccuuuuucucacgucugaauuggcucacgcauaguaacuuuaaguauccagcauuaaacgugacuaugcccaauaacgagcaguucgacaagcuguacaucuggggaguccaccauccuggcaccgauaaagaccagauuuuucuuuaugcccagagcucuggcagaaucacaguguccacuaagaggucacaacaggcuguaauaccaaauauugggagccggccccgcaucagaaacauuccuaguaggaucucuaucuacuggaccauuguuaaaccaggagauauauugcugaucaauuccacagguaaccuaauugccccgcggggcuacuucaagauccgcagcgggaaaucgucuauaaugcgauccgacgcgcccauuggaaaguguaagucagaaugcaucaccccuaauggcaguaucccaaacgacaaacccuuucagaaugugaacagaauuacguauggugcauguccuagguacgucaagcagagcacucucaaacuggccacagggaugcggaaugugccagagaagcaaacccguggaaucuucggcgcuauugccggcuuuauagaaaacgggugggagggaaugauggaugguugguauggcuuccgccaccaaaauuccgaggggagaggacaggcagcugaccuuaaaucuacucaggccgcgaucgaucagauuaacggcaagcugaauagguugaucgguaaaacaaacgaaaaguuccaccagaucgagaaggaauuuagcgagguggaagggcggauucaggaccucgagaaauacgucgaggauaccaagauagaccuguggucauauaacgccgaauuacugguugcacucgagaaucaacauacgaucgaucuuaccgacagugaaaugaacaaacuguucgagaagacuaaaaagcaguugcgagaaaaugcugaggauaugggcaacggaugcuuuaagauuuaccacaaaugugacaaugccugcaucggcuccauucgcaacgggacauaugaucaugacguguacagagacgaggcucuaaauaacagguuccagaucaagggaguagaacugaaaagcgguuacaaggauuggauacucuggaucucuuuugccauuucaugcuuccugcuuuguguggcacuguugggcuuuaucaugugggccugccagaaagggaauauucgguguaacaucugcauauga

SEQ ID NO: 132484 - RNA, 1701 nt, Artificial Sequence; identical to SEQ ID NO: 132010
  derived and/or modified sequence opt3 from hemagglutinin__InfluenzaA__AGV99037

SEQ ID NO: 132485 - RNA, 1701 nt, Artificial Sequence
  derived and/or modified sequence opt3 from hemagglutinin__InfluenzaA__AGV99049
augaagaccaucauugcccugagcuacauacucugccuuguguucgcucagaaacugcccggcaacgacaauuccacagcaacuuuguguuuagggcaccaugccgucccuaacggaacgguugugaagaccaucacaaaugauagaauugagguaacuaacgcgaccgaacuggugcaaaauucuucaaucggugagauuugcgacaguccacaccagauccuagauggcgaaaacuguacacucauagacgcucugcuuggggauccgcagugcgacggauuucagaauaaaaagugggaucuguucgucgagaggagcaaagccuauuccaacuguuaccccuaugacgugccugauuacgcaucuuugcggucgcucguugccucaagcggcacccuggaauuuaauaacgagaguuucaauuggacuggugugacacaaaacgggaccuccucugcuugcauccgccgaagcaauaacuccuuuuucucacgucugaauuggcucacgcauuuaaacuuuaaguauccagcacugaacgucacuaugcccaauaacgagcaguucgacaaacuuuacauuuggggagugcaccauccuggcaccgauaaagaccagaucuuuuuguaugcccagaguagcggcagaauuacaguaucuacuaagaggucccaacaggcuguuaucccaaauauagggucacggccccgcauuagaaacaucccuagcaggauuaguaucuacuggaccaucgugaaaccaggagauauucugcuaauaaauucuacagguaaccucaucgccccgcggggcuacuucaagauucgcuccgggaaaagcucgaucaugcgaucugacgcgcccauaggaaaguguaaguccgaaugcauuaccccuaauggcucaaucccaaacgacaaacccuuucagaaugucaacagaaucacguauggugcauguccuagguacgugaagcagaguacucugaaacuugccacagggaugcggaaugugccagagaagcaaacccguggaauuuucggcgcuaucgccggcuuuauugaaaacgggugggagggaauggucgaugguugguauggcuuccgccaccagaauagcgaggggagaggacaggcagcugaccugaaauccacucaagccgcgauagaucagaucaacggcaaguugaauaggcucauugguaaaacaaacgggaaguuccaccagaucgaaaaggaguuuucugaaguugagggccggauccaggaccuggaaaaauacguggaggauaccaagauugacuuauggagcuauaacgccgagcugcucguagcacuugaaaaucaacauacgauagaucugaccgacucagagaugaacaaauuguucgaaaagacaaagaagcagcuacgagagaaugcugaagauaugggaaacggcugcuuuaagaucuaccacaaaugugacaaugccugcauugggaguauccgcaacggaacuuaugaucaugacguguacagagacgaggcucugaauaacagguuccagauuaagggugucgagcucaaauccggcuacaaggauuggauccuguggaucagcuuugccauaucuugcuuccuucugugugugguuuugcucggguuuauuaugugggcaugccagaaaggaaauauccgguguaacauuugcaucuga

SEQ ID NO: 132486 - RNA, 1701 nt, Artificial Sequence
  derived and/or modified sequence opt3 from hemagglutinin__InfluenzaA__AGV99073
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcggaagcaauuccucauuuuucagucgacugaacuggcugacgcaucucaauuuuaaguauccagcauuaaacgugacuaugcccaacaaugagcaguucgacaagcuguacauuuggggcguccaccauccuggcaccgauaaagaccagaucuuucuuuaugcccagagcucugggcguauaacaguguccacuaagagaucacaacaggcuguaauuccaaacaucggaagcaggccccggauucgcaauaucccuaguagaaucucuauuuacuggaccauaguuaaaccaggugauaucuugcugauuaacuccacaggcaaucuaaucgccccgaggggguacuucaagauacggagcggaaaaucgucuauuaugcgcuccgacgcgcccaucggcaaguguaagucagaaugcaucaccccuaacgguaguauuccaaaugacaaacccuuucagaacgugaaucgaaucacguauggggcauguccuagauacgucaagcagagcacucucaaacuggccacaggaaugaggaacgugccagagaagcaaacccggggcauuuucggcgcuauagccggguuuaucgaaaauggaugggaggguaugguggauggcugguauggguuccgucaccagaacuccgagggacgcggccaggcagcugaccuuaaaucuacucaagccgcgauugaucagaucaaugguaagcugaacagauugaucgggaaaacaaaugaaaaguuccaccagauugagaaggaauuuagcgaggucgaaggcaggauacaggaccucgagaaauacguugaggauaccaagaucgaccuguggucauauaacgccgaauuacugguggcacucgagaaccaacauacgauugaucuuaccgacagugaaaugaauaaacuguucgagaagacuaaaaagcaguugcgggaaaacgcugaggauaugggaaauggcugcuuuaagaucuaccacaaaugugacaacgccugcauuggguccauccgaaauggaacauaugaucaugacguauaccgcgacgaggcucuaaacaauagauuccagauaaaggguguggaacugaaacccggcuacaaggauuggauccucuggauuagcuuugccaucucuugcuuccugcuuugugucgcacuguugggguuuauuaugugggccugccagaaaggaaacaucagguguaauauaugcauuuga

SEQ ID NO: 132487 - RNA, 1701 nt, Artificial Sequence; identical to SEQ ID NO: 131874
  derived and/or modified sequence opt3 from hemagglutinin__InfluenzaA__AGV99085

SEQ ID NO: 132488 - RNA, 1701 nt, Artificial Sequence
  derived and/or modified sequence opt3 from hemagglutinin__InfluenzaA__AGV99097
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgaggucgaagggcggauucaggaccuggagaaauacguugaggauaccaagauagacuuauggucauauaacgccgaaauccugguggcacucgagaaccaacauacgauugaucuuaccgacagugaaaugaauaaacuguucgagaagacaaagaagcaguugcgagaaaacgcugaggauaugggcaauggaugcuuuaagaucuaccacaaaugugacaacgccugcauuggcuccauccgcaaugggacuuaugaucaugacguauacagagacgaggcucuaaacaauagguuccagauaaagggaguggaacugaaaagcgguuacaaggauuggauccucuggauuucuuuugccaucucaugcuuccugcuuugugucgcacuguugggcuuuauuaugugggccugccagaaagggaacauccgguguaauauaugcauuuga

SEQ ID NO: 132489 - RNA, 1701 nt, Artificial Sequence
  derived and/or modified sequence opt3 from hemagglutinin__InfluenzaA__AGV99121
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacgauuuucagaauaaaaagugggaccuguucguggagaggagcaaagccuauuccaacuguuaccccuaugaugucccugacuacgcaucuuugcggucgcucguggccucaagcggaacccuggaauuuaauaacgagaguuucaauugggcuggcguuacucaaaacgguacauccucugcaugcauucgcgggagcaauuccucauuuuucagucgacugaacuggcucacccauuuaaauuuuaaguauccagcccugaacgugacgaugcccaacaaugagcaguucgauaaguuguacaucuggggaguccaccauccuggcacugacaaagaucagauuuuucuuuaugcucagagcucuggccguaucaccguguccacaaagagaucacaacaggccguaauaccaaacauugggagcaggccccggauccgcaauauuccuaguagaaucucuaucuacuggacuauuguuaaaccaggagacauacugcuaaucaacuccaccgguaaucucauugcgccgaggggcuacuucaagauccggagcgggaaaucgucuauaaugcgcuccgacgcacccauuggaaaguguaagucagaaugcaucacaccuaacggcaguaucccaaaugauaaacccuuucagaacgugaaucgaauuaccuauggugccuguccuagauacgucaagcagagcacgcugaaacuugcuacugggaugaggaacgugccagagaagcaaacacggggaaucuucggcgccauugcaggcuuuauagaaaaugggugggagggaaugguggacgguugguauggcuuccgucaccagaacuccgaggggcgcggacaggcugccgaucugaaaucuacccaagcggccaucgaccagauuaauggcaaguugaacagacucaucgguaaaacuaaugaaaaguuccaccagaucgagaaggaauuuagcgaggucgaagggaggauucaggaucuggagaaauacguugaggacacaaagauagauuuauggucauauaacgcagaacugcucguggcucuugagaaccaacauaccaucgaccugacggauagugaaaugaauaaauuguucgagaagaccaaaaagcagcuacgggaaaacgccgaggacaugggcaauggaugcuuuaagauuuaccacaaaugugauaacgcuugcaucggcuccauucgaaaugggacauaugaccaugacguauaccgcgaugaggcccugaacaauagauuccagaucaagggaguggaacucaaaagcgguuacaaggacuggauacuguggaucucuuuugcaauuucaugcuuccuucugugugucgccuugcucggcuuuaucaugugggcuugccagaaagggaacauuagguguaauaucugcauauga

SEQ ID NO: 132490 - RNA, 1701 nt, Artificial Sequence; identical to SEQ ID NO: 132489
  derived and/or modified sequence opt3 from hemagglutinin__InfluenzaA__AGV99133

SEQ ID NO: 132491 - RNA, 1701 nt, Artificial Sequence; identical to SEQ ID NO: 132483
  derived and/or modified sequence opt3 from hemagglutinin__InfluenzaA__AGV99145

SEQ ID NO: 132492 - RNA, 1701 nt, Artificial Sequence
  derived and/or modified sequence opt3 from hemagglutinin__InfluenzaA__AGV99157
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucauugagaggagcaaagccuauuccaacuguuaccccuaugacgugccugauuacgcaucuuugcggucgcucgucgccucaagcggcacccuggaauuuaauaacgagaguuucaauuggacuggugugacacaaaacgggaccuccucugcuugcauccgccgaagcaauaacuccuuuuucucacgucugaauuggcucacgcauaguaacuuuaaguauccagcauuaaacguuacuaugcccaauaacgagcaguucgacaagcuguacauuuggggagugcaccauccuggcaccgauaaagaccagaucuuucuuuaugcccagagcucuggcagaauaacagucuccacuaagaggucacaacaggcugugauuccaaauaucgggagccggccccgcauuagaaacaucccuaguaggaucucuauuuacuggaccauaguaaaaccaggagauaucuugcugauuaauuccacagguaaccuaaucgccccgcggggcuacuucaagauacgcagcgggaaaucgucuauuaugcgauccgacacccccaucggaaaguguaagucagaaugcaucacgccuaauggcaguauuccaaacgacaaacccuuucagaauguuaacagaaucacuuauggugcguguccuagguacgugaagcagagcacacucaaacuggcaaccgggaugcggaaugucccagagaagcaaacucguggaauuuucggcgccauagcuggcuuuaucgaaaacgggugggagggaaugauggaugguugguauggcuuccgccaccaaaauuccgaggggagaggacaggccgcagaccuuaaaucuacacaggcugccauugaucagaucaacggcaagcugaauagguugaucgguaaaaccaacgaaaaguuccaccagauugagaaggaauuuagcgagguggaagggcggauacaggaccucgagaaauacguggaggauacgaagaucgaccuguggucauauaacgcggaauuacuggucgcccucgagaaucaacauaccauugaucuuacagacagugaaaugaacaaacuguucgagaagacuaaaaagcaguugcgagaaaaugcagaggauaugggcaacggaugcuuuaagaucuaccacaaaugugacaaugcuugcauuggcuccauccgcaacgggaccuaugaucaugacguuuacagagacgaggcccuaaauaacagguuccagauaaagggaguggaacugaaaagcgguuacaaggauuggauccucuggauuucuuuugcuaucucaugcuuccugcuuuguguagcccuguugggcuuuauuaugugggcaugccagaaagggaauauccgguguaacauaugcauuuga

SEQ ID NO: 132493 - RNA, 1701 nt, Artificial Sequence; identical to SEQ ID NO: 132010
  derived and/or modified sequence opt3 from hemagglutinin__InfluenzaA__AGV99169

SEQ ID NO: 132494 - RNA, 1701 nt, Artificial Sequence; identical to SEQ ID NO: 132483
  derived and/or modified sequence opt3 from hemagglutinin__InfluenzaA__AGV99181

SEQ ID NO: 132495 - RNA, 1701 nt, Artificial Sequence
  derived and/or modified sequence opt3 from hemagglutinin__InfluenzaA__AGV99193
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauaacuccuuuuucucacgucugaauuggcucacgcauaguaacuuuaaguauccagcauuaaacgugacuaugcccaauaacgagcaguucgacaagcuguacaucuggggaguccaccauccuggcaccgauaaagaccagauuuuucuuuaugcccagagcucuggcagaaucacaguguccacuaagaggucacaacaggcuguaauaccaaauauugggagccggccccgcaucagaaacauuccuaguaggaucucuaucuacuggaccauuguuaaaccaggagauauauugcugaucaauuccacagguaaccuaauugccccgcggggcuacuucaagauccgcagcgggaaaucgucuauaaugcgauccgacacccccauuggaaaguguaagucagaaugcaucacgccuaauggcaguaucccaaacgacaaacccuuucagaaugugaacagaauuacuuauggugcguguccuagguacgucaagcagagcacacucaaacuggcaaccgggaugcggaaugugccagagaagcaaacucguggaaucuucggcgccauugcuggcuuuauagaaaacgggugggagggaaugauggaugguugguauggcuuccgccaccaaaauuccgaggggagaggacaggccgcagaccuuaaaucuacacaggcugccaucgaucagauuaacggcaagcugaauagguugaucgguaaaaccaacgaaaaguuccaccagaucgagaaggaauuuagcgagguggaagggcggauucaggaccucgagaaauacgucgaggauacgaagauagaccuguggucauauaacgcggaauuacugguugcccucgagaaucaacauaccaucgaucuuacagacagugaaaugaacaaacuguucgagaagacuaaaaagcaguugcgagaaaaugcagaggauaugggcaacggaugcuuuaagauuuaccacaaaugugacaaugcuugcaucggcuccauucgcaacgggaccuaugaucaugacguguacagagacgaggcccuaaauaacagguuccagaucaagggaguagaacugaaaagcgguuacaaggauuggauacucuggaucucuuuugcuauuucaugcuuccugcuuuguguggcccuguugggcuuuaucaugugggcaugccagaaagggaauauucgguguaacaucugcauauga

SEQ ID NO: 132496 - RNA, 1701 nt, Artificial Sequence; identical to SEQ ID NO: 131884
  derived and/or modified sequence opt3 from hemagglutinin__InfluenzaA__AGV99956

SEQ ID NO: 132497 - RNA, 1701 nt, Artificial Sequence
  derived and/or modified sequence opt3 from hemagglutinin__InfluenzaA__AGV99986
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucauugccucaagcggcacccuggaauuuaauaacgagaguuucaauuggacuggugugacacaaaacgggaccuccucugcuugcauccgccgaagcaauaacuccuuuuucucacgucugaauuggcucacgcauaguaacuuuaaguauccagcauuaaacguuacuaugcccaauaacgagcaguucgacaagcuguacauuuggggagugcaccauccuggcaccgauaaagaccagaucuuucuuuaugcccagagcucuggcagaauaacagucuccacuaagaggucacaacaggcugugauuccaaauaucgggagccggccccgcauuagaaacaucccuaguaggaucucuauuuacuggaccauaguaaaaccaggagauaucuugcugauuaauuccacagguaaccuaaucgccccgcggggcuacuucaagauacgcagcgggaaaucgucuauuaugcgauccgacgcgcccaucggaaaguguaagucagaaugcaucaccccuaauggcaguauuccaaacgacaaacccuuucagaauguuaacagaaucacguauggugcauguccuagguacgugaagcagagcacucucaaacuggccacagggaugcggaaugucccagagaagcaaacccguggaauuuucggcgcuauagccggcuuuaucgaaaacgggugggagggaaugauggaugguugguauggcuuccgccaccaaaauuccgaggggagaggacaggcagcugaccuuaaaucuacucaggccgcgauugaucagaucaacggcaagcugaauagguugaucgguaaaacaaacgaaaaguuccaccagauugagaaggaauuuagcgagguggaagggcggauacaggaccucgagaaauacguggaggauaccaagaucgaccuguggucauauaacgccgaauuacuggucgcacucgagaaucaacauacgauugaucuuaccgacagugaaaugaacaaacuguucgagaagacuaaaaagcaguugcgagaaaaugcugaggauaugggcaacggaugcuuuaagaucuaccacaaaugugacaaugccugcauuggcuccauccgcaacgggacauaugaucaugacguuuacagagacgaggcucuaaauaacagguuccagauaaagggaguggaacugaaaagcgguuacaaggauuggauccucuggauuucuuuugccaucucaugcuuccugcuuuguguagcacuguugggcuuuauuaugugggccugccagaaagggaauauccgguguaacauaugcauuuga

SEQ ID NO: 132498 - RNA, 1701 nt, Artificial Sequence
  derived and/or modified sequence opt3 from hemagglutinin__InfluenzaA__AGW00065
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacaccucuuugcggucgcucguggcaucaagcggcacucuggaauuuaauaacgagaguuucaauuggacagguguuacccaaaacgggacguccucugccugcauucgccgaagcaauuccucauuuuucagucgucugaacuggcucacucauuuaaauuuuaaguauccagcucugaacgugaccaugcccaacaaugagcaguucgacaaguuguacaucuggggaguccaccauccuggcacagauaaagaccagauuuuucuuuaugcacagagcucuggcagaaucacuguguccaccaagaggucacaacaggccguaauaccaaacauugggagccggccccgcaucagaaauauuccuaguaggaucucuaucuacuggacaauuguuaaaccaggagauauacugcuaaucaacuccaccgguaaucucauugcuccgcggggcuacuucaagauccgcagcgggaaaucgucuauaaugcgauccgacgcccccauuggaaaguguaagucagaaugcaucacgccuaacggcaguaucccaaaugacaaacccuuucagaacgugaauagaauuacuuauggugcguguccuagguacgucaagcagagcacacugaaacuugcaaccgggaugcggaacgugccagagaagcaaacucguggaaucuucggcgccauugcuggcuuuauagaaaaugggugggagggaaugguggaugguugguauggcuuccgccaccagaacuccgaggggagaggacaggccgcagaccugaaaucuacacaagcugccaucgaucagauuaauggcaaguugaacaggcucaucgguaaaaccaaugaaaaguuccaccagaucgagaaggaauuuagcgaggucgaagggcggauucaggaccuggagaaauacguugaggauacgaagauagacuuauggucauauaacgcggaacugcucguggcccuugagaaccaacauaccaucgaucugacagacagugaaaugaauaaauuguucgagaagacuaaaaagcagcuacgagaaaacgcagaggauaugggcaauggaugcuuuaagauuuaccacaaaugugacaacgcuugcaucggcuccauucgcaaugggaccuaugaucaugacguauacagagacgaggcccugaacaauagguuccagaucaagggaguggaacucaaaagcgguuacaaggauuggauacuguggaucucuuuugcuauuucaugcuuccuucugugugucgccuugcucggcuuuaucaugugggcaugccagaaagggaacauucgguguaauaucugcauauga

SEQ ID NO: 132499 - RNA, 1701 nt, Artificial Sequence; identical to SEQ ID NO: 132010
  derived and/or modified sequence opt3 from hemagglutinin__InfluenzaA__AGW00077

SEQ ID NO: 132500 - RNA, 1701 nt, Artificial Sequence; identical to SEQ ID NO: 131874
  derived and/or modified sequence opt3 from hemagglutinin__InfluenzaA__AGW00089

SEQ ID NO: 132501 - RNA, 1701 nt, Artificial Sequence; identical to SEQ ID NO: 132010
  derived and/or modified sequence opt3 from hemagglutinin__InfluenzaA__AGW00101

SEQ ID NO: 132502 - RNA, 1701 nt, Artificial Sequence
  derived and/or modified sequence opt3 from hemagglutinin__InfluenzaA__AGW00113
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaacuuuacaucuggggcguccaccauccuggcacugauaaagaccagaccuuuuuguaugcucagagcucugggcguauuacaguguccacuaagagaucacaacaggccguaaucccaaacauaggaagcaggccccggauucgcaauaucccuaguagaauuucuaucuacuggaccaucguuaaaccaggugauauucugcuaauaaacuccacaggcaaucucaucgcgccgaggggguacuucaagauucggagcggaaaaucgucuaucaugcgcuccgacgcacccauaggcaaguguaagucagaaugcauuaccccuaacgguaguaucccaaaugacaaacccuuucagaacgugaaucgaaucacguauggggccuguccuagauacgucaagcagagcacucugaaacuugcuacaggaaugaggaacgugccagagaagcaaacccggggcauuuucggcgccaucgcaggguuuauugaaaauggaugggaggguaugguggauggcugguauggguuccgucaccagaacuccgagggacgcggccaggcugccgaccugaaaucuacucaagcggccauagaucagaucaaugguaaguugaacagacucauugggaaaacaaaugaaaaguuccaccagaucgagaaggaauuuagcgaggucgaaggcaggauccaggaccuggagaaauacguugaggauaccaagauugacuuauggucauauaacgcagaacugcucguggcucuugagaaccaacauacgauagaucugaccgacagugaaaugaauaaauuguucgagaagacaaagaagcagcuacgggaaaacgccgaggauaugggaaauggcugcuuuaagaucuaccacaaaugugacaacgcuugcauuggguccauccgaaauggaacuuaugaucaugacguauaccgcgacgaggcccugaacaauagauuccagauuaaggguguggaacucaaaagcggcuacaaggauuggauccuguggauaucuuuugcaaucucaugcuuccuucugugugucgccuugcucggguuuauuaugugggcuugccagaaaggaaacaucagguguaauauuugcaucuga

SEQ ID NO: 132503 - RNA, 1701 nt, Artificial Sequence; identical to SEQ ID NO: 132010
  derived and/or modified sequence opt3 from hemagglutinin__InfluenzaA__AGW00125

SEQ ID NO: 132504 - RNA, 1701 nt, Artificial Sequence; identical to SEQ ID NO: 132010
  derived and/or modified sequence opt3 from hemagglutinin__InfluenzaA__AGW00137

SEQ ID NO: 132505 - RNA, 1701 nt, Artificial Sequence; identical to SEQ ID NO: 132010
  derived and/or modified sequence opt3 from hemagglutinin__InfluenzaA__AGW00149

SEQ ID NO: 132506 - RNA, 1701 nt, Artificial Sequence; identical to SEQ ID NO: 132010
  derived and/or modified sequence opt3 from hemagglutinin__InfluenzaA__AGW00161

SEQ ID NO: 132507 - RNA, 1701 nt, Artificial Sequence; identical to SEQ ID NO: 132010
  derived and/or modified sequence opt3 from hemagglutinin__InfluenzaA__AGW00173

SEQ ID NO: 132508 - RNA, 1701 nt, Artificial Sequence
  derived and/or modified sequence opt3 from hemagglutinin__InfluenzaA__AGW00185
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucauugagaggagcaaagccuauuccaacuguuaccccuaugacgugccugauuacgcaucuuugcggucgcucgucgccucaagcggcacccuggaauuuaauaacgagaguuucaauuggacuggugugacacaaaacgggaccuccucugcuugcauccgccgaagcaauaacuccuuuuucucacgucugaauuggcucacgcauaguaacuuuaaguauccagcauuaaacguuacuaugcccaauaacgagcaguucgacaagcuguacauuuggggagugcaccauccuggcaccgauaaagaccagaucuuucuuuaugcccagagcucuggcagaauaacagucuccacuaagaggucacaacaggcugugauuccaaauaucgggagccggccccgcauuagaaacaucccuaguaggaucucuauuuacuggaccauaguaaaaccaggagauaucuugcugauuaauuccacagguaaccuaaucgccccgcggggcuacuucaagauacgcagcgggaaaucgucuauuaugcgauccgacgcgcccaucggaaaguguaagucagaaugcaucaccccuaauggcaguauuccaaacgacaaacccuuucagaauguuaacagaaucacguauggugcauguccuagguacgugaagcagagcacucucaaacuggccacagggaugcggaaugucccagagaagcaaacccguggaauuuucggcgcuauagccggcuuuaucgaaaacgggugggagggaaugauggaugguugguauggcuuccgccaccaaaauuccgaggggagaggacaggcagcugaccuuaaaucuacucaggccgcgauugaucagaucaacggcaagcugaauagguugaucgguaaaacaaacgaaaaguuccaccagauugagaaggaauuuagcgagguggaagggcggauacaggaccucgagaaauacguggaggauaccaagaucgaccuguggucauauaacgccgaauuacuggucgcacucgagaaucaacauacgauugaucuuaccgacagugaaaugaacaaacuguucgagaagacuaaaaagcaguugcgagaaaaugcugaggauaugggcaacggaugcuuuaagaucuaccacaaaugugacaaugccugcauuggcuccauccgcaacgggacauaugaucaugacguuuacagagacgaggcucuaaauaacagguuccagauaaagggaguggaacugaaaagcgguuacaaggauuggauccucuggauuucuuuugccaucucaugcuuccugcuuuguguagcacuguugggcuuuauuaugugggccugccagaaagggaauauccgguguaacauaugcauuuga

SEQ ID NO: 132509 - RNA, 1701 nt, Artificial Sequence; identical to SEQ ID NO: 132010
  derived and/or modified sequence opt3 from hemagglutinin__InfluenzaA__AGW00709

SEQ ID NO: 132510 - RNA, 1701 nt, Artificial Sequence; identical to SEQ ID NO: 132010
  derived and/or modified sequence opt3 from hemagglutinin__InfluenzaA__AGW00721

SEQ ID NO: 132511 - RNA, 1701 nt, Artificial Sequence; identical to SEQ ID NO: 132010
  derived and/or modified sequence opt3 from hemagglutinin__InfluenzaA__AGW00733

SEQ ID NO: 132512 - RNA, 1701 nt, Artificial Sequence; identical to SEQ ID NO: 132010
  derived and/or modified sequence opt3 from hemagglutinin__InfluenzaA__AGW00745

SEQ ID NO: 132513 - RNA, 1701 nt, Artificial Sequence
  derived and/or modified sequence opt3 from hemagglutinin__InfluenzaA__AGW00757
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaaccugaaucgaauuaccuauggggccuguccuagauacgugaagcagagcacgcuuaaacuggcuacuggaaugaggaacgucccagagaagcaaacacggggcaucuucggcgccauugcaggguuuauagaaaauggaugggaggguaugguggauggcugguauggguuccgucaccagaacuccgagggacgcggccaggcugccgacuugaaaucuacccaagcggccaucgaucagauuaaugguaagcucaacagacugaucgggaaaacuaaugaaaaguuccaccagaucgagaaggaauuuagcgagguggaaggcaggauucaggacuuagagaaauacgucgaggauacaaagauagaccuguggucauauaacgcagaacuccuuguugcucuggagaaccaacauaccaucgauuugacggacagugaaaugaauaaacuauucgagaagaccaaaaagcagcugcgggaaaacgccgaggauaugggaaauggcugcuuuaagauuuaccacaaaugugacaacgcuugcaucggguccauucgaaauggaacauaugaucaugacguguaccgcgacgaggcccucaacaauagauuccagaucaaggguguagaacugaaaagcggcuacaaggauuggauacuuuggaucucuuuugcaauuucaugcuuccuguuguguguggcccuccugggguuuaucaugugggcuugccagaaaggaaacauuagguguaauaucugcauauga

SEQ ID NO: 132514 - RNA, 1701 nt, Artificial Sequence; identical to SEQ ID NO: 132013
  derived and/or modified sequence opt3 from hemagglutinin__InfluenzaA__AGW00769

SEQ ID NO: 132515 - RNA, 1701 nt, Artificial Sequence; identical to SEQ ID NO: 131899
  derived and/or modified sequence opt3 from hemagglutinin__InfluenzaA__AGW00781

SEQ ID NO: 132516 - RNA, 1701 nt, Artificial Sequence; identical to SEQ ID NO: 132498
  derived and/or modified sequence opt3 from hemagglutinin__InfluenzaA__AGW00793

SEQ ID NO: 132517 - RNA, 1701 nt, Artificial Sequence; identical to SEQ ID NO: 132010
  derived and/or modified sequence opt3 from hemagglutinin__InfluenzaA__AGW00805

SEQ ID NO: 132518 - RNA, 1701 nt, Artificial Sequence; identical to SEQ ID NO: 131851
  derived and/or modified sequence opt3 from hemagglutinin__InfluenzaA__AGW00817

SEQ ID NO: 132519 - RNA, 1701 nt, Artificial Sequence; identical to SEQ ID NO: 132497
  derived and/or modified sequence opt3 from hemagglutinin__InfluenzaA__AGW00829

SEQ ID NO: 132520 - RNA, 1701 nt, Artificial Sequence
  derived and/or modified sequence opt3 from hemagglutinin__InfluenzaA__AGW00841
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugguagaaucgaggugacuaacgcgaccgaacugguacaaaauucuucaauuggcgagaucugcgauaguccacaccagauacuagacggggaaaacuguacacucaucgaugcucugcuuggagacccgcagugcgauggcuuucagaauaaaaagugggaccuguucguggagaggagcaaagccuauuccaacuguuaccccuaugaugucccugacuacgcaucuuugcggucgcucguggccucaagcgguacccuggaauuuaauaacgagaguuucaauugggcugggguuacucaaaacggaacauccucugcaugcauucgcggcagcaauuccucauuuuucagucgacugaacuggcucacccauuuaaauuuuaaguauccagcccugaacgugacgaugcccaacaaugagcaguucgauaaguuguacaucuggggcguccaccauccugggacugacaaagaucagauuuuucuuuaugcucagagcucuggacguaucaccguguccacaaagagaucacaacaggccguaauaccaaacauugguagcaggccccggauccgcaauauuccuaguagaaucucuaucuacuggacuauuguuaaaccaggcgacauacugcuaaucaacuccaccgggaaucucauugcgccgaggggauacuucaagauccggagcggcaaaucgucuauaaugcgcuccgaugcacccauugguaaguguaagucagaaugcaucacaccuaacgggaguaucccaaaugacaaacccuuucagaacgugaaucgaauuaccuauggagccuguccuagauacgucaagcagagcacgcugaaacuugcuacuggcaugaggaacgugccagagaagcaaacacggggcaucuucggggccauugcaggauuuauagaaaaugguugggagggcaugguggacgggugguauggauuccgucaccagaacuccgagggccgcggucaggcugccgaucugaaaucuacccaagcggccaucgaccagauuaaugggaaguugaacagacucaucggcaaaacuaaugaaaaguuccaccagaucgagaaggaauuuagcgaggucgaaggaaggauucaggaucuggagaaauacguugaggacacaaagauagauuuauggucauauaacgcagaacugcucguggcucuugagaaccaacauaccaucgaccugacggauagugaaaugaauaaauuguucgagaagaccaaaaagcagcuacgggaaaacgccgaggacaugggcaaugggugcuuuaagauuuaccacaaaugugauaacgcuugcaucggauccauucgaaaugguacauaugaccaugauguauaccgcgacgaggcccugaacaauagauuccagaucaagggcguggaacucaaaagcggguacaaggacuggauacuguggaucucuuuugcaauuucaugcuuccuucugugugucgccuugcucggauuuaucaugugggcuugccagaaaggcaacauuagguguaauaucugcauauga

SEQ ID NO: 132521 - RNA, 1701 nt, Artificial Sequence
  derived and/or modified sequence opt3 from hemagglutinin__InfluenzaA__AGW00853
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagccaagcggcagaauuacagugucuacuaagaggucccaacaggcuguaauacccaacauugggucacggccucgcaucagaaauauuccaagcaggaucaguaucuacuggaccauuguuaaaccgggagauauacugcuaaucaacucuacagguaaucucauugcgccccggggcuacuucaagauccgcuccgggaaaagcucgauaaugcgaucugacgccccuauuggaaaguguaaguccgaaugcaucaccccaaacggcucaauccccaaugacaaaccuuuucagaacgugaauagaauuacguauggugcauguccaagguacgucaagcagaguacucugaaacuugccacagggaugcggaacgugcccgagaagcaaacccguggaaucuucggcgcuauugccggcuuuauagaaaaugggugggagggaaugguggaugguugguauggcuuccgccaccagaacagcgaggggagaggacaggcagcugaccugaaauccacucaagccgcgaucgaucagauuaauggcaaguugaacaggcucaucgguaaaacaaaugaaaaguuccaccagaucgagaaggaauuuucugaggucgaagggcggauucaggaccuggagaaauacguugaggauaccaagauagacuuauggagcuauaacgccgaacugcucguggcacuugagaaccaacauacgaucgaucugaccgacucagaaaugaauaaauuguucgagaagacaaagaagcagcuacgagaaaacgcugaggauaugggcaauggaugcuuuaagauuuaccacaaaugugacaacgccugcaucggcaguauucgcaaugggacuuaugaucauaacguauacagagacgaggcucugaauaacagguuccagaucaagggaguggaacucaaauccgguuacaaggacuggauacuguggaucagcuuugccauuucuugcuuccuucugugugucgcauugcucggcuuuaucaugugggccugccagaaagggaauauucgguguaacaucugcauauga

SEQ ID NO: 132522 - RNA, 1701 nt, Artificial Sequence; identical to SEQ ID NO: 131874
  derived and/or modified sequence opt3 from hemagglutinin__InfluenzaA__AGW00865

SEQ ID NO: 132523 - RNA, 1701 nt, Artificial Sequence
  derived and/or modified sequence opt3 from hemagglutinin__InfluenzaA__AGW00877
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgaccaaaucgaagugacuaaugcgaccgagcugguacagucuucaaguacaggugaaauuugcaacagcccacaccagauccuagauggcgagaauuguacccucauagacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacucuggaguuuaacaaugaguccuucaacuggacagguguuacccagaaugggacgucuagcgcuugcauccggcgcuccaacaauucauuuuucagucgacugaacuggcucacucacuuaaauuuuaaauacccagcacugaacgugaccaugcccaacaaugaacaguucgacaaacuuuauauuuggggaguccaucacccuggcacagauaaggaccagaucuuuuuguacgcccaagcuagcggccguauuacugugucuaccaagagaucccagcaggccguaaucccaaacauaggguucaggccccggguucgcaauauuccuucaagagugagcaucuauuggacaauugucaagccaggagauauccugcuaaucaacaguaccgguaaucucauugcgccgaggggcuacuuuaaaauacggucugggaaguccagcaucaugcgcucggacgcacccauuggaaaauguaacucugccugcaucacgccuaauggcuccauaccaaacgacaagcccuuccagaaugugaaccgaauuacuuacggugcuuguccuagauaugugaagcaaaauacacugaaacuugccaccgggaugaggaacgucccagagaagcagacucggggaaucuuuggcgcaaucgcuggcuucauugaaaaugggugggagggaaugguugaugguugguacggcuuccgucaccagaacucagaggggcgcggacaagccgcggaccugaaaaguacacaggccgcaaucgaucagauuaauggcaaguugaacagacucauagguaaaaccaacgaaaaguuucaucagaucgagaaagaguucagcgaaguggaagggaggauucaagaccuggagaaguauguagaggauacgaagaucgacuuaugguccuacaaugcugaacugcucguggcccuugagaaccagcacaccaucgaucugacagacucugaaaugaauaaauuguuugagaagacuaaaaagcagcuacgggaaaacgcugaggauaugggcaauggaugcuucaaaauuuaucauaagugugacaacgccugcauaggcagcauccgaaaugggaccuacgaucacgacgucuaucgcgacgaggcacugaacaauagauuucagauuaagggaguggaacucaaaucagguuacaaggauuggauccuguggauuaguuucgccaucuccugcuuucuucuguguguugcuuugcucggcuucauaaugugggcgugccaaaaagggaacaucagguguaauauuugcaucuga

SEQ ID NO: 132524 - RNA, 1701 nt, Artificial Sequence
  derived and/or modified sequence opt3 from hemagglutinin__InfluenzaA__AGW00889
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgaggucgaagggcggauucaggaccuggagaaauacguugaggauaccaagauagacuuauggucauauaacgccgaacugcucguggcacuugagaaccaacauacgaucgaucugaccgacagugaaaugaauaaauuguucgagaagacaaagaagcagcuacgagaaaacgcugaggauaugggcaauggaugcuuuaagauuuaccacaaaugugacaacgccugcaucggcuccauucgcaaugggacuuaugaucauaacguauacagagacgaggcucugaauaacagguuccagaucaagggaguggaacucaaaagcgguuacaaggacuggguccuguggauaucuuuugccaucucaugcuuccuucuguguguggcauugcucggcuuuauuaugugggccugccagaaagggaauauccgguguaacauuugcaucuga

SEQ ID NO: 132525 - RNA, 1701 nt, Artificial Sequence; identical to SEQ ID NO: 131874
  derived and/or modified sequence opt3 from hemagglutinin__InfluenzaA__AGW00901

SEQ ID NO: 132526 - RNA, 1701 nt, Artificial Sequence; identical to SEQ ID NO: 131874
  derived and/or modified sequence opt3 from hemagglutinin__InfluenzaA__AGW00913

SEQ ID NO: 132527 - RNA, 1701 nt, Artificial Sequence; identical to SEQ ID NO: 132010
  derived and/or modified sequence opt3 from hemagglutinin__InfluenzaA__AGW00931

SEQ ID NO: 132528 - RNA, 1701 nt, Artificial Sequence; identical to SEQ ID NO: 132010
  derived and/or modified sequence opt3 from hemagglutinin__InfluenzaA__AGW01244

SEQ ID NO: 132529 - RNA, 1701 nt, Artificial Sequence; identical to SEQ ID NO: 131884
  derived and/or modified sequence opt3 from hemagglutinin__InfluenzaA__AGW01256

SEQ ID NO: 132530 - RNA, 1701 nt, Artificial Sequence
  derived and/or modified sequence opt3 from hemagglutinin__InfluenzaA__AGW01295
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgaggucgaagggcggauucaggaccuggagaaauacguugaggauaccaagauagacuuauggucauauaacgccgaaauccugguggcacucgagaaccaacauacgauugaucuuaccgacagugaaaugaauaaacuguucgagaagacaaagaagcaguugcgagaaaacgcugaggauaugggcaauggaugcuuuaagaucuaccacaaaugugacaacgccugcauuggcuccauccgcaaugggacuuaugaucauaacguauacagagacgaggcucuaaauaacagguuccagauaaagggaguggaacugaaaagcgguuacaaggacuggauccucuggauuucuuuugccaucucaugcuuccugcuuugugucgcacuguugggcuuuauuaugugggccugccagaaagggaauauccgguguaacauaugcauuuga

SEQ ID NO: 132531 - RNA, 1701 nt, Artificial Sequence; identical to SEQ ID NO: 131874
  derived and/or modified sequence opt3 from hemagglutinin__InfluenzaA__AGW01307

SEQ ID NO: 132532 - RNA, 1701 nt, Artificial Sequence
  derived and/or modified sequence opt3 from hemagglutinin__InfluenzaA__AGW01319
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgaccaaaucgaagugacuaaugcgaccgagcugguacagucuucaaguacaggugaaauuugcaacagcccacaccagauccuagauggcgagaauuguacccucauagacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacucuggaguuuaacaaugaguccuucaacuggacagguguuacccaggacgggacgucuagcgcuugcauccggcgcuccaauaacucauuuuucagucgacugaauuggcucacucacuuaaacuuuaaauacccagcacugaaugugaccaugcccaacaacgaacaguucgauaaacuuuauauuuggggaguccaucacccuggcacagacaaggaucagaucuuuuuguacgcccaagcuagcggccguauuacugugucuaccaagagaucccagcaggccguaaucccaaauauagggucaaggccccggguucgcaacauuccuagcagagugaguaucuauuggacaauugucaagccaggagacauccugcuaaucaauucuaccgguaaccucauugcgccgaggggcuacuucaaaauacgguccggaaagagcucgaucaugcgcucugacgcacccauugggaaauguaauuccgccugcaucacgccuaacggcucaauaccaaaugauaagcccuuucagaacgugaaucgaauuacuuacggugcuuguccuagauaugugaagcaaaacacacugaaacuugccaccgggaugaggaaugucccagagaagcagacucggggaaucuucggcgcaaucgcuggcuuuauugaaaacgggugggagggaaugguugacgguugguacggcuuccgucaccagaauagugaggggcgcggacaagccgcggaucugaaaagcacacaggccgcaaucgaccagauuaacggcaaguugaauaaacucauagguaagaccaacgaaaaauuccaucagaucgagaaggaauuuuccgagguggaagggaggauucaagaucuggagaaguauguagaggacacgaaaaucgauuuauggucuuacaacgcugaacugcucguggcccuugagaaucagcacaccaucgaccugacagauagcgaaaugaacaaguuguucgagaaaacuaagaaacagcuaagagaaaaugcugaggacaugggcaacggaugcuuuaagauuuaucauaagugugauaaugccugcauaggcucaauccggaacgggaccuacgaccacgacgucuaucgagaugaggcacugaauaaccgcuuccagauuaaaggaguggaacucaagagugguuacaaagacuggauccuguggauuuccuuugccaucagcugcuuccuucuguguguugcuuugcucggcuuuauaaugugggcgugccaaaaggggaauaucagauguaacauuugcaucuga

SEQ ID NO: 132533 - RNA, 1701 nt, Artificial Sequence
  derived and/or modified sequence opt3 from hemagglutinin__InfluenzaA__AGW01331
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggauucaggaccuggagaaauacguugaggauacaaagauagacuuauggucauauaacgcagaacugcucguggcucuugagaaccaacauaccaucgaucugacggacagugaaaugaauaaauuguucgagaagaccaaaaagcagcuacgggaaaacgccgaggauaugggaaauggcugcuuuaagauuuaccacaaaugugacaacgcuugcaucggguccauucgaaauggaacauaugagcaugauguauaccgcgacgaagcccugaacaauagauuccagaucaaggguguggagcucaaaagcggcuacaaggacuggauacuguggaucucuuuugcaauuucaugcuuccuucugugugucgccuugcucggguuuaucaugugggcuugccagaaaggaaacauuagguguaauaucugcauauga

SEQ ID NO: 132534 - RNA, 1701 nt, Artificial Sequence; identical to SEQ ID NO: 132010
  derived and/or modified sequence opt3 from hemagglutinin__InfluenzaA__AGW01343

SEQ ID NO: 132535 - RNA, 1701 nt, Artificial Sequence; identical to SEQ ID NO: 132013
  derived and/or modified sequence opt3 from hemagglutinin__InfluenzaA__AGW01355

SEQ ID NO: 132536 - RNA, 1701 nt, Artificial Sequence; identical to SEQ ID NO: 131884
  derived and/or modified sequence opt3 from hemagglutinin__InfluenzaA__AGW01367

SEQ ID NO: 132537 - RNA, 1701 nt, Artificial Sequence; identical to SEQ ID NO: 132010
  derived and/or modified sequence opt3 from hemagglutinin__InfluenzaA__AGW01391

SEQ ID NO: 132538 - RNA, 1701 nt, Artificial Sequence
  derived and/or modified sequence opt3 from hemagglutinin__InfluenzaA__AGW01403
augaagaccaucauugcccugagcuacauacucugccuuaucuucgcucagaaacugcccggcaacgacaauuccacagcaacuuuguguuuagggcaccaugccgugccuaacggaacgauugucaagaccaucacaaaugaucaaauugagguuacuaacgcgaccgaacuggugcagucuucaaguacaggugagaucugcaauagcccacaccagauacuagacggcgaaaacuguacccucaucgaugcucugcuuggggacccgcagugcgauggauuucaaaauaaaaagugggaccuguucguagagagauccaaagcccauucuaacuguuaucccuacgaugugccugacuaugcaucguugaggucacucgucgccagcaguggcacucuggaauuuaauaacgaguccuucaauuggacaggugugacccagaacgggacgucuagcgcuugcauucggcgcuccaauaacucauuuuucagucgacugaauuggcucacucacuuaaacuuuaaguacccagcacugaacguuaccaugcccaauaacgagcaguucgauaaguuguauaucuggggagugcaucacccuggcacagacaaagaucagauuuuucuuuacgcccaagcugccggccguaucacugucagcaccaagagaucucagcaggcggugauaccaaauauuggguccaggccccggguacgcaacaucccuucaagaguuagcauuuauuggacaaucgugaaaccaggagacauccugcuaauuaauaguaccgguaaccucauagcaccgaggggcuacuucaagauccggucugggaaauccagcauuaugcgcucggaugcccccaucggaaaguguaauucugcuugcauaacgccuaacggcuccauuccaaaugacaagcccuuucagaacgucaaucgaaucacuuacggugccuguccuagauaugugaaacaaaacacacugaaacuugcaaccgggaugaggaaugugccagaaaaacagacucggggaaucuucggcgcuauugccggcuuuaucgagaacgggugggaaggaauggucgacgguugguacggcuuccgucaccaaaauucagaggggcgcggacaggcggccgaucugaagaguacacaggcagcuauugaccagauaaacggcaaauugaacagacucaucgguaagaccaaugagaaauuccaucagauugaaaaggaguuuagcgaaguugaggggaggauccaagaucuggaaaaguauguggaggacacgaaaaucgauuuaugguccuacaacgccgagcugcucguagcucuugaaaaucagcacaccauugaccugacagauucugagaugaacaaguuguucgaaaagacuaagaaacagcuacgggagaaugccgaagacaugggcaacggaugcuuuaagauauaucauaagugugauaaugcaugcaucggcagcauucgaaacgggaccuacgaccacuauguguaccgcgaugaggcccugaauaacagauuccagaucaaaggagucgagcucaagucagguuacaaagacuggauucuguggaucaguuuugcuacauccugcuuccuucuguguguggcguugcucggcuuuauaaugugggcaugccaaaaggggaauaucagguguaacauuugcaucuga

SEQ ID NO: 132539 - RNA, 1701 nt, Artificial Sequence; identical to SEQ ID NO: 131874
  derived and/or modified sequence opt3 from hemagglutinin__InfluenzaA__AGW01415

SEQ ID NO: 132540 - RNA, 1701 nt, Artificial Sequence; identical to SEQ ID NO: 131874
  derived and/or modified sequence opt3 from hemagglutinin__InfluenzaA__AGW01427

SEQ ID NO: 132541 - RNA, 1701 nt, Artificial Sequence; identical to SEQ ID NO: 131874
  derived and/or modified sequence opt3 from hemagglutinin__InfluenzaA__AGW01439

SEQ ID NO: 132542 - RNA, 1701 nt, Artificial Sequence
  derived and/or modified sequence opt3 from hemagglutinin__InfluenzaA__AGW01451
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugauggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgagguggaaggcaggauucaggaccuggagaaauacgucguugauacaaagauagacuuauggucauauaacgcagagcugcucguggcucuugaaaaccaacauaccaucgaucugacggacagugagaugaauaaauuguucgaaaagaccaaaaagcagcuacgggagaacgccgaagauaugggaaauggcugcuuuaagauuuaccacaaaugugacaacgcuugcaucggguccauucgaaauggaacauaugaucaugacguauaccgcgacgaggcccugaacaauagauuccagaucaaggguguggagcucaaaagcggcuacaaggauuggauacuguggaucucuuuugcaauuucaugcuuccuucugugugucgccuugcucggguuuaucaugugggcuugccagaaaggaaacauuagguguaauaucugcauauga

SEQ ID NO: 132543 - RNA, 1701 nt, Artificial Sequence; identical to SEQ ID NO: 132010
  derived and/or modified sequence opt3 from hemagglutinin__InfluenzaA__AGW01463

SEQ ID NO: 132544 - RNA, 1701 nt, Artificial Sequence; identical to SEQ ID NO: 132010
  derived and/or modified sequence opt3 from hemagglutinin__InfluenzaA__AGW01475

SEQ ID NO: 132545 - RNA, 1701 nt, Artificial Sequence
  derived and/or modified sequence opt3 from hemagglutinin__InfluenzaA__AGW01487
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauaacuccuuuuucucacgucugaauuggcucacgcauaguaacuuuaaguauccagcauuaaacgugacuaugcccaauaacgagcaguucgacaagcuguacaucuggggaguccaccauccuggcaccggcaaagaucagauuuuucuuuaugcccagagcucugggagaaucacaguguccacuaagaggucacaacaggcuguaauaccaaauauuggaagccggccccgcaucagaaacauuccuaguaggaucucuaucuacuggaccauuguuaaaccaggugacauauugcugaucaauuccacaggcaaccuaauugccccgcggggguacuucaagauccgcagcggaaaaucgucuauaaugcgauccgaugcgcccauuggcaaguguaagucagaaugcaucaccccuaaugguaguaucccaaacgacaaacccuuucagaaugugaacagaauuacguauggggcauguccuagguacgucaagcagagcacucucaaacuggccacaggaaugcggaaugugccagagaagcaaacccguggcaucuucggcgcuauugccggguuuauagaaaacggaugggaggguaugauggacggcugguauggguuccgccaccaaaauuccgagggaagaggccaggcagcugaucuuaaaucuacucaggccgcgaucgaccagauuaacgguaagcugaauagguugaucgggaaaacaaacgaaaaguuccaccagaucgagaaggaauuuagcgagguggaaggccggauucaggaucucgagaaauacgucgaggacaccaagauagaucuguggucauauaacgccgaauuacugguugcacucgagaaucaacauacgaucgaccuuaccgauagugaaaugaacaaacuguucgagaagacuaaaaagcaguugcgagaaaaugcugaggacaugggaaacggcugcuuuaagauuuaccacaaaugugauaaugccugcaucggguccauucgcaacggaacauaugaccaugauguguacagagacgaggcucuaaauaacagguuccagaucaaggguguagaacugaaaagcggcuacaaggacuggauacucuggaucucuuuugccauuucaugcuuccugcuuuguguggcacuguugggguuuaucaugugggccugccagaaaggaaauauucgguguaacaucugcauauga

SEQ ID NO: 132546 - RNA, 1701 nt, Artificial Sequence; identical to SEQ ID NO: 131874
  derived and/or modified sequence opt3 from hemagglutinin__InfluenzaA__AGW01499

SEQ ID NO: 132547 - RNA, 1701 nt, Artificial Sequence
  derived and/or modified sequence opt3 from hemagglutinin__InfluenzaA__AGW01511
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggauucaggaccuggagaaauacguugaggauacaaagauagacuuauggucauauaacgcagaacugcucguggcucuugagaaccaacauaccaucgaucugacggacagugaaaugaauaaauuguucgagaagaccaaaaagcagcuacgggaaaacgccgaggauaugggaaauggcugcuuuaagauuuaccacaaaugugacaacgcuugcaucggguccauucgaaauggaacauaugaucaugacguauaccgcgacgaggcccugaacaauagauuccagaucaaggguguggaacucaaaagcggcuacaaggauuggauacuguggaucucuuuugcaauuucaugcuuccuucugugugccgcuuugcucggguuuaucaugugggcgugccagaaaggaaacauuagguguaauaucugcauauga

SEQ ID NO: 132548 - RNA, 1701 nt, Artificial Sequence
  derived and/or modified sequence opt3 from hemagglutinin__InfluenzaA__AGW01535
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaaggagaguuucaacugggcugguguuacucaaaaugggacauccucugcaugcauucgcggaagcaacuccucauuuuucagucgacugaauuggcucacccauuuaaacuuuaaguauccagcccugaaugugacgaugcccaacaacgagcaguucgacaaacuuuacaucuggggcguccaccauccuggcacugauaaggaccagauuuuucuuuaugcucagagcucugggcguaucaccguguccacaaaaagaucacaacaggccguaauaccaaauauuggaagcaggccccggauccgcaacauuccuaguagaaucucuaucuacuggacuauuguuaagccaggugauauacugcuaaucaauuccaccggcaaccucauugcgccgaggggguacuucaaaauccggagcggaaagucgucuauaaugcgcuccgacgcacccauuggcaaguguaaaucagaaugcaucacaccuaaugguaguaucccaaacgacaagcccuuucagaaugugaaccgaauuaccuauggggccuguccuagauacgucaaacagagcacgcugaaguuggcuacuggaaugaggaaugugccagagaaacaaacacggggcaucuucggcgccauugcaggguuuauagaaaacggaugggaggguaugguggauggcugguauggguuccgucaccaaaauuccgagggacgcggccaggcugccgaccugaagucuacccaggcggccaucgaucagauuaacgguaaauugaauagacucaucgggaagacuaacgaaaaguuccaccagaucgagaaagaauuuagcgaggucgaaggcaggauucaggaccuggagaaguacguugaggauacaaaaauagacuuauggucauauaaugcagaacugcucguggcucuugagaaccaacauaccaucgaucugacggacagugaaaugaacaaguuguucgagaaaaccaagaagcagcuacgggaaaaugccgaggauaugggaaacggcugcuuuaaaauuuaccacaagugugacaaugcuugcaucggguccauucgaaacggaacauaugaucaugacguauaccgcgacgaggcccugaauaacagauuccagaucaaagguguggaacucaagagcggcuacaaagauuggauacuguggaucucuuuugcaauuucaugcuuccuucugugugucgccuugcucggguuuaucaugugggcuugccagaagggaaauauuagguguaacaucugcauauga

SEQ ID NO: 132549 - RNA, 1701 nt, Artificial Sequence; identical to SEQ ID NO: 131874
  derived and/or modified sequence opt3 from hemagglutinin__InfluenzaA__AGW01547

SEQ ID NO: 132550 - RNA, 1701 nt, Artificial Sequence; identical to SEQ ID NO: 132010
  derived and/or modified sequence opt3 from hemagglutinin__InfluenzaA__AGW01559

SEQ ID NO: 132551 - RNA, 1701 nt, Artificial Sequence; identical to SEQ ID NO: 132010
  derived and/or modified sequence opt3 from hemagglutinin__InfluenzaA__AGW01571

SEQ ID NO: 132552 - RNA, 1701 nt, Artificial Sequence; identical to SEQ ID NO: 132010
  derived and/or modified sequence opt3 from hemagglutinin__InfluenzaA__AGW01583

SEQ ID NO: 132553 - RNA, 1701 nt, Artificial Sequence; identical to SEQ ID NO: 132010
  derived and/or modified sequence opt3 from hemagglutinin__InfluenzaA__AGW01595

SEQ ID NO: 132554 - RNA, 1701 nt, Artificial Sequence
  derived and/or modified sequence opt3 from hemagglutinin__InfluenzaA__AGW01607
augaagaccaucauugcccugagcuacauacucugccuugugcuggcucagaaauugcccggcaacgacaauuccacagcaacuuuaugucuggggcaccaugccgucccuaacggaacgaucguuaagaccauuacaaaugauagaaucgaggugacuaacgcgaccgaacuuguacaaaauucuucaauuggugagaucugcgacaguccacaccagauacucgauggcgaaaacuguacacugaucgacgcucuacugggggauccgcagugcgacggauuccagaauaaaaagugggauuuguuuguggagaggagcaaagccuauuccaacuguuaccccuaugacgucccugauuacgcaucucuccggucgcugguggccucaagcggcacccuggaguucaauaacgaaaguuuuaauugggcugguguuacucaaaacgggacauccucugcaugcauucgcggaagcaauuccucauucuuuagucgacucaacugguuaacccaucugaauuucaaguauccagcccuuaacgugacgaugcccaacaaugagcaguuugacaaguuguacaucuggggcguccaccauccuggcacugauaaagaccagauuuuccuguaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacuacucaucaacuccaccggcaaucugauugcgccgaggggguacuuuaagauccggagcggaaaaucgucuauaaugcgcuccgacgcacccauuggcaaguguaagucagaaugcaucacaccuaacgguaguaucccaaaugacaaacccuuccagaacgugaaucgaauuaccuauggggccuguccuagauacgucaagcagagcacgcuuaaacuggcuacuggaaugaggaacgugccagagaagcaaacacggggcaucuuuggcgccauugcaggguucauagaaaauggaugggaggguaugguggauggcugguauggguuucgucaccagaacuccgagggacgcggccaggcugccgacuugaaaucuacccaagcggccaucgaucagauuaaugguaagcucaacagacugaucgggaaaacuaaugaaaaguuccaccagaucgagaaggaguucagcgaagucgaaggcaggauucaggacuuagagaaauacguugaggauacaaagauagaccuguggucauauaacgcagaacuccuuguggcucuggagaaccaacauaccaucgauuugacggacagugaaaugaauaaacuauuugagaagaccaaaaagcagcugcgggaaaacgccgaggauaugggaaauggcugcuucaagauuuaccacaaaugugacaacgcuugcaucggguccauucgaaauggaacauaugaucaugacguauaccgcgacgaggcccucaacaauagauuucagaucaaggguguggaacugaaaagcggcuacaaggauuggauacuuuggaucucuuucgcaauuucaugcuuucuguugugugucgcccuccugggguucaucaugugggcuugccagaaaggaaacauuagguguaauaucugcauauga

SEQ ID NO: 132555 - RNA, 1701 nt, Artificial Sequence; identical to SEQ ID NO: 132013
  derived and/or modified sequence opt3 from hemagglutinin__InfluenzaA__AGW01619

SEQ ID NO: 132556 - RNA, 1701 nt, Artificial Sequence; identical to SEQ ID NO: 132010
  derived and/or modified sequence opt3 from hemagglutinin__InfluenzaA__AGW01631

SEQ ID NO: 132557 - RNA, 1701 nt, Artificial Sequence
  derived and/or modified sequence opt3 from hemagglutinin__InfluenzaA__AGW01643
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgcggaagcaauuccucauuuuucagucgacugaacuggcucacgcauuuaaauuuuaaguauccagcacugaacgugacuaugcccaacaaugagcaguucgacaaacuuuacaucuggggcguccaccauccuggcaccgauaaagaccagaucuuuuuguaugcccagagcucugggcguauuacaguguccacuaagagaucacaacaggcuguaauaccaaacauuggaagcaggccccggauccgcaauauuccuaguagaaucucuaucuacuggaccauuguuaaaccaggugauauacugcuaaucaacuccacaggcaaucucauugccccgaggggguacuucaagauccggagcggaaaaucgucuauaaugcgcuccgacgcgcccauuggcaaguguaagucagaaugcaucaccccuaacgguaguaucccaaaugacaaacccuuucagaacgugaaucgaauuacguauggggcauguccuagauacgucaagcagagcacucugaaacuugccacaggaaugaggaacgugccagagaagcaaacccggggcaucuucggcgcuauugccggguuuauagaaaauggaugggaggguaugauggauggcugguauggguuccgucaccagaacuccgagggacgcggccaggcagcugaccugaaaucuacucaagccgcgaucgaucagauuaaugguaaguugaacagacucaucgggaaaacaaaugaaaaguuccaccagaucgagaaggaauuuagcgagguggaaggcaggauucaggaccuggagaaauacgucgaggauaccaagauagacuuauggucauauaacgccgaacugcucguugcacuugagaaccaacauacgaucgaucugaccgacagugaaaugaauaaauuguucgagaagacaaagaagcagcuacgggaaaacgcugaggauaugggaaauggcugcuuuaagauuuaccacaaaugugacaacgccugcaucggguccauucgaaauggaacuuaugaucaugacguguaccgcgacgaggcucugaacaauagauuccagaucaaggguguagaacucaaaagcggcuacaaggauuggauacuguggaucucuuuugccauuucaugcuuccuucuguguguggcauugcucggguuuaucaugugggccugccagaaaggaaacauuagguguaauaucugcauauga

SEQ ID NO: 132558 - RNA, 1701 nt, Artificial Sequence; identical to SEQ ID NO: 132010
  derived and/or modified sequence opt3 from hemagglutinin__InfluenzaA__AGW01655

SEQ ID NO: 132559 - RNA, 1701 nt, Artificial Sequence
  derived and/or modified sequence opt3 from hemagglutinin__InfluenzaA__AGW01667
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggauucaggaccuggagaaauacguugaggauacaaagauagacuuauggucauauaacgcagaacugcucguggcucuugagaaccaacauaccaucgaucugacggacagugaaaugaauaaauuguucgagaagaccaaaaagcagcuacgggaaaacgccgaggauaugggaaauggcugcuuuaagauuuaccacaaaugugacaacgcuugcaucggguccauucgaaaugagacauaugaucaugacguauaccgcgacgaagcccugaacaauagauuccagaucaagggaguggagcucaaaagcgguuacaaggauuggauacuguggaucucuuuugcaauuucaugcuuccuucugugugucgccuugcucggcuuuaucaugugggcuugccagaaagggaacauuagguguaauaucugcauauga

SEQ ID NO: 132560 - RNA, 1701 nt, Artificial Sequence; identical to SEQ ID NO: 132010
  derived and/or modified sequence opt3 from hemagglutinin__InfluenzaA__AGW01679

SEQ ID NO: 132561 - RNA, 1701 nt, Artificial Sequence
  derived and/or modified sequence opt3 from hemagglutinin__InfluenzaA__AGW01691
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgaggucgaagggcggauucaggaccuggagaaauacguugaggauaccaagauagacuuauggucauauaacgccgaacugcucguggcacuugagaaccaacauacgaucgaucugaccgacagugaaaugaauaaauuguucgagaagacaaagaagcagcuacgagaaaacgcugaggauaugggcaauggaugcuuuaagauuuaccacaaaugugacaacgccugcaucggcuccauucgcaaugggacuuaugaucaugacguauacagagacgaggcucugaacaauagguuccagaucaagggaguggaacucaaaagcgguuacaaggauuggauacuguggaucucuuuugccauuucaugcuuccuucugugugucgcauugcucggcuuugugaugugggccugccagaaagggaacauccgguguaauauuugcaucuga

SEQ ID NO: 132562 - RNA, 1701 nt, Artificial Sequence; identical to SEQ ID NO: 131874
  derived and/or modified sequence opt3 from hemagglutinin__InfluenzaA__AGW01701

SEQ ID NO: 132563 - RNA, 1701 nt, Artificial Sequence; identical to SEQ ID NO: 131874
  derived and/or modified sequence opt3 from hemagglutinin__InfluenzaA__AGW01713

SEQ ID NO: 132564 - RNA, 1701 nt, Artificial Sequence
  derived and/or modified sequence opt3 from hemagglutinin__InfluenzaA__AGW01725
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgaggucgaagggcggauucaggaccuggagaaauacguugaggauaccaagauagacuuauggucauauaacgccgaacugcucguggcacuugagaaccaacauacgaucgaucugaccgacagugaaaugaauaaauuguucgagaagacaaagaagcagcuacgagaaaacgcugaggauaugggcaauggaugcuuuaagauuuaccacaaaugugacaacgccugcaucggcuccauucgcaaugggacuuaugaucauaacguauacagagacgaggcucugaauaacagguuccagaucaagggaguggaacucaaaagcgguuacaaggacuggauacuguggaucucuuuugccauuucaugcuuccuuaucugugucgcacuguugggcuuuauuaugugggccugccagaaagggaauauccgguguaacauaugcauuuga

SEQ ID NO: 132565 - RNA, 1701 nt, Artificial Sequence; identical to SEQ ID NO: 131874
  derived and/or modified sequence opt3 from hemagglutinin__InfluenzaA__AGW01737

SEQ ID NO: 132566 - RNA, 1701 nt, Artificial Sequence; identical to SEQ ID NO: 132010
  derived and/or modified sequence opt3 from hemagglutinin__InfluenzaA__AGW01749

SEQ ID NO: 132567 - RNA, 1701 nt, Artificial Sequence; identical to SEQ ID NO: 132010
  derived and/or modified sequence opt3 from hemagglutinin__InfluenzaA__AGW01761

SEQ ID NO: 132568 - RNA, 1701 nt, Artificial Sequence; identical to SEQ ID NO: 131874
  derived and/or modified sequence opt3 from hemagglutinin__InfluenzaA__AGW01773

SEQ ID NO: 132569 - RNA, 1701 nt, Artificial Sequence; identical to SEQ ID NO: 132010
  derived and/or modified sequence opt3 from hemagglutinin__InfluenzaA__AGW01785

SEQ ID NO: 132570 - RNA, 1701 nt, Artificial Sequence; identical to SEQ ID NO: 131874
  derived and/or modified sequence opt3 from hemagglutinin__InfluenzaA__AGW01797

SEQ ID NO: 132571 - RNA, 1701 nt, Artificial Sequence; identical to SEQ ID NO: 132010
  derived and/or modified sequence opt3 from hemagglutinin__InfluenzaA__AGW01809

SEQ ID NO: 132572 - RNA, 1701 nt, Artificial Sequence; identical to SEQ ID NO: 132010
  derived and/or modified sequence opt3 from hemagglutinin__InfluenzaA__AGW01821

SEQ ID NO: 132573 - RNA, 1701 nt, Artificial Sequence; identical to SEQ ID NO: 132009
  derived and/or modified sequence opt3 from hemagglutinin__InfluenzaA__AGW01833

SEQ ID NO: 132574 - RNA, 1701 nt, Artificial Sequence
  derived and/or modified sequence opt3 from hemagglutinin__InfluenzaA__AGW01845
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuacuaaugagaguuucaacuggacagguguuacccaaaaugggacguccucugcuugcauucgccgaagcaacuccucauuuuucagucgucugaauuggcucacucauuuaaacuuuaaguauccagcacugaaugugaccaugcccaacaacgagcaguucgacaaguuguacaucuggggaguccaccauccuggcacagauaaagaccagauuuuucuuuaugcccagagcucuggcagaaucacuguguccaccaagaggucacaacaggcuguaauaccaaauauugggagccggccccgcaucagaaacauuccuaguaggaucucuaucuacuggacaauuguuaaaccaggagauauacugcuaaucaauuccaccgguaaccucauugccccgcggggcuacuucaagauccgcagcgggaaaucgucuauaaugcgauccgacgcgcccauuggaaaguguaagucagaaugcaucacgccuaauggcaguaucccaaacgacaaacccuuucagaaugugaacagaauuacuuauggugcauguccuagguacgucaagcagagcacacugaaacuugccaccgggaugcggaaugugccagagaagcaaacucguggaaucuucggcgcuauugccggcuuuauagaaaacgggugggagggaaugguggaugguugguauggcuuccgccaccaaaauuccgaggggagaggacaggcagcugaccugaaaucuacacaggccgcgaucgaucagauuaacggcaaguugaauaggcucaucgguaaaaccaacgaaaaguuccaccagaucgagaaggaauuuagcgaggucgaagggcggauucaggaccuggagaaauacguugaggauacgaagauagacuuauggucauauaaugccgaacugcucguggcacuugagaaccaacauaccaucgaucugacagacagugaaaugaacaaauuguucgagaagacuaaaaagcagcuacgagaaaaugcugaggauaugggcaacggaugcuuuaagauuuaccacaaaugugacaaugccugcaucggcuccauucgcaacgggaccuaugaucauaauguauacagagacgaggcucugaacaauagguuccagaucaagggaguggaacucaaaagcgguuacaaggacuggauacuguggaucucuuuugccauuucaugcuuccuucugugugucgcauugcucggcuuuaucaugugggccugccagaaagggaacauucgguguaauaucugcauauga

SEQ ID NO: 132575 - RNA, 1701 nt, Artificial Sequence; identical to SEQ ID NO: 132010
  derived and/or modified sequence opt3 from hemagglutinin__InfluenzaA__AGW01857

SEQ ID NO: 132576 - RNA, 1701 nt, Artificial Sequence; identical to SEQ ID NO: 132010
  derived and/or modified sequence opt3 from hemagglutinin__InfluenzaA__AGW01869

SEQ ID NO: 132577 - RNA, 1701 nt, Artificial Sequence; identical to SEQ ID NO: 132561
  derived and/or modified sequence opt3 from hemagglutinin__InfluenzaA__AGW01881

SEQ ID NO: 132578 - RNA, 1701 nt, Artificial Sequence; identical to SEQ ID NO: 131884
  derived and/or modified sequence opt3 from hemagglutinin__InfluenzaA__AGW01893

SEQ ID NO: 132579 - RNA, 1701 nt, Artificial Sequence; identical to SEQ ID NO: 131899
  derived and/or modified sequence opt3 from hemagglutinin__InfluenzaA__AGW01905

SEQ ID NO: 132580 - RNA, 1701 nt, Artificial Sequence; identical to SEQ ID NO: 132010
  derived and/or modified sequence opt3 from hemagglutinin__InfluenzaA__AGW01917

SEQ ID NO: 132581 - RNA, 1701 nt, Artificial Sequence; identical to SEQ ID NO: 131874
  derived and/or modified sequence opt3 from hemagglutinin__InfluenzaA__AGW01929

SEQ ID NO: 132582 - RNA, 1701 nt, Artificial Sequence; identical to SEQ ID NO: 132010
  derived and/or modified sequence opt3 from hemagglutinin__InfluenzaA__AGW01941

SEQ ID NO: 132583 - RNA, 1701 nt, Artificial Sequence; identical to SEQ ID NO: 131874
  derived and/or modified sequence opt3 from hemagglutinin__InfluenzaA__AGW01953

SEQ ID NO: 132584 - RNA, 1701 nt, Artificial Sequence
  derived and/or modified sequence opt3 from hemagglutinin__InfluenzaA__AGW01965
augaagaccaucauugcccugagcuacauacucugccuuguguucgcucaggagcugcccggcaacgacgauuccauggcaacauuguguuuagggcaccaugccgucccuaauggaacuaucguuaaaacgauuaccaacgaccaaaucgaagugacaaaugcgacugagcugguacagucuucaaguaccggugaaauuugcaacagcccacaccagauccuagauggcgagaauuguacacucauagacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacccuggaguuuaacaaugaguccuucaacuggacugguguuacacagaaugggaccucuagcgcuugcauccggcgcuccaacaauucauuuuucagucgacugaacuggcucacgcacuuaaauuuuaaauacccagcacugaacgugacuaugcccaacaaugaacaguucgacaaacuuuauauuuggggaguccaucacccuggcaccgauaaggaccagaucuuuuuguacgcccaagcuagcggccguauuacagugucuacuaaaagaucccagcaggccguaaucccaaacauagggucaaggccccggguucgcaauauuccuagcagagugaguaucuauuggaccauugucaagccaggagauauccugcuaaucaacucuacagguaaucucauugcgccgaggggcuacuucaaaauacgguccggaaagagcucgaucaugcgcucugacgcacccauugggaaauguaacuccgccugcaucaccccuaauggcucaauaccaaacgacaagcccuuucagaaugugaaccgaauuacguacggugcuuguccuagauaugugaagcaaaauacucugaaacuugccacagggaugaggaacgucccagagaagcagacccggggaaucuucggcgcaaucgcuggcuuuauugaaaaugggugggagggaaugguugaugguugguacggcuuccgucaccagaacagugaggggcgcggacaagccgcggaccugaaaagcacucaggccgcaaucgaucagauuaauggcaaguugaacagacucauagguaaaacaaacgaaaaguuccaucagaucgagaaagaauuuuccgagguggaagggaggauucaagaccuggagaaguauguagaggauaccaagaucgacuuauggucuuacaaugcugaacugcucguggcccuugagaaccagcacacgaucgaucugaccgacagcgaaaugaauaaauuguucgagaagacaaagaagcagcuacgggaaaacgcugaggauaugggcaauggaugcuuuaaaauuuaucauaagugugacaacgauugcauaggcucaauccgaaaugggacuuacgaccacaacgucuaucgcgacgaggcccugaauaacagauuccagauuaagggaaucgaacucaaaagugguuacaaggauuggauucuguggaucuccuuugcaauaagcugcuuccuucuguguguggccuugcucggcuuuaucaugugggcuugccaaaaagggaauauuagguguaacaucugcauuuga

SEQ ID NO: 132585 - RNA, 1701 nt, Artificial Sequence; identical to SEQ ID NO: 132010
  derived and/or modified sequence opt3 from hemagglutinin__InfluenzaA__AGW01977

SEQ ID NO: 132586 - RNA, 1701 nt, Artificial Sequence; identical to SEQ ID NO: 132010
  derived and/or modified sequence opt3 from hemagglutinin__InfluenzaA__AGW01989

SEQ ID NO: 132587 - RNA, 1701 nt, Artificial Sequence; identical to SEQ ID NO: 132010
  derived and/or modified sequence opt3 from hemagglutinin__InfluenzaA__AGW02001

SEQ ID NO: 132588 - RNA, 1701 nt, Artificial Sequence; identical to SEQ ID NO: 132010
  derived and/or modified sequence opt3 from hemagglutinin__InfluenzaA__AGW02013

SEQ ID NO: 132589 - RNA, 1701 nt, Artificial Sequence; identical to SEQ ID NO: 131874
  derived and/or modified sequence opt3 from hemagglutinin__InfluenzaA__AGW02025

SEQ ID NO: 132590 - RNA, 1701 nt, Artificial Sequence; identical to SEQ ID NO: 132010
  derived and/or modified sequence opt3 from hemagglutinin__InfluenzaA__AGW02037

SEQ ID NO: 132591 - RNA, 1701 nt, Artificial Sequence; identical to SEQ ID NO: 132010
  derived and/or modified sequence opt3 from hemagglutinin__InfluenzaA__AGW02061

SEQ ID NO: 132592 - RNA, 1701 nt, Artificial Sequence; identical to SEQ ID NO: 132010
  derived and/or modified sequence opt3 from hemagglutinin__InfluenzaA__AGW02073

SEQ ID NO: 132593 - RNA, 1701 nt, Artificial Sequence; identical to SEQ ID NO: 132010
  derived and/or modified sequence opt3 from hemagglutinin__InfluenzaA__AGW02085

SEQ ID NO: 132594 - RNA, 1701 nt, Artificial Sequence; identical to SEQ ID NO: 131899
  derived and/or modified sequence opt3 from hemagglutinin__InfluenzaA__AGW02097

SEQ ID NO: 132595 - RNA, 1701 nt, Artificial Sequence; identical to SEQ ID NO: 131874
  derived and/or modified sequence opt3 from hemagglutinin__InfluenzaA__AGW02109

SEQ ID NO: 132596 - RNA, 1701 nt, Artificial Sequence; identical to SEQ ID NO: 132010
  derived and/or modified sequence opt3 from hemagglutinin__InfluenzaA__AGW02133

SEQ ID NO: 132597 - RNA, 1701 nt, Artificial Sequence; identical to SEQ ID NO: 132010
  derived and/or modified sequence opt3 from hemagglutinin__InfluenzaA__AGW02157

SEQ ID NO: 132598 - RNA, 1701 nt, Artificial Sequence; identical to SEQ ID NO: 131874
  derived and/or modified sequence opt3 from hemagglutinin__InfluenzaA__AGW02169

SEQ ID NO: 132599 - RNA, 1701 nt, Artificial Sequence; identical to SEQ ID NO: 132010
  derived and/or modified sequence opt3 from hemagglutinin__InfluenzaA__AGW02181

SEQ ID NO: 132600 - RNA, 1701 nt, Artificial Sequence; identical to SEQ ID NO: 131884
  derived and/or modified sequence opt3 from hemagglutinin__InfluenzaA__AGW02193

SEQ ID NO: 132601 - RNA, 1701 nt, Artificial Sequence; identical to SEQ ID NO: 131851
  derived and/or modified sequence opt3 from hemagglutinin__InfluenzaA__AGW04171

SEQ ID NO: 132602 - RNA, 1707 nt, Artificial Sequence
  derived and/or modified sequence opt3 from hemagglutinin__InfluenzaA__AGW27061
auggagaagaucgugcuacucuucgccauugucaaccuuguuaaaagcgaccacauaugcaucggcuaccaugcuaauaacuccaccgaacagguggauacaauuauggagaagaauguaacugugacgcacgcacaagacauccuggaaaagacccauaacgggaaguugugugauuuaaauggagucaaaccccugauucuaaaggacugcucuguggccgguuggcuccugggcaacccuaugugugaugaguuuaucgacguuccagaauggucauauauaguggagaaggcgaauccggcuaacgaucuuugcuaccccgggaauuucaacgacuaugaggaacugaaacacuugcucaguagaaucaaucauuuugagaagauuaggaucauuccuaaagauagcuggccagaccacgaagccucccugggagucucugcagccuguucguaccagggcaacagcucauucuuucggaaugugguauggcugcucaagaaaaacgaugcuuaucccaucauaaagaagaguuacaauaacacaaacaaagaggacuuacugguucuuugggguauucaccauccuaaugaugaggcagaacagauccgcuuguaucagaacccaacuaccuacguguccacagggaccucuacucugaaucaacgacuggucccccguauugccacaagaagcaaggugaacggacaguccggcaggaucgacuucuuuuggaccauccucaaaccuaaugacgcuauuaacuucgagucaaauggcaacuuuauagccccagaauacgcguauaagaucgugaaaaagggggauaguacgauuaugcggagcgaggucgaauacggaaauugcucuacucgcugucagaccccgaugggugcaaucaacuccucaaugcccuuccacaauauacauccucugacaauuggcgagugcccaaaauauguuaagagcaacaaacuugugcuggccacuggguugagaaauaguccccagaucgagaggcggcgccgaaaaagaggacucuuuggcgcuaucgccgguuucauugaagggggauggcaaggcaugguagacggcugguacggguaucaccacucuaacgagcagggauccgguuacgcagcugauaaggaaagcacccagaaagccaucgacggcgugacaaauaaggucaacucgauuauagauaaaaugaacacccaguuugaggcgguggggagggaguucaauaaccuggaacggcguaucgagaauuuaaacaagaagauggaagacggauuccuggauguuuggacguauaaugccgagcuccuugugcugauggaaaacgagcgcacuuuggacuuucaugauucuaaugucaaaaaccuauacgacaaggugagacugcaacucagggauaaugcaaaagaacugggcaacgguuguuucgaguuuuaccacaagugcgacaaugaguguauggaauccguacggaacgggacauaugacuacccucaguauucagaggaagcucgacuuaaacgcgaggagauuaguggcguuaagcuggaaagcaucggaaccuaccagaucuuguccauuuauucuacuguggccagcucacucguccugaguauaaugguggcuggcuuaucccuguggaugugcagcaaugggucucuacaaugcagaauguguaucuga

SEQ ID NO: 132603 - RNA, 1698 nt, Artificial Sequence
  derived and/or modified sequence opt3 from hemagglutinin__InfluenzaA__AGY14471
augaaggugaaacugcucauccuucugugcaccuucacagccacuuacgcugacacgauuuguauaggcuaucacgcaaacaauagcaccgauacagucgacacuaucuuggagaagaacguuaccgugacacauuccguaaauuuacuggaagauucucacaacgggaaacuaugccuccugaagggaauugcgccccuucagcuggguaauuguucaguggccggcuggaucuuggggaacccugagugcggacuccugauuccaaaagaaaguuggagcuacaucgucgagaccccgaaucccgaaaacggcacuuguuauccugguuacuuugacgauuaugaggagcugagagaacaacucuccucugugucgucauucgagagguuugaaauauucccaaaggagagcaguuggcccaaucauacaguuaccgggguguccgcuucuugcagccacaacggaaaguccucauuuuaccggaauuuacuguggcuuacgggcaaaaacggcuuguauccuaaucugaguaagagcuacgccaacaauaaagagaaggaaguccuaauccucuggggagugcaucacccaucuaacauugggaaccagcgcacucuguaccacaccgagaauacauauguauccguugugucaagccauuacagucgacguuucacucccgaaaucaccaaaagaccuaaggucagggaccaggagggucggauuaacuauuacuggacacuucuggaaccaggcgauaccaucauauuugaggcaaaugggaacuugauugccccgugguaugcuuucgcacucucuaagggauuuggcuccgguaucauuacgagcaaugcccccauggacgagugugaugcuaaaugccagacuccucaaggggccaucaacucgaaucugccauuccagaacgugcaccccgugacaaucggagaauguccuaaguacguccgcucuaccaaauuaagaaugguuacuggccugaggaauauuccauccauacagucacggggccucuuuggggcgaucgcaggauucauugaggguggcuggacagggaugguggacggaugguauggcuaccaucaccagaacgaacaagguaguggguacgccgcugaucaggagagcacccagaaugccaucaacggcauaacgaauaagguaaacuccgugauugaaaagaugaauacccaguuuacagucgugggaaaagaguucaacaaacuugagcgccgaauggaaaaccugaauaagaagguugacgauggcuucuuggacaucuggacuuauaacgcagagcuacuggugcuccuggaaaaugagagaacccuugacuuucacgauucuaacgucaugaaucuguacgaaaaagugaaggggcaauugaaaaacaaugcuaaggagaucggaaacgguugcuucgaguuuuaucauaaauguaauaacgaaugcauggagagcguaaagaauggcacauacgacuaucccaaguacucagaagagaguaaacucaacagggagaagauugaugggguuaaacuggaauccaugggaguguaucagaucuuagccauuuacagcacugucgcgucuucacuggugcuacucgucagucugggcgccaucagcuucuggaugugcuccaaugguucucuucagugucggauaugcauuuga

SEQ ID NO: 132604 - RNA, 1698 nt, Artificial Sequence; identical to SEQ ID NO: 132603
  derived and/or modified sequence opt3 from hemagglutinin__InfluenzaA__AGY14477

SEQ ID NO: 132605 - RNA, 1701 nt, Artificial Sequence
  derived and/or modified sequence opt3 from hemagglutinin__InfluenzaA__AHC57459
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcugccggccguauuacugugagcaccaagagaucucagcaggcgguaaucccaaauauaggguccaggccccggauucgcaacaucccuucaagaguuagcauuuauuggacaaucgugaaaccaggagacauccugcuaauuaauaguaccgguaaccucauagcaccgaggggcuacuucaagauccggucugggaaauccagcauuaugcgcucggaugcccccaucggaaaguguaauucugcuugcauaacgccuaacggcuccauuccaaaugacaagcccuuucagaacgucaaucgaaucacuuacggugccuguccuagauaugugaaacaaaacacacugaaacuugcaaccgggaugaggaaugugccagaaaagcagacucggggaaucuucggcgcuauugccggcuuuaucgagaacgggugggaaggaauggucgacgguugguacggcuuccgucaccaaaauucagaggggcgcggacaggcggccgaucugaagaguacacaggcagcuauugaccagauaaacggcaaauugaacagacucaucgguaagaccaaugagaaauuccaucagauugaaaaggaguuuagcgaaguugaggggaggauccaagaucuggaaaaguauguggaggacacgaaaaucgauuuaugguccuacaacgccgagcugcucguagcucuugaaaaucagcacaccauugaccugacagauucugagaugaacaaguuguucgaaaagacuaagaaacagcuacgggagaaugccgaagacaugggcaacggaugcuuuaagauauaucauaagugugauaaugcaugcaucggcagcauucgaaacgggaccuacgaccacgauguguaucgcgacgaggcccugaauaacagauuccagaucaaaggagucgagcucaagucagguuacaaagacuggauucuguggaucaguuuugcuauauccugcuuccuucuguguguggcguugcucggcuuuaucaugugggcaugccaaaaggggaauauuagguguaacaucugcauuuga

SEQ ID NO: 132606 - RNA, 1701 nt, Artificial Sequence; identical to SEQ ID NO: 128998
  derived and/or modified sequence opt3 from hemagglutinin__InfluenzaA__AHC57465

SEQ ID NO: 132607 - RNA, 1701 nt, Artificial Sequence; identical to SEQ ID NO: 128871
  derived and/or modified sequence opt3 from hemagglutinin__InfluenzaA__AHC57487

SEQ ID NO: 132608 - RNA, 1701 nt, Artificial Sequence; identical to SEQ ID NO: 129798
  derived and/or modified sequence opt3 from hemagglutinin__InfluenzaA__AHC57499

SEQ ID NO: 132609 - RNA, 1701 nt, Artificial Sequence; identical to SEQ ID NO: 129798
  derived and/or modified sequence opt3 from hemagglutinin__InfluenzaA__AHC57511

SEQ ID NO: 132610 - RNA, 1701 nt, Artificial Sequence; identical to SEQ ID NO: 129798
  derived and/or modified sequence opt3 from hemagglutinin__InfluenzaA__AHC57523

SEQ ID NO: 132611 - RNA, 1701 nt, Artificial Sequence; identical to SEQ ID NO: 128998
  derived and/or modified sequence opt3 from hemagglutinin__InfluenzaA__AHC57675

SEQ ID NO: 132612 - RNA, 1701 nt, Artificial Sequence; identical to SEQ ID NO: 128998
  derived and/or modified sequence opt3 from hemagglutinin__InfluenzaA__AHC57827

SEQ ID NO: 132613 - RNA, 1701 nt, Artificial Sequence; identical to SEQ ID NO: 128871
  derived and/or modified sequence opt3 from hemagglutinin__InfluenzaA__AHC57956

SEQ ID NO: 132614 - RNA, 1701 nt, Artificial Sequence
  derived and/or modified sequence opt3 from hemagglutinin__InfluenzaA__AHC57981
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacaaaauucuucaacaggugagaucugcgacaguccacaccagauacuggauggcgaaaacuguacccuaaucgacgcucuccugggggauccgcagugcgacggauuucagaauaaaaagugggaucuuuucguggagagaagcaaagccuauuccaacuguuaccccuaugacgucccugauuacgcaucucugaggucguugauugccucaagcggcacucucgaauuuaauaacgagaguuucaauuggacaggugugacccagaacgggacguccucugcuugcauccggcgcagcaauaacuccuuuuucucacgacugaauuggcugacucaucucaacuuuaaguauccagcauuaaacguuaccaugcccaauaacgagcaguucgacaagcuguacauuuggggagugcaccauccuggcacagauaaagaccagaucuuucuuuaugcccaagcuaguggccguauaacugucagcaccaagagaucucagcaggccgugauuccaaauaucggguccaggccccggguacgcaacauuccuucaagaaucagcaucuacuggacaauuguuaaaccaggagauauauugcugaucaauaguaccgguaaccuaauugcgccgaggggcuacuucaagauccggucugggaaauccagcauaaugcgcucggacgcacccauuggaaaguguaauucugaaugcaucacgccuaacggcuccaucccaaaugacaagcccuuucagaacgugaaucgaauuacuuauggugccuguccuagauacgucaaacaaaacacacucaagcuggcuaccgggaugaggaaugugccagagaaacagacucggggaaucuucggcgccauugcaggcuuuauagaaaacgggugggagggaaugguggaugguugguauggcuuccgucaccaaaauucagaggggcgcggacaggcugccgaccuuaagaguacacaggcggccaucgaucagauuaacggcaaccugaauagauugaucgguaaaaccaacgaaaaguuccaccagaucgagaaagaauuuagcgaggucgaagggaggauucaagaccucgagaaguacguugaggauacgaagauagaccugugguccuauaaugcagaauuacugguggcucucgagaaccagcauaccaucgaucuuacagacucugaaaugaauaaacuguucgagaagacuaaaaagcaguugcgggaaaacgccgaggauaugggcaauggaugcuuuaaaauuuaccacaagugugacaacgcuugcaucggcagcauucgaaaugggaccuaugaucaugacguauaccgcgacgaggcccuaaacaauagauuccagaucaagggaguggaacugaaaucagguuacaaggauuggauacucuggaucaguuuugcaauuuccugcuuccugcuuugugucgcccuguugggcuuuaucaugugggcuugccaaaaagggaacauuagguguaauaucugcauauga

SEQ ID NO: 132615 - RNA, 1701 nt, Artificial Sequence; identical to SEQ ID NO: 129798
  derived and/or modified sequence opt3 from hemagglutinin__InfluenzaA__AHC57993

SEQ ID NO: 132616 - RNA, 1701 nt, Artificial Sequence; identical to SEQ ID NO: 131090
  derived and/or modified sequence opt3 from hemagglutinin__InfluenzaA__AHC58005

SEQ ID NO: 132617 - RNA, 1701 nt, Artificial Sequence
  derived and/or modified sequence opt3 from hemagglutinin__InfluenzaA__AHC58017
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcugccggccguauuacugugagcaccaagagaucucagcaggcgguaaucccaaauauaggguccaggccccggguucgcaacauuccuucaagagugagcaucuauuggacaauugucaaaccaggagacauccugcuaaucaauaguaccgguaaccucauugcaccgaggggcuacuucaagauacggucugggaaauccagcaucaugcgcucggaugcccccauuggaaaguguaauucugcuugcaucacgccuaacggcuccauaccaaaugacaagcccuuucagaacgugaaucgaauuacuuacggugccuguccuagauaugugaaacaaaacacacugaaacuugcaaccgggaugaggaaugucccagaaaagcagacucggggaaucuucggcgcuaucgccggcuuuauugagaacgggugggaaggaaugguugacgguugguacggcuuccgucaccaaaauucagaggggcgcggacaggcggccgaucugaagaguacacaggcagcuaucgaccagauuaacggcaaauugaacagacucauagguaagaccaaugagaaauuccaucagaucgaaaaggaguuuagcgaaguggaggggaggauucaagaucuggaaaaguauguagaggacacgaaaaucgauuuaugguccuacaacgccgagcugcucguggcucuugaaaaucagcacaccaucgaccugacagauucugagaugaacaaguuguucgaaaagacuaagaaacagcuacgggagaaugccgaagacaugggcaacggaugcuuuaagauuuaucauaagugugauaaugcaugcauagucagcauccgaaacggcaccuacgaccacgauguguaucgcgacgaggcccugaauaacagauuccagauuaaagggguugagcucaagucaggauacaaagacuggauccuguggauuaguuuugcuaucuccugcuuccuucuguguguggcguugcucgguuuuauaaugugggcaugccaaaagggcaauaucagguguaacauuugcaucuga

SEQ ID NO: 132618 - RNA, 1701 nt, Artificial Sequence
  derived and/or modified sequence opt3 from hemagglutinin__InfluenzaA__AHC58029
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggggauccaauaacucauuuuucagucgccugaauuggcucacucaguuaaacuuuaaguacccagcacugaacgugaccaugcccaauaacgagcaguucgauaagcuguauauuuggggcguccaccauccuggcacagacaaagaucaaaucuuuuuguacgcccaggcuagcgggcgaauuacugugucuaccaagcguucccagcaggccguaaucccaaauauaggaucaagacccaggguucggaacauuccuagccgcgugaguaucuauuggacaauugucaaaccaggugacauccugcuaaucaauucuaccggcaaccucauugcgccgagaggguacuucaagauaagguccggaaaaagcucgaucaugcggucugaugcacccauuggcaaguguaauuccgccugcaucacgccuaacgguucaauaccaaaugacaagcccuuucaaaacgugaaucgcauuacuuacggggcuuguccucgauaugugaaacagaacacacugaaacuugccaccggaaugagaaaugucccagaaaaacagacuaggggcaucuucggcgcaaucgcuggguuuauugagaacggaugggaagguaugguugacggcugguacggguuccggcaccaaaauagugagggacguggccaggccgcggaucuuaagagcacacaggccgcaaucgaccagauuaacgguaaauugaaccgccucauagggaagaccaaugagaaauuccaccaaaucgaaaaggaguuuuccgaaguggagggcaggauucaggaucuggaaaaguauguagaggacacgaaaaucgauuuauggucuuacaacgcugagcugcucguggcccuugaaaaucagcauaccaucgaccugacagauagcgagaugaacaaguuguucgaaaagacuaagaaacagcuaagagagaaugcugaagacaugggaaacggcugcuuuaagauuuaucacaagugugauaaugccugcauagggucaauccggaacggaaccuacgaccaugaugucuaucgagacgaggcacugaauaaccgcuuccaaauuaaagguguggagcucaagaguggcuacaaagacuggauccuguggauuuccuuugccaucagcugcuuccuucuguguguugcuuugcucggguuuauaaugugggcgugccagaagggaaauaucagauguaacauuugcaucuga

SEQ ID NO: 132619 - RNA, 1701 nt, Artificial Sequence
  derived and/or modified sequence opt3 from hemagglutinin__InfluenzaA__AHC58050
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacucaaguuucuuuagccgacugaauuggcucacucauuuaaacuuuaaguauccagcacugaaugugaccaugcccaacaacgagcaguucgacaaacuuuacauuuggggaguccaccauccuggcacagauaaggaccagaucuuuuuguaugcccaaucuuccggccguauuacugugucaaccagaaggagccagcaggcuguaaucccaaauauagggagucggccccgcauuagaaacaucccuucuaggauuuccaucuacuggacaaucguuaagccaggagauauucugcuaauaaauagcaccgguaaccucaucgccccgcggggcuacuucaaaauucgcucggggaagucuuccaucaugcgaucagacgcgcccauaggaaaauguaauagugaaugcauuacgccuaacggcagcaucccaaaugacaagcccuuucagaacgugaauagaaucacuuauggugcauguccuagguacgucaagcaauccacacugaaacuugccaccgggaugcggaacgugccagagaagcagacucguggaauuuucggcgcuaucgccggcuuuauugaaaaugggugggagggaaugguggaugguugguauggcuuccgccaccagaacucugaggggagaggacaagcagcugaccugaaaagcacacaggccgcgauagaucagaucaauggcaaguugaacaggcucauugguaaaaccaaugaaaaguuccaccagaucgagaaagaauuuucagaggucgaagggcggauccaagaccuggagaaguacguugaggauacgaagauugacuuauggaguuauaacgccgaacugcucguggcacuugagaaccagcauaccauagaucugacagacuccgaaaugaauaaauuguucgagaagacuaaaaagcagcuacgagaaaacgcugaggauaugggcaauggaugcuuuaaaaucuaccacaagugugacaacgccugcauuggcagcauccgcaaugggaccuauaaccaugauguauacagagacgaggcucugaauaacagguuccagauuaagggaguggaacucaaaucugguuacaaggacuggauccuguggauaucauuugccaucaguugcuuccuucugugugucgcauugcucggcuuuauuaugugggccugccaaaaagggaauauccgguguaacauuugcaucuga

SEQ ID NO: 132620 - RNA, 1701 nt, Artificial Sequence; identical to SEQ ID NO: 129798
  derived and/or modified sequence opt3 from hemagglutinin__InfluenzaA__AHC58074

SEQ ID NO: 132621 - RNA, 1701 nt, Artificial Sequence; identical to SEQ ID NO: 129798
  derived and/or modified sequence opt3 from hemagglutinin__InfluenzaA__AHC58098

SEQ ID NO: 132622 - RNA, 1701 nt, Artificial Sequence; identical to SEQ ID NO: 129798
  derived and/or modified sequence opt3 from hemagglutinin__InfluenzaA__AHC58110

SEQ ID NO: 132623 - RNA, 1701 nt, Artificial Sequence; identical to SEQ ID NO: 129798
  derived and/or modified sequence opt3 from hemagglutinin__InfluenzaA__AHC58126

SEQ ID NO: 132624 - RNA, 1701 nt, Artificial Sequence; identical to SEQ ID NO: 129798
  derived and/or modified sequence opt3 from hemagglutinin__InfluenzaA__AHC58138

SEQ ID NO: 132625 - RNA, 1701 nt, Artificial Sequence; identical to SEQ ID NO: 129798
  derived and/or modified sequence opt3 from hemagglutinin__InfluenzaA__AHC58162

SEQ ID NO: 132626 - RNA, 1701 nt, Artificial Sequence; identical to SEQ ID NO: 131090
  derived and/or modified sequence opt3 from hemagglutinin__InfluenzaA__AHC58186

SEQ ID NO: 132627 - RNA, 1701 nt, Artificial Sequence
  derived and/or modified sequence opt3 from hemagglutinin__InfluenzaA__AHC58198
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcgaaaacuguacccucauagacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcauccggcgcagcaauaacuccuuuuucucacgacugaauuggcucacucauuuaaacuuuaaguauccagcacugaacgugaccaugcccaauaacgagcaguucgacaaacuuuacauuuggggaguccaccauccuggcacagauaaggaccagaucuuuuuguaugcccaagcuaguggccguauuacugugagcaccaagagaucucagcaggccguaaucccaaauauaggguccaggccccggguucgcaacauuccuucaagaaucagcauuuacuggacaaucgugaaaccaggagauauccugcuaauuaauaguaccgguaaccucauagcgccgaggggcuacuucaagauccggucugggaaauccagcauuaugcgcucggacgcacccaucggaaaguguaauucugaaugcauaacgccuaacggcuccauuccaaaugacaagcccuuucagaacgucaaucgaaucacuuauggugccuguccuagauacgugaaacaaaacacacugaaacuugcuaccgggaugaggaaugugccagagaagcagacucggggaaucuucggcgccauugcaggcuuuaucgaaaacgggugggagggaauggucgaugguugguauggcuuccgucaccaaaauucagaggggcgcggacaggcugccgaccugaagaguacacaggcggccauugaucagauaaacggcaaauugaacagacucaucgguaagaccaaugaaaaauuccaccagauugagaaggaauuuagcgagguugaagggaggauccaaaaccuggagaaguacguggaggacacgaaaaucgauuuaugguccuauaaugcagaacugcucguagcucuugagaaccagcauaccauugaccugacagauucugaaaugaauaaguuguucgagaaaacuaagaaacagcuacgggaaaacgccgaggacaugggcaauggaugcuuuaagauauaccacaagugugauaacgcuugcaucggcagcauucgaaaugggaccuaugaccaugauguguaccgcgacgaggcccugaacaauagauuccagaucaaaggagucgaacucaagucagguuacaaagacuggauucuguggaucaguuuugcaauauccugcuuccuucuguguguggccuugcucggcuuuaucaugugggauugccaaaaggggaacauuagguguaauaucugcauuuga

SEQ ID NO: 132628 - RNA, 1701 nt, Artificial Sequence
  derived and/or modified sequence opt3 from hemagglutinin__InfluenzaA__AHC58210
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcgaaaacuguacccucauagacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacucuggaauuuaauaacgagaguuucaauugggcugguguuacacagaacgggaccuccucugcaugcauccggcgcagcaauaacuccuuuuucucacgacugaauuggcucacgcauuuaaacuuuaaguauccagcccugaacgugacuaugcccaauaacgagcaguucgacaaacuuuacauuuggggaguccaccauccuggcaccgauaaggaccagaucuuuuuguaugcucaagccaguggccguauuacagugagcacuaagagaucucagcaggcgguaaucccaaauauaggguccaggccccggguucgcaacauuccuucaagaaucagcauuuacuggaccaucgugaaaccaggagauauccugcuaauuaauaguacagguaaccucauagcaccgaggggcuacuucaagauccggucugggaaauccagcauuaugcgcucggacgcccccaucggaaaguguaauucugaaugcauaaccccuaacggcuccauuccaaaugacaagcccuuucagaacgucaaucgaaucacguauggugcuuguccuagauacgugaaacaaaacacucugaaacuugccacagggaugaggaaugugccagagaagcagacccggggaaucuucggcgcaauugcuggcuuuaucgaaaacgggugggagggaauggucgaugguugguauggcuuccgucaccaaaauucagaggggcgcggacaggccgcggaccugaagaguacucaggccgcaauugaucagauaaacggcaaauugaacagacucaucgguaagacaaaugaaaaauuccaccagauugagaaggaauuuagcgagguugaagggaggauccaagaccuggagaaguacguggaggauaccaaaaucgacuuaugguccuauaacgcugaacugcucguagcccuugagaaucagcauacgauugaucugaccgacucugaaaugaacaaguuguucgagaaaacaaagaaacagcuacgggaaaaugcugaggauaugggcaacggaugcuuuaagauauaccacaagugugacaaugccugcaucggcagcauucgaaacgggacuuaugaucaugacguguaccgcgacgaggcacugaauaacagauuccagaucaaaggagucgaacucaagucagguuacaaagauuggauucuguggaucaguuuugccauauccugcuuccuucuguguguggcuuugcucggcuuuaucaugugggcgugccaaaaggggaauauuagguguaacaucugcauuuga

SEQ ID NO: 132629 - RNA, 1701 nt, Artificial Sequence; identical to SEQ ID NO: 128998
  derived and/or modified sequence opt3 from hemagglutinin__InfluenzaA__AHC58234

SEQ ID NO: 132630 - RNA, 1701 nt, Artificial Sequence; identical to SEQ ID NO: 129798
  derived and/or modified sequence opt3 from hemagglutinin__InfluenzaA__AHC58246

SEQ ID NO: 132631 - RNA, 1701 nt, Artificial Sequence; identical to SEQ ID NO: 128998
  derived and/or modified sequence opt3 from hemagglutinin__InfluenzaA__AHC58258

SEQ ID NO: 132632 - RNA, 1701 nt, Artificial Sequence; identical to SEQ ID NO: 128871
  derived and/or modified sequence opt3 from hemagglutinin__InfluenzaA__AHC58270

SEQ ID NO: 132633 - RNA, 1701 nt, Artificial Sequence
  derived and/or modified sequence opt3 from hemagglutinin__InfluenzaA__AHC58372
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacucaaguuucuuuagccgacugaauuggcucacucauuuaaacuuuaaguauccagcacugaaugugaccaugcccaacaacgagcaguucgacaagcuguacauuuggggaguccaccauccuggcacagauaaagaccagaucuuuuuguaugcccaaucuuccggccguauuacugugucaaccaagagaagccagcaggcuguaacaccaaauaucgggaguaggccccggauacgcaacauuccuucuagaaucuccauuuacuggaccaucguuaaaccaggagauauccugcuaauuaauagcacggguaaccucauagccccgaggggcuacuucaagauccggucggggaaaucuuccauuaugcgcucagacgcgcccaucggaaaguguaauagugaaugcauaacuccuaacggcagcauuccaaaugacaagcccuuucagaacgugaaucgaaucacauauggugcauguccuagauacgucaaacaauccacccugaaacuugccacugggaugaggaacgugccagagaagcagacacggggaaucuucggcgcuauugccggcuuuaucgaaaaugggugggagggaaugguggaugguugguauggcuuccgucaccagaacucugaggggcgcggacaagcagcugaccuuaagagcacccaggccgcgauugaucagauaaauggcaaauugaacagacucaucgguaagacgaaugaaaaauuccaccagauugagaaggaauuuucagaggucgaagggaggauccaagaccuggagaaguacguugaggauaccaaaaucgacuuauggaguuauaacgccgaacugcucguggcacuugagaaccagcauacaauugaucugacugacuccgaaaugaauaaguuguucgagaaaaccaagaaacagcuacgggaaaacgcugaggauaugggcaauggaugcuuuaagauauaccacaagugugacaacgccugcaucggcagcauucgaaaugggacauauaaccaugauguauaccgcgacgaggcucugaauaacagauuccagaucaaaggaguggaacucaagucugguuacaaagacuggauucuguggaucucauuugccauaaguugcuuccuucugugugucgcauugcucggcuuuaucaugugggccugccaaaaggggaauauuagguguaacaucugcauuuga

SEQ ID NO: 132634 - RNA, 1701 nt, Artificial Sequence
  derived and/or modified sequence opt3 from hemagglutinin__InfluenzaA__AHC58396
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggggauccaauaacucauuuuucagucgccugaauuggcucacucacuuaaacuuuaaguacccagcacugaacgugaccaugcccaauaacgagcaguucgauaagcuguauauuuggggcguccaucacccuggcacagacaaagaucagaucuuuuuguacgcccaagcuagcgggcgaauuacugugucuaccaagcguucccagcaggccguaaucccaaauauaggaucaagacccaggguucggaacauuccuagccgcgugaguaucuauuggacaauugucaaaccaggugacauccugcuaaucaauucuaccggcaaccucauugcgccgagaggguacuucaagauaagguccggaaaaagcucgaucaugcggucugaugcacccauuggcaaguguaauuccgccugcaucacgccuaacgguucaauaccaaaugacaagcccuuucagaacgugaaucgcauuacuuacggggcuuguccucgauaugugaaacaaaacacacugaaacuugccaccggaaugagaaaugucccagaaaaacagacuaggggcaucuucggcgcaaucgcuggguuuauugagaacggaugggaagguaugguugacggcugguacggguuccggcaccagaauagugagggacguggccaagccgcggaucuuaagagcacacaggccgcaaucgaccagauuaacgguaaauugaaccgccucauagggaagaccaaugagaaauuccaucagaucgaaaaggaguuuuccgaaguggagggcaggauucaagaucuggaaaaguauguagaggacacgaaaaucgauuuauggucuuacaacgcugagcugcucguggcccuugaaaaucagcacaccaucgaccugacagauagcgagaugaacaaguuguucgaaaagacuaagaaacagcuaagagagaaugcugaagacaugggaaacggcugcuuuaagauuuaucauaagugugauaaugccugcauagggucaauccggaacggaaccuacgaccacgaugucuaucgagacgaggcacugaauaaccgcuuccagauuaaagguguggagcucaagaguggcuacaaagacuggauccuguggauuuccuuugccaucagcugcuuccuucuguguguugcuuugcucggguuuauaaugugggcgugccaaaagggaaauaucagauguaacauuugcaucuga

SEQ ID NO: 132635 - RNA, 1701 nt, Artificial Sequence; identical to SEQ ID NO: 129798
  derived and/or modified sequence opt3 from hemagglutinin__InfluenzaA__AHC58408

SEQ ID NO: 132636 - RNA, 1701 nt, Artificial Sequence; identical to SEQ ID NO: 131090
  derived and/or modified sequence opt3 from hemagglutinin__InfluenzaA__AHC58420

SEQ ID NO: 132637 - RNA, 1701 nt, Artificial Sequence; identical to SEQ ID NO: 131090
  derived and/or modified sequence opt3 from hemagglutinin__InfluenzaA__AHC58432

SEQ ID NO: 132638 - RNA, 1701 nt, Artificial Sequence; identical to SEQ ID NO: 128998
  derived and/or modified sequence opt3 from hemagglutinin__InfluenzaA__AHC58444

SEQ ID NO: 132639 - RNA, 1701 nt, Artificial Sequence; identical to SEQ ID NO: 132634
  derived and/or modified sequence opt3 from hemagglutinin__InfluenzaA__AHC58456

SEQ ID NO: 132640 - RNA, 1701 nt, Artificial Sequence
  derived and/or modified sequence opt3 from hemagglutinin__InfluenzaA__AHC58468
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaagcaggggccaaaaguuuuuauaagaaccugaucuggcucgugaaaaagggaaauagcuacccaaaauuaucuaaguccuauauaaacgauaagggcaaagaaguacugguucuuuggggcauccaucaccccucaacgagcgcugaccagcagaguuuguaccagaaugccgaugcguacguguucgucgggacuucuaaguauuccaaaaaguuuaaaccugagauugcagugcgcccaaaggugcgagaccaagagggacguaugaacuacuauuggacccuggucgaacccggugauaaaaucacauucgaggccacuggcaaccuacucguuccuagauacgcuuuugccauggaaaggaaugcagggagcggaauuaucauaucggacaccccagugcacgauugcaacacaaccugucagacgccgaagggcgcuauuaauacuucucugcccuuccagaacauccauccuauuacaaucgguaagugcccaaaauauguaaaguccaccaaacuucggcuggccacuggguugcgcaaugugcccucaauccagaguagaggacucuuuggcgcgauugccggcuucauagaagggggauggacagguauggucgacggcugguacggguaucaccaucaaaacgcacagggaagcggcuacgcugccgaccugaaguccacccagaaugcuaucgauaaaauuacgaacaagguuaauucugugaucgaaaagaugaacacccaguuuacagccguggguaaagaguucaaucacuuagagaggcggauagaaaaccugaauaagaaagucgacgauggguuccucgacauuuggacuuacaacgcagagcuucugguguugcuagaaaaugagcgcacccuggauuaucacgacagcaacguaaagaaccucuacgaaaaaguucgaucacaacugaagaauaacgccaaggagaucggcaauggauguuuugaguucuaucauaaaugcgauaacacauguauggaaagugugaagaauggcacuuacgacuauccuaaauacuccgaggaagcuaaacuuaacagagaggaaaucgauggggucaagcuggagagcaccaggauuuaucagaucuuggcgauuuacucuacaguggcaucaagucucguccuggugguuagcuuaggagccauauccuuuuggaugugcucuaaugguucgcugcagugccggaucuguauuuga

SEQ ID NO: 132641 - RNA, 1701 nt, Artificial Sequence
  derived and/or modified sequence opt3 from hemagglutinin__InfluenzaA__AHC58479
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagaucauagauggcgaaaacuguacccuaaucgacgcucuccugggggauccgcagugcgacggauuucagaauaaaaagugggaucuuuucguggagagaagcaaagccuauuccaacuguuaccccuaugacgucccugauuacgcaucucugaggucguugguggccucaagcggcacucucgaauuuaauaacgagaguuucaauuggacagguguuacccagaacgggacguccucugcuugcauucggcgcagcaauaacuccuuuuucucacgacugaauuggcugacucaucucaacuuuaaguauccagcauuaaacgugaccaugcccaauaacgagcaguucgacaagcuguacaucuggggaguccaccauccuggcacagauaaagaccagauuuuucuuuaugcccaagcuaguggccguaucacugugagcaccaagagaucucagcaggccguaauaccaaauauuggguccaggccccggguucgcaacaucccuucaagaauuagcaucuacuggacaaucgugaaaccaggagauauuuugcugauaaauaguaccgguaaccuaaucgcgccgaggggcuacuucaagauucggucugggaaauccagcaucaugcgcucggacgcacccauaggaaaguguaauucugaaugcauuacgccuaacggcuccaucccaaaugacaagcccuuucagaacgucaaucgaaucacuuauggugccuguccuagauacgugaaacaaaacacacucaagcuggcuaccgggaugaggaaugugccagagaaacagacucggggaauuuucggcgccaucgcaggcuuuauugaaaacgggugggagggaauggucgaugguugguauggcuuccgucaccaaaauucagaggggcgcggacaggcugccgaccuuaagaguacacaggcggccauaaaccagaucaacggcaaacugaauagauugauugguaagaccaacgaaaaauuccaccagaucgagaaggaauuuagcgagguugaagggaggauccaagaucucgagaaguacguggaggacacgaaaauugaucugugguccuauaaugcagaauuacugguagcucucgagaaccagcauaccauagaccuuacagauucugaaaugaauaagcuguucgagaaaacuaagaaacaguugcgggaaaacgccgaggacaugggcaauggaugcuuuaagaucuaccacaagugugauaacgcuugcauuggcagcauccgaaaugggaccuaugaccaugauguguaccgcgacgaggcccuaaacaauagauucaaaauuaagggagucgaacugaaaucagguuacaaggacuggauccucuggauaaguuuugcaaucuccugcuuccugcuuuguguggcccuguugggcuuuauuaugugggcuugccagaaagggaacaucagguguaauauuugcaucuga

SEQ ID NO: 132642 - RNA, 1701 nt, Artificial Sequence; identical to SEQ ID NO: 132634
  derived and/or modified sequence opt3 from hemagglutinin__InfluenzaA__AHC58491

SEQ ID NO: 132643 - RNA, 1701 nt, Artificial Sequence; identical to SEQ ID NO: 128998
  derived and/or modified sequence opt3 from hemagglutinin__InfluenzaA__AHC58515

SEQ ID NO: 132644 - RNA, 1701 nt, Artificial Sequence; identical to SEQ ID NO: 129798
  derived and/or modified sequence opt3 from hemagglutinin__InfluenzaA__AHC58527

SEQ ID NO: 132645 - RNA, 1701 nt, Artificial Sequence
  derived and/or modified sequence opt3 from hemagglutinin__InfluenzaA__AHC58563
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagaucauagauggcgaaaacuguacccuaaucgacgcucuccugggggauccgcagugcgacggauuucagaauaaaaagugggaucuuuucguggagagaagcaaagccuauuccaacuguuaccccuaugacgucccugauuacgcaucucugaggucguugguggccucaagcggcacucucgaauuuaauaacgagaguuucaauuggacagguguuacccagaacgggacguccucugcuugcauucggcgcagcaauaacuccuuuuucucacgacugaauuggcugacucaucucaacuuuaaguauccagcauuaaacgugaccaugcccaauaacgagcaguucgacaagcuguacaucuggggaguccaccauccuggcacagauaaagaccagauuuuucuuuaugcccaagcuaguggccguaucacugugagcaccaagagaucucagcaggccguaauaccaaauauuggguccaggccccggguucgcaacaucccuucaagaauuagcaucuacuggacaaucgugaaaccaggagauauuuugcugauaaauaguaccgguaaccuaaucgcgccgaggggcuacuucaagauucggucugggaaauccagcaucaugcgcucggacgcacccauaggaaaguguaauucugaaugcauuacgccuaacggcuccaucccaaaugacaagcccuuucagaacgucaaucgaaucacuuauggugccuguccuagauacgugaaacaaaacacacucaagcuggcuaccgggaugaggaaugugccagagaaacagacucggggaauuuucggcgccaucgcaggcuuuauugaaaacgggugggagggaauggucgaugguugguauggcuuccgucaccaaaauucagaggggcgcggacaggcugccgaccuuaagaguacacaggcggccauagaucagaucaacggcaaacugaacagauugauugguaagaccaaugaaaaauuccaccagaucgagaaggaauuuagcgagguugaagggaggauccaagaccucgagaaguacguggaggauacgaaaauugaccugugguccuauaacgcagaauuacugguagcucucgagaaucagcauaccauagaucuuacagacucugaaaugaacaagcuguucgagaaaacuaagaaacaguugcgggaaaaugccgaggauaugggcaacggaugcuuuaagaucuaccacaagugugacaaugcuugcauuggcagcauccgaaacgggaccuaugaucaugacguguaccgcgacgaggcccuaaauaacagauuccagauuaaaggagucgaacugaagucagguuacaaagauuggauccucuggauaaguuuugcaaucuccugcuuccugcuuuguguggcccuguugggcuuuauuaugugggcuugccaaaaggggaauaucagguguaacauuugcaucuga

SEQ ID NO: 132646 - RNA, 1701 nt, Artificial Sequence; identical to SEQ ID NO: 129798
  derived and/or modified sequence opt3 from hemagglutinin__InfluenzaA__AHC58575

SEQ ID NO: 132647 - RNA, 1701 nt, Artificial Sequence; identical to SEQ ID NO: 128871
  derived and/or modified sequence opt3 from hemagglutinin__InfluenzaA__AHC58587

SEQ ID NO: 132648 - RNA, 1701 nt, Artificial Sequence; identical to SEQ ID NO: 128998
  derived and/or modified sequence opt3 from hemagglutinin__InfluenzaA__AHC58599

SEQ ID NO: 132649 - RNA, 1701 nt, Artificial Sequence; identical to SEQ ID NO: 129798
  derived and/or modified sequence opt3 from hemagglutinin__InfluenzaA__AHC58611

SEQ ID NO: 132650 - RNA, 1701 nt, Artificial Sequence; identical to SEQ ID NO: 129798
  derived and/or modified sequence opt3 from hemagglutinin__InfluenzaA__AHC58623

SEQ ID NO: 132651 - RNA, 1701 nt, Artificial Sequence; identical to SEQ ID NO: 129798
  derived and/or modified sequence opt3 from hemagglutinin__InfluenzaA__AHC58647

SEQ ID NO: 132652 - RNA, 1701 nt, Artificial Sequence; identical to SEQ ID NO: 128998
  derived and/or modified sequence opt3 from hemagglutinin__InfluenzaA__AHC58659

SEQ ID NO: 132653 - RNA, 1701 nt, Artificial Sequence; identical to SEQ ID NO: 128871
  derived and/or modified sequence opt3 from hemagglutinin__InfluenzaA__AHC58671

SEQ ID NO: 132654 - RNA, 1701 nt, Artificial Sequence; identical to SEQ ID NO: 131090
  derived and/or modified sequence opt3 from hemagglutinin__InfluenzaA__AHC58683

SEQ ID NO: 132655 - RNA, 1701 nt, Artificial Sequence; identical to SEQ ID NO: 128871
  derived and/or modified sequence opt3 from hemagglutinin__InfluenzaA__AHC58695

SEQ ID NO: 132656 - RNA, 1701 nt, Artificial Sequence; identical to SEQ ID NO: 131090
  derived and/or modified sequence opt3 from hemagglutinin__InfluenzaA__AHC58707

SEQ ID NO: 132657 - RNA, 1701 nt, Artificial Sequence; identical to SEQ ID NO: 131090
  derived and/or modified sequence opt3 from hemagglutinin__InfluenzaA__AHC58719

SEQ ID NO: 132658 - RNA, 1701 nt, Artificial Sequence; identical to SEQ ID NO: 132634
  derived and/or modified sequence opt3 from hemagglutinin__InfluenzaA__AHC58731

SEQ ID NO: 132659 - RNA, 1701 nt, Artificial Sequence
  derived and/or modified sequence opt3 from hemagglutinin__InfluenzaA__AHC58743
augaagaccaucauugccuggagcuacauacugugccucguguucgcucagaaacuucccggcaacgacaauuccacagcaacucuguguuuggggcaccaugccgucccuaacggaacgaucguuaagaccauuacaaaugaucaaaucgaggugacuaacgcgaccgaauuaguacaaaauucuucaacaggugagauuugcgacaguccacaccagauccuggauggcgaaaacuguacccuaauagacgcucuccugggggauccgcagugcgacggauuucagaauaaaaagugggaucuuuucguggagagaagcaaagccuauuccaacuguuaccccuaugacgucccugauuacgcaucucugaggucguugguggccucaagcggcacucucgaauuuaauaacgagaguuucaauuggacagguguuacccagaacgggacguccucugcuugcauccggcgcagcaauaacuccuuuuucucacgacugaauuggcugacucaucucaacuuuaaguauccagcauuaaacgugaccaugcccaauaacgagcaguucgacaagcuguacauuuggggaguccaccauccuggcacagauaaagaccagaucuuucuuuaugcccaagcuaguggccguauuacugugagcaccaagagaucucagcaggccguaaucccaaauauaggguccaggccccggguucgcaacauuccuucaagaaucagcauuuacuggacaaucgugaaaccaggagauaucuugcugauuaauaguaccgguaaccuaauagcgccgaggggcuacuucaagauccggucugggaaauccagcauuaugcgcucggacgcacccaucggaaaguguaauucugaaugcauaacgccuaacggcuccauuccaaaugacaagcccuuucagaacgucaaucgaaucacuuauggugccuguccuagauacgugaaacaaaacacacucaagcuggcuaccgggaugaggaaugugccagagaaacagacucggggaaucuucggcgccauugcaggcuuuaucgaaaacgggugggagggaauggucgaugguugguauggcuuccgucaccaaaauucagaggggcgcggacaggcugccgaccuuaagaguacacaggcggccauugaucagauaaacggcaaacugaacagauugaucgguaagaccaaugaaaaauuccaccagauugagaaggaauuuagcgagguugaagggaggauccaagaccucgagaaguacguggaggauacgaaaaucgaccugugguccuauaacgcagaauuacugguagcucucgagaaucagcauaccauugaucuuacagacucugaaaugaacaagcuguucgagaaaacuaagaaacaguugcgggaaaaugccgaggauaugggcaacggaugcuuuaagauauaccacaagugugacaaugcuugcaucggcagcauucgaaacgggaccuaugaucaugacguguaccgcgacgaggcccuaaauaacagauuccagaucaaaggagucgaacugaagucagguuacaaagauuggauucucuggaucaguuuugcaauauccugcuuccugcuuuguguggcccuguugggcuuuaucaugugggcuugccaaaaggggaauauuagguguaacaucugcauuuga

SEQ ID NO: 132660 - RNA, 1701 nt, Artificial Sequence; identical to SEQ ID NO: 132634
  derived and/or modified sequence opt3 from hemagglutinin__InfluenzaA__AHC58755

SEQ ID NO: 132661 - RNA, 1701 nt, Artificial Sequence; identical to SEQ ID NO: 128871
  derived and/or modified sequence opt3 from hemagglutinin__InfluenzaA__AHC58779

SEQ ID NO: 132662 - RNA, 1701 nt, Artificial Sequence; identical to SEQ ID NO: 132633
  derived and/or modified sequence opt3 from hemagglutinin__InfluenzaA__AHC58791

SEQ ID NO: 132663 - RNA, 1701 nt, Artificial Sequence
  derived and/or modified sequence opt3 from hemagglutinin__InfluenzaA__AHC58803
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagaucauagauggcgaaaacuguacccuaaucgacgcucuccugggggauccgcagugcgacggauuucagaauaaaaagugggaucuuuucguggagagaagcaaagccuauuccaacuguuaccccuaugacgucccugauuacgcaucucugaggucguugguggccucaagcggcacucucgaauuuaauaacgagaguuucaauuggacagguguuacccagaacgggacguccucugcuugcauucggcgcagcaauaacuccuuuuucucacgacugaauuggcugacucaucucaacuuuaaguauccagcauuaaacgugaccaugcccaauaacgagcaguucgacaagcuguacaucuggggaguccaccauccuggcacagauaaagaccagauuuuucuuuaugcccaagcuaguggccguaucacugugagcaccaagagaucucagcaggccguaauaccaaauauuggguccaggccccggguucgcaacaucccuucaagaauuagcaucuacuggacaaucgugaaaccaggagauauuuugcugauaaauaguaccgguaaccuaaucgcgccgaggggcuacuucaagauucggucugggaaauccagcaucaugaagucggacgcacccauaggaaaguguaauucugaaugcauuacgccuaacggcuccaucccaaaugacaaacccuuucagaacgucaaucgcaucacuuauggugccuguccucgauacgugaagcaaaacacacucaaacuggcuaccgggaugagaaaugugccagagaagcagacuaggggaauuuucggcgccaucgcaggcuuuauugaaaacgggugggagggaauggucgaugguugguauggcuuccggcaccaaaauucagaggggcguggacaggcugccgaccuuaaaaguacacaggcggccauagaucagaucaacggcaagcugaaccgcuugauugguaaaaccaaugaaaaguuccaccagaucgagaaggaauuuagcgagguugaagggagaauccaagaccucgagaaauacguggaggauacgaagauugaccugugguccuauaacgcagaauuacugguagcucucgagaaucagcauaccauagaucuuacagacucugaaaugaacaaacuguucgagaagacuaaaaagcaguugagggaaaaugccgaggauaugggcaacggaugcuuuaagaucuaccacaaaugugacaaugcuugcauuggcagcauccggaacgggaccuaugaucaugacguguaccgagacgaggcccuaaauaaccgcuucaagauuaaaggagucgaacugaagucagguuacaaagauuggauccucuggauaaguuuugcaaucuccugcuuccugcuuuguguggcccuguugggcuuuauuaugugggcuugccagaaggggaauaucagauguaacauuugcaucuga

SEQ ID NO: 132664 - RNA, 1701 nt, Artificial Sequence
  derived and/or modified sequence opt3 from hemagglutinin__InfluenzaA__AHC58815
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgggaacuguacccucauagaugcucugcuuggagacccgcagugcgauggcuuucaaaauaaaaagugggaccuguucguggaaagauccaaagccuauucuaacuguuaccccuaugaugucccugacuacgcaucguugaggucacucguggccagcagugguacucuggaguuuaauaacgaauccuucaauuggacagggguuacccagaacggaacgucuagcgcuugcauccggcgcuccaauaacucauuuuucagucgacugaauuggcucacucauuuaaacuuuaaguauccagcacugaacgugaccaugcccaauaacgagcaguucgauaagcuguacauuuggggcguccaccauccuggcacagacaaagaucagaucuuuuuguaugcccaagcuagcgggcguauuacugugucuaccaagagaucccagcaggccguaaucccaaauauaggaucaaggccccggguucgcaacauuccuagcagaaucaguauuuacuggacaaucgugaaaccaggugacauccugcuaauuaauucuaccggcaaccucauagcgccgaggggguacuucaagauccgguccggaaaaagcucgauuaugcgcucugaugcacccaucggcaaguguaauuccgagugcauaacgccuaacgguucaauuccaaaugacaagcccuuucagaacgucaaucgaaucacuuauggggccuguccuagauacgugaaacaaaacacacugaaacuugcuaccggaaugaggaaugugccagaaaaacagacucggggcaucuucggcgccauugcaggguuuaucgagaacggaugggaagguauggucgacggcugguauggguuccgucaccagaauagugagggacgcggccaagcugccgaucuuaagagcacacaggcggccauugaccagauaaacgguaaauugaacagacucaucgggaagaccaaugagaaauuccaccagauugaaaaggaguuuuccgaaguugagggcaggauccaagaucuggaaaaguacguggaggacacgaaaaucgauuuauggucuuauaacgcagagcugcucguagcucuugaaaaucagcauaccauugaccugacagauagcgagaugaacaaguuguucgaaaagacuaagaaacagcuacgggagaaugccgaagacaugggaaacggcugcuuuaagauauaccacaagugugauaaugcuugcaucgggucaauucgaaacggaaccuaugaccauaauguguaccgcgaugaggcccugaacaauagauuccagaucaaaggugucgagcucaagaguggcuacaaagacuggauucuguggaucuccuuugcaauaagcugcuuccuucuguguguggccuugcucggguuuaucaugugggcuugccaaaagggaaacauuagguguaauaucugcauuuga

SEQ ID NO: 132665 - RNA, 1701 nt, Artificial Sequence; identical to SEQ ID NO: 128871
  derived and/or modified sequence opt3 from hemagglutinin__InfluenzaA__AHC58827

SEQ ID NO: 132666 - RNA, 1701 nt, Artificial Sequence; identical to SEQ ID NO: 129798
  derived and/or modified sequence opt3 from hemagglutinin__InfluenzaA__AHC58839

SEQ ID NO: 132667 - RNA, 1701 nt, Artificial Sequence
  derived and/or modified sequence opt3 from hemagglutinin__InfluenzaA__AHC58863
augaagaccaucauugcccugagcuacauacucugccuuguguucgcucagaaacugcccggcaacgacaauuccacagcaacuuuguguuuagggcaccaugccgucucuaacggaacgaucguuaagaccauuacaaaugaucaaaucgaggugacuaacgcgaccgaacugguacagucaaguagcacaggugagauuugcaauuccccucaccagauccuagacggcgaaaacuguacccucauagaugcucugcuuggggacccacagugcgauggauuucaaaauaaaaagugggaccuguucguggagagaucuaaagcccauucgaacuguuauccguacgauguccccgacuaugcaucauugaggagccucguggccaguuccggcacucuggaauuuaauaacgagucuuucaauuggacagguguuacccagaacgggacgagcuccgcuugcauccggggaucaaauaacagcuuuuucagucgccugaauuggcucacucacuuaaacuuuaaguacccugcacugaacgugaccaugccaaauaacgagcaguucgauaaacuuuauauuuggggcguccaucaccccggcacagacaaagaucagaucuuuuuguacgcccaggcuucugggcgaauuacuguguccaccaagcguucacaacaggccguaaucccuaauauaggaagcagaccaaggguucggaacauucccagucgcgugucuaucuauuggacaauugucaaaccuggugacauccugcuaaucaauuccaccggcaaccucauugcgccaagaggguacuucaagauaaggagcggaaaaucgucuaucaugcgguccgaugcaccgauuggcaaguguaauucagccugcaucacgcccaacgguaguauaccuaaugacaagccauuucagaacgugaaucgcauuacuuacggggcuuguccccgauaugugaaacaaaacacacugaaacuugccaccggaaugagaaaugucccugaaaagcagacuaggggcaucuucggcgcaaucgcuggguuuauugagaacggaugggaagguaugauggacggcugguacggguuccggcaccagaauagcgagggacguggccaagccgcggaucugaaguccacacaggccgcaaucgaccagauuaacgguaaauugaaccgccucauagggaagaccaaugagaaauuccaucagaucgaaaaggaguuuucugaaguugagggcaggauucaagaucuggaaaaguauguggaggacacgaaaaucgauuuauggagcuacaacgcugagcugcucguagcccuugaaaaucagcacaccaucgaccugacagauucagagaugaacaaguuguucgaaaagacuaagaaacagcuaagagagaaugcugaagacaugggaaacggcugcuuuaagauuuaucauaagugugauaaugccugcauagggaguauccggaacggaaccuacgaccacgauguguaucgagacgaggcacugaauaaccgcuuccagauuaaaggugucgagcucaaguccggcuacaaagacuggauccuguggauuagcuuugccaucucuugcuuccuucuguguguggcuuugcucggguuuauaaugugggcgugccaaaagggaaauaucagauguaacauuugcaucuga

SEQ ID NO: 132668 - RNA, 1701 nt, Artificial Sequence; identical to SEQ ID NO: 128871
  derived and/or modified sequence opt3 from hemagglutinin__InfluenzaA__AHC58875

SEQ ID NO: 132669 - RNA, 1701 nt, Artificial Sequence; identical to SEQ ID NO: 129798
  derived and/or modified sequence opt3 from hemagglutinin__InfluenzaA__AHC58887

SEQ ID NO: 132670 - RNA, 1701 nt, Artificial Sequence; identical to SEQ ID NO: 132634
  derived and/or modified sequence opt3 from hemagglutinin__InfluenzaA__AHC58899

SEQ ID NO: 132671 - RNA, 1701 nt, Artificial Sequence; identical to SEQ ID NO: 129798
  derived and/or modified sequence opt3 from hemagglutinin__InfluenzaA__AHC58981

SEQ ID NO: 132672 - RNA, 1701 nt, Artificial Sequence; identical to SEQ ID NO: 129798
  derived and/or modified sequence opt3 from hemagglutinin__InfluenzaA__AHC58993

SEQ ID NO: 132673 - RNA, 1701 nt, Artificial Sequence; identical to SEQ ID NO: 129798
  derived and/or modified sequence opt3 from hemagglutinin__InfluenzaA__AHC59005

SEQ ID NO: 132674 - RNA, 1701 nt, Artificial Sequence
  derived and/or modified sequence opt3 from hemagglutinin__InfluenzaA__AHC59017
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggggauccaauaacucauuuuucagucgccugaauuggcucacucacuuaaacuuuaaguacccagcacugaacgugaccaugcccaauaacgagcaguucgauaagcuguauauuuggggcguccaucacccuggcacagacaaagaucagaucuuuuuguacgcccaagcuagcgggcgaauuacugugucuaccaagcguucccagcaggccguaaucccaaauauaggaucaagacccaggguucggaacauuccuagccgcgugaguaucuauuggacaauugucaaaccaggugacauccugcuaaucaauucuaccggcaaccucauugcgccgagaggguacuucaagauaagguccggaaaaagcucgaucaugcggucugaugcacccauuggcaaguguaauuccgccugcaucacgccuaacgguucaauaccaaaugacaagcccuuucagaacgugaaucgcauuacuuacggggcuuguccucgauaugugaaacaaaacacacugaaacuugccaccggaaugagaaaugucccagaaaaacagacuaggggcaucuucggcgcaaucgcuggguuuauugagaacggaugggaagguaugguugacggcugguacggguuccggcaccagaauagugagggacguggccaagccgcggaucuuaagagcacacaggccgcaaucgaccagauuaacgguaaauugaaccgccucauagggaagaccaaugagaaauuccaucagaucgaaaaggaguuuuccgaaguggagggcaggauucaagaucuggaaaaguauguagaggacacgaaaaucgauuuauggucuuacaacgcugagcugcucguggcccuugaaaaucagcacaccaucgaccugacagauagcgagaugucaaaguuguucgaaaagacuaagaaacagcuaagagagaacgcugaagacaugggaaauggcugcuuuaagauuuaucauaagugugauaacgccugcauagggaguauccggaauggaaccuacgaccacgaugucuaucgagacgaggcacugaacaaucgcuuccagauuaaagguguggagcucaaguccggcuacaaagacuggauccuguggauuagcuuugccaucucuugcuuccuucuguguguugcuuugcucggguuuauaaugugggcgugccaaaagggaaacaucagauguaauauuugcaucuga

SEQ ID NO: 132675 - RNA, 1701 nt, Artificial Sequence; identical to SEQ ID NO: 132634
  derived and/or modified sequence opt3 from hemagglutinin__InfluenzaA__AHC59029

SEQ ID NO: 132676 - RNA, 1701 nt, Artificial Sequence; identical to SEQ ID NO: 128998
  derived and/or modified sequence opt3 from hemagglutinin__InfluenzaA__AHC59041

SEQ ID NO: 132677 - RNA, 1701 nt, Artificial Sequence
  derived and/or modified sequence opt3 from hemagglutinin__InfluenzaA__AHC59053
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcugccggccguauuacugugagcaccaagagaucucagcaggcgguaaucccaaauauaggguccaggccccggguucgcaacauuccuucaagagugagcaucuauuggacaauugucaaaccaggagacauccugcuaaucaauaguaccgguaaccucauugcaccgaggggcuacuucaagauacagucugggaaauccagcaucaugcggucggaugcccccauuggaaaguguaauucugcuugcaucacgccuaacggcuccauaccaaaugacaagcccuuucaaaacgugaaucgcauuacuuacggugccuguccucgauaugugaaacagaacacacugaaacuugcaaccgggaugagaaaugucccagaaaagcagacuaggggaaucuucggcgcuaucgccggcuuuauugagaacgggugggaaggaaugguugacgguugguacggcuuccggcaccaaaauucagaggggcguggacaggcggccgaucugaagaguacacaggcagcuaucgaccagauuaacggcaaauugaaccgccucauagguaagaccaaugagaaauuccaucaaaucgaaaaggaguuuagcgaaguggaggggaggauucaggaucuggaaaaguauguagaggacacgaaaaucgauuuaugguccuacaacgccgagcugcucguggcucuugaaaaucagcacaccaucgaccugacagauucugagaugaacaaguuguucgaaaagacuaagaaacagcuaagagagaaugccgaagacaugggcaacggaugcuuuaagauuuaucauaagugugauaaugcaugcauaggcagcauccggaacgggaccuacgaccacgaugucuaucgagacgaggcccugaauaaccgcuuccaaauuaaaggaguggagcucaagucagguuacaaagacuggauccuguggauuaguuuugcuaucuccugcuuccuucuguguguugcguugcucggcuuuauaauguggacaugccagaaggggaauaucagauguaacauuugcaucuga

SEQ ID NO: 132678 - RNA, 1701 nt, Artificial Sequence
  derived and/or modified sequence opt3 from hemagglutinin__InfluenzaA__AHC59077
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcgaaaacuguacccucauagacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcauccggcgcagcaauaacuccuuuuucucacgacugaauuggcucacucauuuaaacuuuaaguauccagcacugaacgugaccaugcccaauaacgagcaguucgacaaacuuuacauuuggggaguccaccauccuggcacagauaaggaccagaucuuuuuguaugcccaagcuaguggccguauuacugugagcaccaagagaucucagcaggccguaaucccaaauauaggguccaggccccggguucgcaacauuccuucaagaaucagcauuuacuggacaaucgugaaaccaggagauauccugcuaauuaauaguaccgguaaccucauagcgccgaggggcuacuucaagauccggucugggaaauccagcauuaugcgcucggacgcacccaucggaaaguguaauucugaaugcauaacgccuaacggcuccauuccaaaugacaagcccuuucagaacgucaaucgaaucacuuauggugccuguccuagauacgugaaacaaaacacacugaaacuugcuaccgggaugaggaaugugccagagaagcagacucggggaaucuucggcgccauugcaggcuuuaucgaaaacgggugggagggaauggucgaugguugguauggcuuccgucaccaaaauucagaggggcgcggacaggcugccgaccugaagaguacacaggcggccauugaucagauaaacggcaaauugaacagacucaucgguaagaccaaugaaaaauuccaccagauugagaaggaauuuagcgagguugaagggaggauccaagaccuggagaaguacguggaggauacgaaaaucgacuuaugguccuauaacgcagaacugcucguagcucuugagaaucagcauaccauugaucugacagacucugaaaugaacaaguuguucgagaaaacuaagaaacagcuacgggaaaaugccgaggauaugggcaacggaugcuuuaagauauaccacaagugugacaaugcuugcaucggcagcauucgaaacgggaccuaugaucaugacguguaccgcgacgaggcccugaauaacagauuccagaucaaaggagucgaacucaagucagguuacaaagauuggauucuguggaucaguuuugcaauauccugcuuccuucugugugugguuuugcucggcuuuaucaugugggccugccaaaaggggaauauuagguguaacaucugcauuuga

SEQ ID NO: 132679 - RNA, 1701 nt, Artificial Sequence; identical to SEQ ID NO: 131090
  derived and/or modified sequence opt3 from hemagglutinin__InfluenzaA__AHC59089

SEQ ID NO: 132680 - RNA, 1701 nt, Artificial Sequence; identical to SEQ ID NO: 129798
  derived and/or modified sequence opt3 from hemagglutinin__InfluenzaA__AHC59101

SEQ ID NO: 132681 - RNA, 1701 nt, Artificial Sequence; identical to SEQ ID NO: 128998
  derived and/or modified sequence opt3 from hemagglutinin__InfluenzaA__AHC59113

SEQ ID NO: 132682 - RNA, 1701 nt, Artificial Sequence; identical to SEQ ID NO: 129798
  derived and/or modified sequence opt3 from hemagglutinin__InfluenzaA__AHC59125

SEQ ID NO: 132683 - RNA, 1701 nt, Artificial Sequence
  derived and/or modified sequence opt3 from hemagglutinin__InfluenzaA__AHC59137
augaagaccaucauugcccugagcuacauacucugccuuguguucgcucagaaaauccccggcaacgacaauuccacagcaacucuguguuuggggcaccaugccgucucuaacggaacgauuguuaagaccaucacaaaugaucaaauugaggugacuaacgcgaccgaauuaguacagucaaguagcacaggugagaucugcaauuccccucaccagauacuggacggcgaaaacuguacccuaaucgaugcucuccugggggacccacagugcgauggauuucaaaauaaaaagugggaccuuuucguggagagaucuaaagcccauucgaacuguuauccguacgauguccccgacuaugcaucacugaggagcuugguggccaguuccggcacucucgaauuuaauaacgagucuuucaauuggacagguguuacccagaacgggacgagcuccgcuugcauucggggaucaaauaacagcuuuuucagucgccugaauuggcugacucaccucaacuuuaaguacccugcauuaaacgugaccaugccaaauaacgagcaguucgauaagcuguauaucuggggcguccaucaccccggcacagacaaagaucagauuuuucuuuacgcccaggcuucugggcgaaucacuguguccaccaagcguucacaacaggccguaauaccuaauauuggaagcagaccaaggguucggaacauccccagucgcgugucuauuuauuggacaaucgucaaaccuggugacaucuugcugauuaauuccaccggcaaccuaauagcgccaagaggguacuucaagaucaggagcggaaaaucgucuauuaugcgguccgaugcaccgaucggcaaguguaauucagccugcauaacgcccaacgguaguauuccuaaugacaagccauuucagaacgugaaucgcaucacuuacggggcuuguccccgauaugugaaacaaaacacacucaagcuggccaccggaaugagaaaugucccugaaaaacagacuaggggcaucuucggcgcaauugcuggguuuaucgagaacggaugggaagguaugauggacggcugguacggguuccggcaccagaauagcgagggacguggccaagccgcggaucuuaaguccacacaggccgcaauugaccagauaaacgguaaacugaaccgcuugaucgggaagaccaaugagaaauuccaucagauugaaaaggaguuuucugaaguugagggcagaauccaagaucucgaaaaguauguggaggacacgaaaaucgaucuguggagcuacaacgcugaguuacugguagcccucgaaaaucagcacaccauugaccuuacagauucagagaugaacaagcuguucgagaaaacuaagaaacaguugagggaaaaugcugaagacaugggaaacggcugcuuuaagauauaucauaagugugauaaugccugcaucgggaguauucggaacggaaccuacgaccacgauguguaucgagacgaggcacuaaauaaccgcuuccagaucaaaggugucgagcugaaguccggcuacaaagacuggauucucuggaucagcuuugccauaucuugcuuccugcuuuguguggcucuguugggguuuaucaugugggcgugccaaaagggaaauauuagauguaacaucugcauuuga

SEQ ID NO: 132684 - RNA, 1701 nt, Artificial Sequence; identical to SEQ ID NO: 128998
  derived and/or modified sequence opt3 from hemagglutinin__InfluenzaA__AHC59149

SEQ ID NO: 132685 - RNA, 1701 nt, Artificial Sequence
  derived and/or modified sequence opt3 from hemagglutinin__InfluenzaA__AHC59185
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacucaaguuucuuuagccgacugaauuggcucacucauuuaaacuuuaaguauccagcacugaaugugaccaugcccaacaacgagcaguucgacaagcuguacauuuggggaguccaccauccuggcacagauaaagaccagaucuuuuuguaugcccaaucuuccggccguauuacugugucaaccaagagaagccagcaggcuguaaucccaaauauagggaguaggccccggauucgcaacaucccuucuagaauuuccaucuacuggacaaucguuaaaccaggagauauucugcuaauaaauagcaccgguaaccucaucgccccgaggggcuacuucaagauucggucggggaaaucuuccaucaugcgcucagacgcgcccauaggaaaguguaauagugaaugcauuacgccuaacggcagcaucccaaaugacaagcccuuucagaacgugaaucgaaucacuuauggugcauguccuagauacgucaaacaauccacacugaaacuugccaccgggaugaggaacgugccagagaagcagacucggggaauuuucggcgcuaucgccggcuuuauugaaaaugggugggagggaaugguggaugguugguauggcuuccgucaccagaacucugaggggcgcggacaagcagcugaccuuaagagcacacaggccgcgauagaucagaucaauggcaaauugaacagacucauugguaagaccaaugaaaaauuccaccagaucgagaaggaauuuucagaggucgaagggaggauccaagaccuggagaaguacguugaggauacgaaaauugacuuauggaguuauaacgccgaacugcucguggcacuugagaaccagcauaccauagaucugacagacuccgaaaugaauaaguuguucgagaaaacuaagaaacagcuacgggaaaacgcugaggauaugggcaauggaugcuuuaagaucuaccacaagugugacaacgccugcauuggcagcauccgaaaugggaccuaugaucauaacguauaccgcgacgaggcucugaauaacagauuccagauuaaaggaguggaacucaagucugguuacaaagacuggauccuguggauaucauuugccaucaguugcuuccuucugugugucgcauugcucggcuuuauuaugugggccugccaaaaggggaauaucagguguaacauuugcaucuga

SEQ ID NO: 132686 - RNA, 1701 nt, Artificial Sequence; identical to SEQ ID NO: 128871
  derived and/or modified sequence opt3 from hemagglutinin__InfluenzaA__AHC59197

SEQ ID NO: 132687 - RNA, 1701 nt, Artificial Sequence
  derived and/or modified sequence opt3 from hemagglutinin__InfluenzaA__AHC59209
augaagaccaucauugcccugagcuacauacucugccuuguguucgcucaggagauccccggcaacgacaauuccacagcaacucuguguuuggggcaccaugccgucccuaacggaacgauuguuaaaaccaucacaaaugaucaaauugaagugacuaacgcgaccgaguuaguacagucuucaaguacaggugaaaucugcaauagcccacaccagauacuggacggcgagaacuguacccuaaucgaugcucuccugggggacccgcagugcgaugacuuucaaaauaagaaaugggaucuuuucguggaaagauccaaggcccauucuaacuguuaucccuacgacgucccugauuaugcaucgcugaggucauugguggccagcaguggaacucucgaguuuaauaacgaguccuucaauuggacaggcguuacccagaacgguacgucuagcgcuugcauucggcgcuccaauaacucauuuuucagucgacugaauuggcugacucaccucaacuuuaaauacccagcauuaaacgugaccaugcccaauaacgaacaguucgacaagcuguauaucuggggaguccaucacccugggacagauaaggaccagauuuuucuuuacgcccaagcuagcggccguaucacugugucuaccaaaagaucccagcaggccguaauaccaaauauuggcucaaggccccggguucgcaacaucccuagcagagugaguauuuauuggacaaucgucaagccaggggauaucuugcugauuaauucuaccggaaaccuaauagcgccgagggguuacuucaaaauccgguccggcaagagcucgauuaugcgcucugacgcacccaucggggaguguaauuccgccugcauaacgccuaacggaucaauuccaaaugacaaacccuuucagaacgugaaucgaaucacuuacggcgcuuguccuagauaugugaagcaaaacacacucaagcuggccaccgguaugaggaaugucccagaaaaacagacucgggggaucuucggagcaauugcuggcuuuaucgagaacggcugggaggggaugguugauggaugguacgguuuccgucaccagaauagugaaggccgcgggcaagccgcggaccuuaagagcacacaggccgcaauugaucagauaaacggaaaacugaacagauugaucggcaagaccaaugagaaauuccaucagauugaaaaggaguuuuccgaaguggaggguaggauccaagaccucgagaaauauguagaagauacgaagaucgaccuguggucuuacaacgcugaguuacugguggcccucgaaaaucagcacaccauugaucuuacagacagcgagaugaacaagcuguucgagaaaacuaagaaacaguugcgggaaaaugcugaggauauggggaacggcugcuuuaagauauaucauaaaugugacaaugccugcaucggaucaauucgaaacggcaccuacgaucacgcagucuaucgcgacgaagcccuaaauaacagauuccagaucaaggggguggagcugaagaguggauacaaagacuggauucucuggaucuccuuugcuauaagcugcuuccugcuuuguguugcgcuguuggguuuuaucaugugggcaugccaaaagggcaauauuagguguaacaucugcauuuga

SEQ ID NO: 132688 - RNA, 1701 nt, Artificial Sequence; identical to SEQ ID NO: 128998
  derived and/or modified sequence opt3 from hemagglutinin__InfluenzaA__AHC59221

SEQ ID NO: 132689 - RNA, 1701 nt, Artificial Sequence; identical to SEQ ID NO: 132667
  derived and/or modified sequence opt3 from hemagglutinin__InfluenzaA__AHC59245

SEQ ID NO: 132690 - RNA, 1701 nt, Artificial Sequence; identical to SEQ ID NO: 132634
  derived and/or modified sequence opt3 from hemagglutinin__InfluenzaA__AHC59257

SEQ ID NO: 132691 - RNA, 1701 nt, Artificial Sequence; identical to SEQ ID NO: 129798
  derived and/or modified sequence opt3 from hemagglutinin__InfluenzaA__AHC59269

SEQ ID NO: 132692 - RNA, 1701 nt, Artificial Sequence; identical to SEQ ID NO: 132634
  derived and/or modified sequence opt3 from hemagglutinin__InfluenzaA__AHC59281

SEQ ID NO: 132693 - RNA, 1701 nt, Artificial Sequence; identical to SEQ ID NO: 128998
  derived and/or modified sequence opt3 from hemagglutinin__InfluenzaA__AHC59293

SEQ ID NO: 132694 - RNA, 1701 nt, Artificial Sequence
  derived and/or modified sequence opt3 from hemagglutinin__InfluenzaA__AHC59305
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcagcuccccacaccagauccuagacggcgaaaauuguacccucauagaugcucugcuuggggacccgcagugcgauggauuucaaaacaaaaagugggaccuguucguggagagaucuaaagcccauucgaauuguuaucccuacgaugucccugacuaugcaucauugaggagccucguggccaguuccggcacucuggaauuuaacaaugagucuuucaacuggacagguguuacccagaaugggacgagcuccgcuugcauccggcgcucaaacaauagcuuuuucagucgacugaacuggcucacucacuuaaauuuuaaguacccagcacugaacgugaccaugcccaacaaugagcaguucgauaaacuuuauauuuggggaguccaucacccuggcacagacaaagaucagaucuuuuuguacgcccaggcuucuggccguauuacuguguccaccaagagaucacaacaggccguaaucccaaacauagggagcaggccccggguucgcaauauuccuaguagagugucuaucuauuggacaauugucaaaccaggagacauccugcuaaucaacuccaccgguaaucucauugcgccgaggggcuacuucaagauacggagcgggaaaucgucuaucaugcgcuccgaugcacccauuggaaaguguaacucagccugcaucacgccuaauggcaguauaccaaacgacaagcccuuucagaaugugaaccgaauuacuuacggugcuuguccuagauaugugaaacaaaauacacugaaacuugccaccgggaugaggaacgucccagaaaagcagacucggggaaucuucggcgcaaucgcuggcuuuauugagaaugggugggaaggaaugguugacgguugguacggcuuccgucaccagaacagcgaggggcgcggacaagccgcggaucugaaguccacacaggccgcaaucgaccagauuaauggcaaauugaacagacucauagguaagaccaacgagaaauuccaucagaucgaaaaggaguuuucugaaguggaggggaggauucaagaucuggaaaaguauguagaggacacgaaaaucgauuuauggagcuacaaugcugagcugcucguggcccuugaaaaccagcacaccaucgaccugacagauucagagaugaauaaguuguucgaaaagacuaagaaacagcuacgggagaacgcugaagacaugggcaauggaugcuuuaagauuuaucauaagugugauaacgccugcauaggcaguauccgaaaugggaccuacgaccacgaugucuaucgcgacgaggcacugaacaauagauuccagauuaaaggaguggagcucaaguccgguuacaaagacuggauccuguggauuagcuuugccaucucuugcuuccuucuguguguugcuuugcucggcuuuauaaugugggcgugccaaaaggggaacaucagguguaauauuugcaucuga

SEQ ID NO: 132695 - RNA, 1701 nt, Artificial Sequence
  derived and/or modified sequence opt3 from hemagglutinin__InfluenzaA__AHC59329
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauaacuccuuuuucucacgucugaauuggcucacgcauuuaaacuuuaaguauccagcacugaacgugacuaugcccaauaacgagcaguucgacaaacuuuacaucuggggaguccaccauccuggcaccgaaaaagaucagaucuuuuuguaugcccagaguagcggcagaauuacagugucuacuaagaggucccaacaggcuguaauaccaaauauugggucacggccccgcaucagaaacauuccuagcaggaucaguaucuacuggaccauuguuaaaccaggagacauacugcuaaucaauucuacagguaaccucauugccccgcggggcuacuucaagauccgcuccgggaaaagcucgauaaugcgaucugaugcgcccauuggaaaguguaaguccgagugcaucaccccuaauggcucaaucccaaacgacaaacccuuucagaaugugaacagaauuacguauggugcauguccuagguacgucaagcagaguacucugaaacuugccacagggaugcggaaugugccagaaaagcaaacccguggaaucuucggcgcuauugccggcuuuauagagaacgggugggagggaaugguggacgguugguauggcuuccgccaccagaauagcgaagggagaggacaggcagcugaucugaaauccacucaagccgcgaucgaccagauuaacggcaaguugaauaggcucaucgguaaaacaaacgagaaguuccaccagaucgaaaaggaguuuucugaagucgaggggcggauucaggaucuggagaaauacguugaagacaccaagauagauuuauggagcuauaacgccgagcugcucguggcacuugaaaaucaacauacgaucgaccugaccgauucagagaugaacaaauuguucgaaaagacaaagaagcagcuacgagagaaugcugaggacaugggcaacggaugcuuuaagauuuaccacaaaugugauaaugccugcaucggcaguauucgcaacgggacuuaugaccaugauguauacagagacgaagcucugaauaacagguuccagaucaagggaguggagcucaaauccgguuacaaggacuggauacuguggaucagcuuugccauuucuugcuuccuucugugugucgcauugcucggcuuuaucaugugggccugccagaaagggaauauucgguguaacaucugcauauga

SEQ ID NO: 132696 - RNA, 1701 nt, Artificial Sequence; identical to SEQ ID NO: 131090
  derived and/or modified sequence opt3 from hemagglutinin__InfluenzaA__AHC59341

SEQ ID NO: 132697 - RNA, 1701 nt, Artificial Sequence; identical to SEQ ID NO: 132634
  derived and/or modified sequence opt3 from hemagglutinin__InfluenzaA__AHC59365

SEQ ID NO: 132698 - RNA, 1701 nt, Artificial Sequence
  derived and/or modified sequence opt3 from hemagglutinin__InfluenzaA__AHC59377
augaagaccaucauugcccugagcuacauacucugccuuguguucgcucagaaacugcccggcaacgacaauuccacagcaacuuuguguuuagggcaccaugccgucccuaacggaacgguugugaagaccaucacaaaugaucaaauugagguaacuaacgcgaccgaacuggugcaaaauucuucaacaggugagaucugcgacaguccacaccagauucuagauggcgaaaacuguacccucaucgacgcucugcuuggggauccgcagugcgacggauuucagaauaaaaagugggaucuguucgucgagagaagcaaagccuauuccaacuguuaccccuaugacgugccugauuacgcaucuuugaggucgcucguugccucaagcggcacucuggaauuuaauaacgagaguuucaauuggacaggugugacccagaacgggacguccucugcuugcauacggcgcagcaauaacuccuuuuucucacgacugaauuggcucacucauuuaaacuuuaaguauccagcacugaacgucaccaugcccaauaacgagcaguucgacaaguuguacaucuggggagugcaccauccuggcacagauaaagaccagauuuuucuuuaugcccaagcuaguggccguaucacuguaagcaccaagagaucucagcaggccguuauuccaaauaucggguccaggccccgggugcgcaacauaccuucaagaauuagcaucuacuggacaauugucaaaccaggagauauccugcuaaucaauaguaccgguaaccucauugcgccgaggggcuacuucaagauacggucugggaaauccagcaucaugcgcucggacgcacccauuggaaaguguaauucugaaugcaucacgccuaacggcuccauaccaaaugacaagcccuuucagaacgugaaucgaauuacuuauggugccuguccuagauacgugaaacaaaacacacugaaacuugcuaccgggaugaggaaugucccagagaagcagacucggggaaucuucggcgccaucgcaggcuuuauugaaaacgggugggagggaaugguugaugguugguauggcuuccgucaccaaaauucagaggggcgcggacaggcugccgaccugaagaguacacaggcggccaucgaucagauuaacggcaaauugaacagacucauagguaagaccaaugaaaaauuccaccagaucgagaaggaauuuagcgagguggaagggaggauucaaaaccuggagaaguacguagaggacacgaaaaucgauuuaugguccuauaaugcagaacugcucguggcucuugagaaccagcauaccaucgaccugacagauucugaaaugaauaaguuguucgagaaaacuaagaaacagcuacgggaaaacgccgaggacaugggcaauggaugcuuuaagauuuaccacaagugugauaacgcuugcauaggcagcauccgaaaugggaccuaugaccaugaugucuaccgcgacgaggcccugaacaauagauuccagauuaaaggaguggaacucaagucagguuacaaagacuggauccuguggauuaguuuugcaaucuccugcuuccuucuguguguugccuugcucggcuuuauaaugugggcuugccaaaaggggaacaucagguguaauauuugcaucuga

SEQ ID NO: 132699 - RNA, 1701 nt, Artificial Sequence; identical to SEQ ID NO: 128998
  derived and/or modified sequence opt3 from hemagglutinin__InfluenzaA__AHC59413

SEQ ID NO: 132700 - RNA, 1701 nt, Artificial Sequence; identical to SEQ ID NO: 129798
  derived and/or modified sequence opt3 from hemagglutinin__InfluenzaA__AHC59425

SEQ ID NO: 132701 - RNA, 1701 nt, Artificial Sequence; identical to SEQ ID NO: 131090
  derived and/or modified sequence opt3 from hemagglutinin__InfluenzaA__AHC59437

SEQ ID NO: 132702 - RNA, 1701 nt, Artificial Sequence
  derived and/or modified sequence opt3 from hemagglutinin__InfluenzaA__AHC59449
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggggauccaauaacucauuuuucagucgccugaauuggcucacucacuuaaacuuuaaguacccagcacugaacgugaccaugcccaauaacgagcaguucgauaagcuguauauuuggggcguccaucacccuggcacagacaaagaucagaucuuuuuguacgcccaagcuagcgggcgaauuacugugucuaccaagcguucccagcaggccguaaucccaaauauaggaucaagacccaggguucggaacauuccuagccgcgugaguaucuauuggacaauugucaaaccaggugacauccugcuaaucaauucuaccggcaaccucauugcgccgagaggguacuucaagauaagguccggaaaaagcucgaucaugcggucugaugcacccauuggcaaguguaauuccgccugcaucacgccuaacgguucaauaccaaaugacaagcccuuucagaacgugaaucgcauuacuuacggggcuuguccucgauaugugaaacaaaacacacugaaacuugccaccggaaugagaaaugucccagaaaagcagacuaggggcaucuucggcgcaaucgcuggguuuauugagaacggaugggaagguaugguugacggcugguacggguuccggcaccagaauagugagggacguggccaagccgcggaucuuaagagcacacaggccgcaaucgaccagauuaacgguaaauugaaccgccucauagggagaaccaaugagaaguuccaucagaucgaaaaagaguuuuccgaaguggagggcaggauucaagaucuggaaaaguauguagaggacacgaagaucgauuuauggucuuacaacgcugagcugcucguggcccuugaaaaucagcacaccaucgaccugacagauagcgagaugaacaaauuguucgaaaagacuaaaaagcagcuacgggagaaugcugaagacaugggaaacggcugcuuuaaaauuuaucauaagugugauaaugccugcauagggucaauccgaaacggaaccuacgaccacgaugucuaucgcgacgaggcacugaauaacagauuccagauuaaggguguggagcucaaaaguggcuacaaggacuggauccuguggauuuccuuugccaucagcugcuuccuucuguguguugcuuugcucggguuuauaaugugggcgugccaaaaaggaaauaucagguguaacauuugcaucuga

SEQ ID NO: 132703 - RNA, 1701 nt, Artificial Sequence; identical to SEQ ID NO: 128871
  derived and/or modified sequence opt3 from hemagglutinin__InfluenzaA__AHC59461

SEQ ID NO: 132704 - RNA, 1701 nt, Artificial Sequence; identical to SEQ ID NO: 132695
  derived and/or modified sequence opt3 from hemagglutinin__InfluenzaA__AHC59473

SEQ ID NO: 132705 - RNA, 1701 nt, Artificial Sequence; identical to SEQ ID NO: 128998
  derived and/or modified sequence opt3 from hemagglutinin__InfluenzaA__AHC59485

SEQ ID NO: 132706 - RNA, 1701 nt, Artificial Sequence; identical to SEQ ID NO: 128998
  derived and/or modified sequence opt3 from hemagglutinin__InfluenzaA__AHC59497

SEQ ID NO: 132707 - RNA, 1701 nt, Artificial Sequence; identical to SEQ ID NO: 128871
  derived and/or modified sequence opt3 from hemagglutinin__InfluenzaA__AHC59509

SEQ ID NO: 132708 - RNA, 1701 nt, Artificial Sequence; identical to SEQ ID NO: 128871
  derived and/or modified sequence opt3 from hemagglutinin__InfluenzaA__AHC59521

SEQ ID NO: 132709 - RNA, 1701 nt, Artificial Sequence
  derived and/or modified sequence opt3 from hemagglutinin__InfluenzaA__AHC59533
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaagaaugaguccuucaacuggacagguguuacccagaaugggacgucuagcgcuugcauccggcgcuccaacaauucauuuuucagucgacugaacuggcucacucacuuaaauuuuaaguacccagcacugaacgugaccaugcccaacaaugagcaguucgauaaacuuuauauuuggggaguccaucacccuggcacagacaaggaucagaucuuuuuguacgcccaagcuagcggccguauuacugugucuaccaaaagaucccagcaggccguaaucccaaacauagggucaaggccccggguucgcaauauuccuagcagagugaguaucuauuggacaauugucaagccaggagacauccugcuaaucaacucuaccgguaaucucauugcgccgaggggcuacuucaaaauacgguccggaaagagcucgaucaugcgcucugaugcacccauugggaaguguaacuccgccugcaucacgccuaauggcucaauaccaaacgacaaacccuuucagaaugugaaccgaauuacuuacggugcuuguccuagauaugugaagcaaaauacacugaaacuugccaccgggaugaggaacgucccagaaaagcagacucggggaaucuucggcgcaaucgcuggcuuuauugagaaugggugggaaggaaugguugacgguugguacggcuuccgucaccagaacagugaggggcgcggacaagccgcggaucugaaaagcacacaggccgcaaucgaccagauuaauggcaaguugaacagacucauagguaaaaccaacgagaaguuccaucagaucgaaaaggaguuuuccgaaguggaggggaggauucaagaucuggaaaaauauguagaggacacgaagaucgauuuauggucuuacaaugcugagcugcucguggcccuugaaaaccagcacaccaucgaccugacagauagcgagaugaauaaauuguucgaaaagacuaaaaagcagcuacgggagaacgcugaagacaugggcaauggaugcuuuaagauuuaucauaaaugugauaacgccugcauaggcucaauccgaaaugggaccuacgaccacgaugucuaucgcgacgaggcacugaacaauagauuccagauuaagggaguggagcucaaaagugguuacaaggacuggauccuguggauuuccuuugccaucagcugcuuccuucuguguguugcuuugcucggcuuuauaaugugggcgugccaaaaagggaacaucagguguaauauuugcaucuga

SEQ ID NO: 132710 - RNA, 1701 nt, Artificial Sequence; identical to SEQ ID NO: 128998
  derived and/or modified sequence opt3 from hemagglutinin__InfluenzaA__AHC59545

SEQ ID NO: 132711 - RNA, 1701 nt, Artificial Sequence; identical to SEQ ID NO: 132634
  derived and/or modified sequence opt3 from hemagglutinin__InfluenzaA__AHC59557

SEQ ID NO: 132712 - RNA, 1701 nt, Artificial Sequence
  derived and/or modified sequence opt3 from hemagglutinin__InfluenzaA__AHC59569
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcgaaaacuguacccucauagacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcauccggcgcagcaauaacuccuuuuucucacgacugaauuggcucacucauuuaaacuuuaaguauccagcacugaacgugaccaugcccaauaacgagcaguucgacaaacuuuacauuuggggaguccaccauccuggcacagauaaggaccagaucuuuuuguaugcccaagcuaguggccguauuacugugagcaccaagagaucucagcaggccguaaucccaaauauaggguccaggccccggguucgcaacauuccuucaagaaucagcauuuacuggacaaucgugaaaccaggagauauccugcuaauuaauaguaccgguaaccucauagcgccgaggggcuacuucaagauccggucugggaaauccagcauuaugcgcucggacgcacccaucggaaaguguaauucugaaugcauaacgccuaacggcuccauuccaaaugacaagcccuuucagaacgucaaucgaaucacuuauggugccuguccuagauacgugaaacaaaacacacugaaacuugcuaccgggaugaggaaugugccagagaagcagacucggggaaucuucggcgccauugcaggcuuuaucgaaaacgggugggagggaaugauggaugguugguauggcuuccgucaccaaaauucagaggggcgcggacaggcugccgaccugaagaguacacaggcggccauugaucagauaaacggcaaauugaacagacucaucgguaagaccaaugaaaaauuccaccagauugagaaggaauuuagcgaggucgaagggaggauccaagaccuggagaaguacguugaggauacgaaaaucgacuuaugguccuauaacgcagaacugcucguggcucuugagaaucagcauaccauugaucugacagacucugaaaugaacaaguuguucgagaaaacuaagaaacagcuacgggaaaaugccgaggauaugggcaacggaugcuuuaagauauaccacaagugugacaaugcuugcaucggcagcauucgaaacgggaccuaugaucaugacguauaccgcgacgaggcccugaauaacagauuccagaucaaaggaguggaacucaagucagguuacaaagauuggauucuguggaucaguuuugcaauauccugcuuccuucugugugucgccuugcucggcuuuaucaugugggcuugccaaaaggggaauauuagguguaacaucugcauuuga

SEQ ID NO: 132713 - RNA, 1701 nt, Artificial Sequence; identical to SEQ ID NO: 128998
  derived and/or modified sequence opt3 from hemagglutinin__InfluenzaA__AHC59581

SEQ ID NO: 132714 - RNA, 1701 nt, Artificial Sequence; identical to SEQ ID NO: 128871
  derived and/or modified sequence opt3 from hemagglutinin__InfluenzaA__AHC59593

SEQ ID NO: 132715 - RNA, 1701 nt, Artificial Sequence; identical to SEQ ID NO: 131090
  derived and/or modified sequence opt3 from hemagglutinin__InfluenzaA__AHC59605

SEQ ID NO: 132716 - RNA, 1701 nt, Artificial Sequence; identical to SEQ ID NO: 128998
  derived and/or modified sequence opt3 from hemagglutinin__InfluenzaA__AHC59617

SEQ ID NO: 132717 - RNA, 1701 nt, Artificial Sequence; identical to SEQ ID NO: 128998
  derived and/or modified sequence opt3 from hemagglutinin__InfluenzaA__AHC59629

SEQ ID NO: 132718 - RNA, 1701 nt, Artificial Sequence; identical to SEQ ID NO: 132634
  derived and/or modified sequence opt3 from hemagglutinin__InfluenzaA__AHC59641

SEQ ID NO: 132719 - RNA, 1701 nt, Artificial Sequence
  derived and/or modified sequence opt3 from hemagglutinin__InfluenzaA__AHC59653
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaggaucagaucuuuuuguacgcccaagcuagcggccguauuacugugucuacccagagaucccagcaggccguaaucccaaauauagggucaaggccccggguucgcaacauuccuagcagagugaguaucuauuggacaauugucaagccaggagacauccugcuaaucaauucuaccgguaaccucauugcgccgaggggcuacuucaaaauacgguccggaaagagcucgaucaugcgcucugaugcacccauugggaaauguaauuccgccugcaucacgccuaacggcucaauaccaaaugacaagcccuuucaaaacgugaaucgaauuacuuacggugcuuguccuagauaugugaagcagaacacacugaaacuugccaccgggaugaggaaugucccagaaaagcagacucggggaaucuucggcgcaaucgcuggcuuuauugagaacgggugggaaggaaugguugacgguugguacggcuuccgucaccaaaauagugaggggcgcggacaggccgcggaucugaaaagcacacaggccgcaaucgaccagauuaacggcaaguugaacagacucauagguaaaaccaaugagaaguuccaucaaaucgaaaaagaguuuuccgaaguggaggggaggauucaggaucuggaaaaguauguagaggacacgaagaucgauuuauggucuuacaacgcugagcugcucguggcccuugaaaaucagcacaccaucgaccugacagauagcgagaugaacaaauuguucgaaaagacuaaaaagcagcuacgggagaaugcugaagacaugggcaacggaugcuuuaaaauuuaucauaagugugauaaugccugcauaggcucaauccgaaacgggaccuacgaccacgaugucuaucgcgacgaggcacugaauaacagauuccaaauuaagggaguggagcucaaaagugguuacaaggacuggauccuguggauuuccuuugccaucagcugcuuccuucuguguguugcuuugcucggcuuuauaaugugggcgugccagaaagggaauaucagguguaacauuugcaucuga

SEQ ID NO: 132720 - RNA, 1701 nt, Artificial Sequence; identical to SEQ ID NO: 128871
  derived and/or modified sequence opt3 from hemagglutinin__InfluenzaA__AHC59665

SEQ ID NO: 132721 - RNA, 1701 nt, Artificial Sequence; identical to SEQ ID NO: 128998
  derived and/or modified sequence opt3 from hemagglutinin__InfluenzaA__AHC59677

SEQ ID NO: 132722 - RNA, 1701 nt, Artificial Sequence; identical to SEQ ID NO: 132719
  derived and/or modified sequence opt3 from hemagglutinin__InfluenzaA__AHC59689

SEQ ID NO: 132723 - RNA, 1701 nt, Artificial Sequence; identical to SEQ ID NO: 132634
  derived and/or modified sequence opt3 from hemagglutinin__InfluenzaA__AHC59701

SEQ ID NO: 132724 - RNA, 1701 nt, Artificial Sequence; identical to SEQ ID NO: 128871
  derived and/or modified sequence opt3 from hemagglutinin__InfluenzaA__AHC59713

SEQ ID NO: 132725 - RNA, 1701 nt, Artificial Sequence; identical to SEQ ID NO: 132645
  derived and/or modified sequence opt3 from hemagglutinin__InfluenzaA__AHC59737

SEQ ID NO: 132726 - RNA, 1701 nt, Artificial Sequence; identical to SEQ ID NO: 128871
  derived and/or modified sequence opt3 from hemagglutinin__InfluenzaA__AHC59749

SEQ ID NO: 132727 - RNA, 1701 nt, Artificial Sequence; identical to SEQ ID NO: 128998
  derived and/or modified sequence opt3 from hemagglutinin__InfluenzaA__AHC59761

SEQ ID NO: 132728 - RNA, 1701 nt, Artificial Sequence; identical to SEQ ID NO: 128998
  derived and/or modified sequence opt3 from hemagglutinin__InfluenzaA__AHC59773

SEQ ID NO: 132729 - RNA, 1701 nt, Artificial Sequence; identical to SEQ ID NO: 129798
  derived and/or modified sequence opt3 from hemagglutinin__InfluenzaA__AHC59785

SEQ ID NO: 132730 - RNA, 1701 nt, Artificial Sequence; identical to SEQ ID NO: 128998
  derived and/or modified sequence opt3 from hemagglutinin__InfluenzaA__AHC59797

SEQ ID NO: 132731 - RNA, 1701 nt, Artificial Sequence; identical to SEQ ID NO: 131090
  derived and/or modified sequence opt3 from hemagglutinin__InfluenzaA__AHC59809

SEQ ID NO: 132732 - RNA, 1701 nt, Artificial Sequence
  derived and/or modified sequence opt3 from hemagglutinin__InfluenzaA__AHC59821
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcgaaaacuguacccucauagacgcucugcuuggggauccgcagugcgacggacugcagaauaaaaagugggauuuguuuguggagagaagcaaagccuauuccaacuguuaccccuaugacgucccugauuacgcaucucucaggucgcugguggccucaagcggcacucuggaguucaauaacgaaaguuuuaauuggacagguguuacccagaacgggacguccucugcuugcauccggcgcagcaauaacuccuucuuuucacgacucaauugguuaacucaucugaacuucaaguauccagcacuuaacgugaccaugcccaauaacgagcaguuugacaaguuguacauuuggggaguccaccauccuggcacagauaaagaccagaucuuccuguaugcccaagcuaguggccguauuacugugagcaccaagagaucucagcaggccguaaucccaaauauaggguccaggccccggguucgcaacauuccuucaagaaucagcauuuacuggacaaucgugaaaccaggagauauccuacucauuaauaguaccgguaaccugauagcgccgaggggcuacuuuaagauccggucugggaaauccagcauuaugcgcucggacgcacccaucggaaaguguaauucugaaugcauaacgccuaacggcuccauuccaaaugacaagcccuuccagaacgucaaucgaaucacuuauggugccuguccuagauacgugaaacaaaacacacuuaagcuggcuaccgggaugaggaaugugccagagaaacagacucggggaaucuuuggcgccauugcaggcuucaucgaaaacgggugggagggaauggucgaugguugguauggcuuucgucaccaaaauucagaggggcgcggacaggcugccgacuugaagaguacacaggcggccauugaucagauaaacggcaaacucaacagacugaucgguaagaccaaugaaaaauuccaccagauugagaaggaguucagcgaaguugaagggaggauccaagacuuagagaaguacguggaggauacgaaaaucgaccugugguccuauaacgcagaacuccuuguagcucuggagaaucagcauaccauugauuugacagacucugaaaugaacaagcuaguggagaaaacuaagaaacagcugcgggaaaaugccgaggauaugggcaacggaugcuuuaagauauaccacaagugugacaaugcuugcaucggcagcauucgaaacgggaccuaugaucaugacgucuaccgcgacgaggcccucaauaacagauuccagaucaaaggaguggaacugaagucagguuacaaagauuggauucuuuggaucaguuuugcaauauccugcuuccuguuguguguugcccuccugggcuuuaucaugugggcuugccaaaaggggaauauuagguguaacaucugcauuuga

SEQ ID NO: 132733 - RNA, 1701 nt, Artificial Sequence; identical to SEQ ID NO: 132634
  derived and/or modified sequence opt3 from hemagglutinin__InfluenzaA__AHC59833

SEQ ID NO: 132734 - RNA, 1701 nt, Artificial Sequence; identical to SEQ ID NO: 132633
  derived and/or modified sequence opt3 from hemagglutinin__InfluenzaA__AHC59845

SEQ ID NO: 132735 - RNA, 1701 nt, Artificial Sequence; identical to SEQ ID NO: 129798
  derived and/or modified sequence opt3 from hemagglutinin__InfluenzaA__AHC59857

SEQ ID NO: 132736 - RNA, 1701 nt, Artificial Sequence; identical to SEQ ID NO: 128998
  derived and/or modified sequence opt3 from hemagglutinin__InfluenzaA__AHC59869

SEQ ID NO: 132737 - RNA, 1701 nt, Artificial Sequence; identical to SEQ ID NO: 128998
  derived and/or modified sequence opt3 from hemagglutinin__InfluenzaA__AHC59881

SEQ ID NO: 132738 - RNA, 1701 nt, Artificial Sequence; identical to SEQ ID NO: 128871
  derived and/or modified sequence opt3 from hemagglutinin__InfluenzaA__AHC59892

SEQ ID NO: 132739 - RNA, 1701 nt, Artificial Sequence
  derived and/or modified sequence opt3 from hemagglutinin__InfluenzaA__AHC59904
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggggauccaauaacucauuuuucagucgccugaauuggcucacucacuuaaacuuuaaguacccagcacugaacgugaccaugcccaauaacgagcaguucgauaagcuguauauuuggggcguccaucacccuggcacagacaaagaucagaucuuuuuguacgcccaagcuagcgggcgaauuacugugucuaccaagcguucccagcaggccguaaucccaaauauaggaucaagacccaggguucggaacauuccuagccgcgugaguaucuauuggacaauugucaaaccaggugacauccugcuaaucaauucuaccggcaaccucauugcgccgagaggguacuucaagauaagguccggaaaaagcucgaucaugcggucugaugcacccauuggcaaguguaauuccgccugcaucacgccuaacgguucaauaccaaaugacaagcccuuucagaacgugaaucgcauuacuuacggggcuuguccucgauaugugaaacaaaacacacugaaacuugccaccggaaugagaaaugucccagaaaaacagacuaggggcaucuucggcgcaaucgcuggguuuauugagaacggaugggaagguaugauggacggcugguacggguuccggcaccagaauagugagggacguggccaagccgcggaucuuaagagcacacaggccgcaaucgaccagauuaacgguaaauugaaccgccucauagggaagaccaaugagaaauuccaucagaucgaaaaggaguuuuccgaaguugagggcaggauucaagaucuggaaaaguauguggaggacacgaaaaucgauuuauggucuuacaacgcugagcugcucguagcccuugaaaaucagcacaccaucgaccugacagauagcgagaugaacaaguuguucgaaaagacuaagaaacagcuaagagagaaugcugaagacaugggaaacggcugcuuuaagauuuaucauaagugugauaaugccugcauagggucaauccggaacggaaccuacgaccacgauguguaucgagacgaggcacugaauaaccgcuuccagauuaaaggugucgagcucaagaguggcuacaaagacuggauccuguggauuuccuuugccaucagcugcuuccuucuguguguggcuuugcucggguuuauaaugugggcgugccaaaagggaaauaucagauguaacauuugcaucuga

SEQ ID NO: 132740 - RNA, 1701 nt, Artificial Sequence
  derived and/or modified sequence opt3 from hemagglutinin__InfluenzaA__AHC59915
augaagaccgugaucgcccugagcuacauucucugccuugcuuucgcacagaaacugcccggcaacgacaauuccacagccacuuuguguuuagggcaccaugcggucccuaacggaacgauaguuaagaccaucacaaaugaucaaauugaggugacuaacgcuaccgaacugguacagucuucaaguacaggugagaucugcgacagcccacaccagauucuagauggcgaaaauuguacccucaucgacgcccugcuuggggauccgcagugcgacggauuucaaaacaaaaagugggaucuguucguggagagauccaaagcauauucuaauuguuaccccuaugacgucccugauuacgccucguugaggucacucguggcuagcaguggcacucuggaauuuaacaaugaguccuucaacuggacagguguuacccagaaugggacgucuagcgcaugcauacggcgcuccaacaauucauuuuucagucgacugaacuggcucacucauuuaaauuuuaaguauccagcccugaacgugaccaugcccaacaaugagcaguucgacaagcuguacaucuggggaguccaccauccuggcacagauaaagaccagauuuuucuuuaugcucaagccagcggccguaucacugugucuaccaagagaucccagcaggcgguaauuccaaacaucgggucaaggccccggguucgcaauauaccuagcagaauuaguaucuacuggacaauugugaaaccaggagauauccugcuaaucaacucuaccgguaaucucauugcaccgaggggcuacuucaagauacgguccgggaaaagcucgaucaugcgcucugacgcccccauuggaaaguguaacuccgaaugcaucacgccuaauggcucaauaccaaacgacaagcccuuucagaaugucaaccgaauuacuuauggugcuuguccuagauacgugaaacaaaauacacugaaguuggccaccgggaugaggaacgugccagagaaacagacucggggaaucuucggcgcaaucgcuggcuuuauugaaaaugggugggagggaauggucgaugguugguauggcuuccgucaccagaacagugaggggcgcggacaagccgcggaccuuaagagcacacaggccgcaaucgaucagauuaauggcaaauugaacagacucauagguaagaccaacgaaaaauuccaccagaucgagaaggaauuuuccgagguugaagggaggauucaagaccuggagaaguacguggaggauacgaaaaucgacuuauggucuuauaaugcugaacugcucguagcccuugagaaccagcauaccaucgaucugacagacagcgaaaugaauaaguuguucgagaaaacuaagaaacagcuacgggaaaacgcugaggauaugggcaauggaugcuuuaagauuuaccacaagugugacaacgccugcauaggcucaauccgaaaugggaccuaugaucaugacguguaccgcgacgaggcacugaacaauagauuccagauuaaaggagucgaacucaagagugguuacaaagauuggauccuguggauuuccuuugccaucagcugcuuccuucuguguguggcuuugcucggcuuuauaaugugggcgugccaaaaggggaacaucagguguaauauuugcaucuga

SEQ ID NO: 132741 - RNA, 1701 nt, Artificial Sequence; identical to SEQ ID NO: 128998
  derived and/or modified sequence opt3 from hemagglutinin__InfluenzaA__AHC59939

SEQ ID NO: 132742 - RNA, 1701 nt, Artificial Sequence
  derived and/or modified sequence opt3 from hemagglutinin__InfluenzaA__AHC59963
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacucaaguuucuuuagccgacugaauuggcucacucauuuaaacuuuaaguauccagcacugaaugugaccaugcccaacaacgagcaguucgacaagcuguacauuuggggaguccaccauccuggcacagauaaagaccagaucuuuuuguaugcccaaucuuccggccguauuacugugucaaccaagagaagccagcaggcuguaaucccaaauauagggaguaggccccggauucgcaacaucccuucuagaauuuccaucuacuggacaaucguuaaaccaggagauauucugcuaauaaauagcaccgguaaccucaucgccccgaggggcuacuucaagauucggucggggaaaucuuccaucaugcgcucagacgcgcccauaggaaaguguaauagugaaugcauuacgccuaacggcagcaucccaaaugacaagcccuuucagaacgugaaucgaaucacuuauggugcauguccuagauacauuaaacaauccacacugaaacuugccaccgggaugaggaacgucccagagaagcagacucggggaaucuucggcgcuauugccggcuuuauagaaaaugggugggagggaaugguggaugguugguauggcuuccgucaccagaacucugaggggcgcggacaagcagcugaccuuaagagcacacaggccgcgaucgaucagauuaauggcaaauugaacagacucaucgguaagaccaaugaaaaauuccaccagaucgagaaggaauuuucagagguggaagggaggauucaagaccuggagaaguacgucgaggauacgaaaauagacuuauggaguuauaacgccgaacugcucguugcacuugagaaccagcauaccaucgaucugacagacuccgaaaugaauaaguuguucgagaaaacuaagaaacagcuacgggaaaacgcugaggauaugggcaauggaugcuuuaagauuuaccacaagugugacaacgccugcaucggcagcauucgaaaugggaccuauaaccaugauguguaccgcgacgaggcucugaauaacagauuccagaucaaaggaguagaacucaagucugguuacaaagacuggauacuguggaucucauuugccauuaguugcuuccuucuguguguggcauugcucggcuuuaucaugugggccugccaaaaggggaauauuagguguaacaucugcauauga

SEQ ID NO: 132743 - RNA, 1701 nt, Artificial Sequence; identical to SEQ ID NO: 128871
  derived and/or modified sequence opt3 from hemagglutinin__InfluenzaA__AHC59987

SEQ ID NO: 132744 - RNA, 1701 nt, Artificial Sequence; identical to SEQ ID NO: 128871
  derived and/or modified sequence opt3 from hemagglutinin__InfluenzaA__AHC59999

SEQ ID NO: 132745 - RNA, 1701 nt, Artificial Sequence; identical to SEQ ID NO: 128998
  derived and/or modified sequence opt3 from hemagglutinin__InfluenzaA__AHC60011

SEQ ID NO: 132746 - RNA, 1701 nt, Artificial Sequence; identical to SEQ ID NO: 128871
  derived and/or modified sequence opt3 from hemagglutinin__InfluenzaA__AHC60023

SEQ ID NO: 132747 - RNA, 1701 nt, Artificial Sequence; identical to SEQ ID NO: 129798
  derived and/or modified sequence opt3 from hemagglutinin__InfluenzaA__AHC60035

SEQ ID NO: 132748 - RNA, 1701 nt, Artificial Sequence; identical to SEQ ID NO: 129798
  derived and/or modified sequence opt3 from hemagglutinin__InfluenzaA__AHC60047

SEQ ID NO: 132749 - RNA, 1701 nt, Artificial Sequence
  derived and/or modified sequence opt3 from hemagglutinin__InfluenzaA__AHC60059
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcgaaaacuguacccucauagacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcauccggcgcagcaauaacuccuuuuucucacgacugaauuggcucacucauuuaaacuuuaaguauccagcacugaacgugaccaugcccaauaacgagcaguucgacaaacuuuacauuuggggaguccaccauccuggcacagauaaagaccagaucuuuuuguaugcccaagcuaguggccguauuacugugagcaccaagagaucucagcaggccguaaucccaaauauaggguccaggccccggguucgcaacauuccuucaagaaucagcauuuacuggacaaucgugaaaccaggagauauccugcuaauuaauaguaccgguaaccucauagcgccgaggggcuacuucaagauccggucugggaaauccagcauuaugcgcucggacgcacccaucggaaaguguaauucugccugcauaacgccuaacggcuccauuccaaaugacaagcccuuucagaacgucaaucgaaucacuuauggugcuuguccuagauacgugaaacaaaacacacugaaacuugccaccgggaugaggaaugugccagaaaagcagacucggggaaucuucggcgcaauugcuggcuuuaucgagaacgggugggaaggaauggucgaugguugguauggcuuccgucaccaaaauucagaggggcgcggacaggccgcggaccugaagaguacacaggccgcaauugaucagauaaacggcaaauugaacagacucaucgguaagaccaaugagaaauuccaccagauugaaaaggaguuuagcgaaguugaggggaggauccaagaccuggaaaaguacguggaggauacgaaaaucgacuuaugguccuauaacgcugagcugcucguagcccuugaaaaucagcauaccauugaucugacagacucugagaugaacaaguuguucgaaaagacuaagaaacagcuacgggagaaugcugaagauaugggcaacggaugcuuuaagauauaccacaagugugacaaugccugcaucggcagcauucgaaacgggaccuauaaucaugauguguaccgcgacgaggcacugaacaauagauuccagaucaaaggagucgagcucaagucagguuacaaagacuggauucuguggaucaguuuugccauauccugcuuccuucuguguguggcuuugcucggcuuuaucaugugggcgugccaaaaggggaacauuagguguaauaucugcauuuga

SEQ ID NO: 132750 - RNA, 1701 nt, Artificial Sequence; identical to SEQ ID NO: 131090
  derived and/or modified sequence opt3 from hemagglutinin__InfluenzaA__AHC60071

SEQ ID NO: 132751 - RNA, 1701 nt, Artificial Sequence; identical to SEQ ID NO: 132634
  derived and/or modified sequence opt3 from hemagglutinin__InfluenzaA__AHC60083

SEQ ID NO: 132752 - RNA, 1701 nt, Artificial Sequence; identical to SEQ ID NO: 129798
  derived and/or modified sequence opt3 from hemagglutinin__InfluenzaA__AHC60095

SEQ ID NO: 132753 - RNA, 1701 nt, Artificial Sequence
  derived and/or modified sequence opt3 from hemagglutinin__InfluenzaA__AHC60107
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagaucauagauggcgaaaacuguacccuaaucgacgcucuccugggggauccgcagugcgacggauuucagaauaaaaagugggaucuuuucguggagagaagcaaagccuauuccaacuguuaccccuaugacgucccugauuacgcaucucugaggucguugguggccucaagcggcacucucgaauuuaauaacgagaguuucaauuggacagguguuacccagaacgggacguccucugcuugcauucggcgcagcaauaacuccuuuuucucacgacugaauuggcugacucaucucaacuuuaaguauccagcauuaaacgugaccaugcccaauaacgagcaguucgacaagcuguacaucuggggaguccaccauccuggcacagauaaagaccagauuuuucuuuaugcccaagcuaguggccguaucacugugagcaccaagagaucucagcaggccguaauaccaaauauuggguccaggccccggguucgcaacaucccuucaagaauuagcaucuacuggacaaucgugaaaccaggagauauuuugcugauaaauaguaccgguaaccuaaucgcgccgaggggcuacuucaagauucggucugggaaauccagcaucaugcgcucggacgcacccauaggaaaguguaauucugaaugcauuacgccuaacggcuccaucccaaaugacaagcccuuucagaacgucaaucgaaucacuuauggugccuguccuagauacgugaaacaaaacacacucaagcuggcuaccgggaugaggaaugugccagagaaacagacucggggaauuuucggcgccaucgcaggcuuuauugaaaacgggugggagggaauggucgaugguugguauggcuuccgucaccaaaauucagaggggcgcggacaggcugccgaccuuaagaguacacaggcggccauagaucagaucaacggcaaacugaacagauugauugguaagaccaaugaaaaauuccaccagaucgagaaggaauuuagcgagguugaagggaggauccaagaccucgagaaguacguggaggauacgaaaauugaccugugguccuauaacgcagaauuacugguagcucucgagaaucagcauaccauagaucuuacagacucugaaaugaacaagcuguucgagaaaacuaagaaacaguugcgggaaaaugccgaggauaugggcaacggaugcuuuaagaucuaccacaagugugacaaugcuugcauuggcagcauccgaaacgggaccuaugaucaugacguguaccgcgacgaggcccuaaauaacagauucaaaauuaagggagucgaacugaaaucagguuacaaggauuggauccucuggauaaguuuugcaaucuccugcuuccugcuuuguguggcccuguugggcuuuauuaugugggcuugccagaaagggaauaucagguguaacauuugcaucuga

SEQ ID NO: 132754 - RNA, 1701 nt, Artificial Sequence; identical to SEQ ID NO: 128998
  derived and/or modified sequence opt3 from hemagglutinin__InfluenzaA__AHC60119

SEQ ID NO: 132755 - RNA, 1701 nt, Artificial Sequence; identical to SEQ ID NO: 128998
  derived and/or modified sequence opt3 from hemagglutinin__InfluenzaA__AHC60131

SEQ ID NO: 132756 - RNA, 1701 nt, Artificial Sequence; identical to SEQ ID NO: 132664
  derived and/or modified sequence opt3 from hemagglutinin__InfluenzaA__AHC60143

SEQ ID NO: 132757 - RNA, 1701 nt, Artificial Sequence
  derived and/or modified sequence opt3 from hemagglutinin__InfluenzaA__AHC60155
augaagaccgugaucgcccugagcuacauucucugccuugcuuucgcacagaaacugcccggcaacgacaauuccacagccacuuuguguuuagggcaccaugcggucccuaacggaacgauaguuaagaccaucacaaaugaucaaauugaggugacuaacgcuaccgaacugguacagucuucaccaacaggugagaucugcgacaguccgcaccagauucuagauggcgaaaauuguacccucaucgacgcccugcuuggggauccccagugcgacggauuucaaaacaaaaagugggaucuguucguggagagaagcaaagcauauuccaauuguuacccuuaugacgucccagauuacgccucuuugaggucgcucguggcuucaagcggcacucuggaauuuaacaaugagaguuucaacuggacagguguuacccagaaugggacguccucugcaugcauacggcgcagcaacaauuccuuuuucucacgacugaacuggcucacucauuuaaauuuuaaguaucccgcccugaacgugaccaugccuaacaaugagcaguucgacaaguuguacaucuggggaguccaccauccaggcacagauaaagaccagauuuuucuuuaugcucaagccaguggccguaucacugugagcaccaagagaucucagcaggcgguaauucccaacaucggguccaggccucggguucgcaauauaccaucaagaauuagcaucuacuggacaauugugaaaccgggagauauccugcuaaucaacaguaccgguaaucucauugcacccaggggcuacuucaagauacggucugggaaauccagcaucaugcgcucggacgccccuauuggaaaguguaacucugaaugcaucacgccaaauggcuccauacccaacgacaagccuuuucagaaugucaaccgaauuacuuauggugcuuguccaagauacgugaaacaaaauacacugaaacuugccaccgggaugaggaacgugcccgagaagcagacucggggaaucuucggcgcaaucgcuggcuuuauugaaaaugggugggagggaauggucgaugguugguauggcuuccgucaccagaacucagaggggcgcggacaagccgcggaccugaagaguacacaggccgcaaucgaucagauuaauggcaaauugaacagacucauagguaagaccaacgaaaaauuccaccagaucgagaaggaauuuagcgagguugaagggaggauucaagaccuggagaaguacguggaggauacgaaaaucgacuuaugguccuauaaugcugaacugcucguagcccuugagaaccagcauaccaucgaucugacagacucugaaaugaauaaguuguucgagaaaacuaagaaacagcuacgggaaaacgcugaggauaugggcaauggaugcuuuaagauuuaccacaagugugacaacgccugcauaggcagcauccgaaaugggaccuaugaucaugacguguaccgcgacgaggcacugaacaauagauuccagauuaaaggagucgaacucaagucagguuacaaagauuggauccuguggauuaguuuugccaucuccugcuuccuucuguguguggcuuugcucggcuuuauaaugugggcgugccaaaaggggaacaucagguguaauauuugcaucuga

SEQ ID NO: 132758 - RNA, 1701 nt, Artificial Sequence; identical to SEQ ID NO: 128871
  derived and/or modified sequence opt3 from hemagglutinin__InfluenzaA__AHC60167

SEQ ID NO: 132759 - RNA, 1701 nt, Artificial Sequence; identical to SEQ ID NO: 129798
  derived and/or modified sequence opt3 from hemagglutinin__InfluenzaA__AHC60179

SEQ ID NO: 132760 - RNA, 1701 nt, Artificial Sequence; identical to SEQ ID NO: 132709
  derived and/or modified sequence opt3 from hemagglutinin__InfluenzaA__AHC60191

SEQ ID NO: 132761 - RNA, 1701 nt, Artificial Sequence; identical to SEQ ID NO: 132709
  derived and/or modified sequence opt3 from hemagglutinin__InfluenzaA__AHC60203

SEQ ID NO: 132762 - RNA, 1701 nt, Artificial Sequence; identical to SEQ ID NO: 131090
  derived and/or modified sequence opt3 from hemagglutinin__InfluenzaA__AHC60215

SEQ ID NO: 132763 - RNA, 1701 nt, Artificial Sequence; identical to SEQ ID NO: 129798
  derived and/or modified sequence opt3 from hemagglutinin__InfluenzaA__AHC60239

SEQ ID NO: 132764 - RNA, 1701 nt, Artificial Sequence; identical to SEQ ID NO: 129798
  derived and/or modified sequence opt3 from hemagglutinin__InfluenzaA__AHC60251

SEQ ID NO: 132765 - RNA, 1701 nt, Artificial Sequence
  derived and/or modified sequence opt3 from hemagglutinin__InfluenzaA__AHC60263
augaagaccaucauugcccugagcuacauacucugccuuguguucgcucagaaacugcccggcaacgaaaauuccacagcaacuuuguguuuagggcaccaugccgucccuaacggaacgaucguuaagaccauuacaaaugaccaaaucgaagugacuaacgcgaccgagcugguacaaaauucuucaacaggugaaauuugcgauaguccacaccagauccuagacggcgagaacuguacccucauagaugcucugcuuggggacccgcagugcgauggauuucagaauaaaaagugggaccuguucguggaaagaagcaaagccuauuccaacuguuaccccuaugaugucccugacuacgcaucuuugaggucgcucguggccucaagcggcacucuggaguuuaauaacgagaguuucaauuggacagguguuacccagaacgggacguccucugcuugcauccggcgcagcaauaacuccuuuuucucacgacugaauuggcucacucauuuaaacuuuaaguauccagcacugaacgugaccaugcccaauaacgaacaguucgauaaacuuuacauuuggggaguccaccauccuggcacagacaaggaucagaucuuuuuguaugcccaagcuaguggccguauuacugugagcaccaagagaucucagcaggccguaaucccaaauauaggguccaggccccggguucgcaacauuccuucaagaaucagcauuuacuggacaaucgugaaaccaggagacauccugcuaauuaauaguaccgguaaccucauagcgccgaggggcuacuucaagauccggucugggaaauccagcauuaugcgcucggaugcacccaucggaaaguguaauucugagugcauaacgccuaacggcuccauuccaaaugacaagcccuuucagaacgucaaucgaaucacuuauggugccuguccuagauacgugaaacaaaacacacugaaacuugcuaccgggaugaggaaugugccagaaaagcagacucggggaaucuucggcgccauugcaggcuuuaucgagaacgggugggagggaauggucgacgguugguauggcuuccgucaccaaaauucagaagggcgcggacaggcugccgaucugaagaguacacaggcggccauugaccagauaaacggcaaauugaacagacucaucgguaagaccaaugagaaauuccaccagauugaaaaggaguuuagcgaaguugaggggaggauccaagaucuggagaaguacguggaagacacgaaaaucgauuuaugguccuauaacgcagagcugcucguagcucuugaaaaucagcauaccauugaccugacagauucugagaugaacaaguuguucgagaaaacuaagaaacagcuacgggagaaugccgaggacaugggcaacggaugcuuuaagauauaccacaagugugauaaugcuugcaucggcagcauucgaaacgggaccuaugaccaugauguguaccgcgacgaagcccugaauaacagauuccagaucaaaggagucgagcucaagucagguuacaaagacuggauucuguggaucaguuuugcaauauccugcuuccuucuguguguggccuugcucggcuuuaucaugugggcuugccaaaaggggaauauuagguguaacaucugcauuuga

SEQ ID NO: 132766 - RNA, 1701 nt, Artificial Sequence; identical to SEQ ID NO: 128871
  derived and/or modified sequence opt3 from hemagglutinin__InfluenzaA__AHC60275

SEQ ID NO: 132767 - RNA, 1701 nt, Artificial Sequence; identical to SEQ ID NO: 132753
  derived and/or modified sequence opt3 from hemagglutinin__InfluenzaA__AHC60287

SEQ ID NO: 132768 - RNA, 1701 nt, Artificial Sequence; identical to SEQ ID NO: 132634
  derived and/or modified sequence opt3 from hemagglutinin__InfluenzaA__AHC60299

SEQ ID NO: 132769 - RNA, 1701 nt, Artificial Sequence
  derived and/or modified sequence opt3 from hemagglutinin__InfluenzaA__AHC60311
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcgaaaacuguacccucauagacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacucuggaauuugacaaugagaguuucaacuggacagguguuacccagaaugggacguccucugcuugcauccggcgcagcaacaauuccuuuuucucacgacugaacuggcucacucauuuaaauuuuaaguauccagcacugaacgugaccaugcccaacaaugagcaguucgauaaacuuuacauuuggggaguccaccauccuggcacagacaaggaucagaucuuuuuguaugcccaagcuaguggccguauuacugugagcaccaagagaucucagcaggccguaaucccaaacauaggguccaggccccggguucgcaauauuccuucaagaaucagcauuuacuggacaaucgugaaaccaggagacauccugcuaauuaacaguaccgguaaucucauagcgccgaggggcuacuucaagauccggucugggaaauccagcauuaugcgcucggacgcacccaucggaaaguguaacucugaaugcauaacgccuaauggcuccauuccaaacgauaagcccuuucagaaugucaaccgaaucacuuauggugccuguccuagauacgugaaacaaaauacacugaaacuugcuaccgggaugaggaacgugccagagaagcagacucggggaaucuucggcgccauugcaggcuuuaucgaaaaugggugggagggaauggucgacgguugguauggcuuccgucaccagaacucagaggggcgcggacaagcugccgaucugaagaguacacaggcggccauugaccagauaaauggcaaauugaacagacucaucgguaagaccaacgaaaaauuccaccagauugagaaggaauuuagcgagguugaagggaggauccaagaucuggagaaguacguggaggacacgaaaaucgauuuaugguccuauaaugcagaacugcucguagcucuugagaaccagcauaccauugaccugacagauucugaaaugaauaaguuguucgagaaaacuaagaaacagcuacgggaaaacgccgaggacaugggcaauggaugcuuuaagauauaccacaagugugauaacgcuugcaucggcagcauucgaaaugggaccuaugaccaugacguguaccgcgaugaggcccugaacaauagauuccagaucaaaggagucgaacucaagucagguuacaaagacuggauucuguggaucaguuuugcaauauccugcuuccuucuguguguggccuugcucggcuuuaucaugugggcuugccaaaaggggaacauuagguguaauaucugcauuuga

SEQ ID NO: 132770 - RNA, 1701 nt, Artificial Sequence; identical to SEQ ID NO: 129798
  derived and/or modified sequence opt3 from hemagglutinin__InfluenzaA__AHC60323

SEQ ID NO: 132771 - RNA, 1701 nt, Artificial Sequence; identical to SEQ ID NO: 131090
  derived and/or modified sequence opt3 from hemagglutinin__InfluenzaA__AHC60335

SEQ ID NO: 132772 - RNA, 1701 nt, Artificial Sequence; identical to SEQ ID NO: 128871
  derived and/or modified sequence opt3 from hemagglutinin__InfluenzaA__AHC60347

SEQ ID NO: 132773 - RNA, 1701 nt, Artificial Sequence; identical to SEQ ID NO: 128998
  derived and/or modified sequence opt3 from hemagglutinin__InfluenzaA__AHC60359

SEQ ID NO: 132774 - RNA, 1701 nt, Artificial Sequence; identical to SEQ ID NO: 132695
  derived and/or modified sequence opt3 from hemagglutinin__InfluenzaA__AHC60371

SEQ ID NO: 132775 - RNA, 1701 nt, Artificial Sequence; identical to SEQ ID NO: 128871
  derived and/or modified sequence opt3 from hemagglutinin__InfluenzaA__AHC60383

SEQ ID NO: 132776 - RNA, 1701 nt, Artificial Sequence; identical to SEQ ID NO: 128998
  derived and/or modified sequence opt3 from hemagglutinin__InfluenzaA__AHC60395

SEQ ID NO: 132777 - RNA, 1701 nt, Artificial Sequence; identical to SEQ ID NO: 132709
  derived and/or modified sequence opt3 from hemagglutinin__InfluenzaA__AHC60407

SEQ ID NO: 132778 - RNA, 1701 nt, Artificial Sequence; identical to SEQ ID NO: 128871
  derived and/or modified sequence opt3 from hemagglutinin__InfluenzaA__AHC60419

SEQ ID NO: 132779 - RNA, 1701 nt, Artificial Sequence; identical to SEQ ID NO: 128998
  derived and/or modified sequence opt3 from hemagglutinin__InfluenzaA__AHC60431

SEQ ID NO: 132780 - RNA, 1701 nt, Artificial Sequence; identical to SEQ ID NO: 128871
  derived and/or modified sequence opt3 from hemagglutinin__InfluenzaA__AHC60455

SEQ ID NO: 132781 - RNA, 1701 nt, Artificial Sequence; identical to SEQ ID NO: 128871
  derived and/or modified sequence opt3 from hemagglutinin__InfluenzaA__AHC60467

SEQ ID NO: 132782 - RNA, 1701 nt, Artificial Sequence; identical to SEQ ID NO: 132633
  derived and/or modified sequence opt3 from hemagglutinin__InfluenzaA__AHC60479

SEQ ID NO: 132783 - RNA, 1701 nt, Artificial Sequence; identical to SEQ ID NO: 129798
  derived and/or modified sequence opt3 from hemagglutinin__InfluenzaA__AHC60491

SEQ ID NO: 132784 - RNA, 1701 nt, Artificial Sequence
  derived and/or modified sequence opt3 from hemagglutinin__InfluenzaA__AHC60503
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagccuauucuaacuguuaccccuaugaugucccugacuacgcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucauuuaaacuuuaaguauccagcacugaacgugaccaugcccaauaacgagcaguucgauaagcuguacauuuggggaguccaccauccuggcacagacaaagaucagaucuuuuuguaugcccaagcuagcggccguauuacugugucuaccaagagaucccagcaggccguaaucccaaauauagggucaaggccccggguucgcaacauuccuagcagaaucaguauuuacuggacaaucgugaaaccaggagacauccugcuaauuaauucuaccgguaaccucauagcgccgaggggcuacuucaagauccgguccgggaaaagcucgauuaugcgcucugaugcacccaucggaaaguguaauuccgccugcauaacgccuaacggcucaauuccaaaugacaagcccuuucagaacgucaaucgaaucacuuauggugcuuguccuagauacgugaaacaaaacacacugaaacuugccaccgggaugaggaaugugccagaaaaacagacucggggaaucuucggcgcaauugcuggcuuuaucgagaacgggugggaaggaauggucgacgguugguauggcuuccgucaccagaauagugaggggcgcggacaagccgcggaucuuaagagcacacaggccgcaauugaccagauaaacggcaaauugaacagacucaucgguaagaccaaugagaaauuccaccagauugaaaaggaguuuuccgaaguugaggggaggauccaagaucuggaaaaguacguggaggacacgaaaaucgauuuauggucuuauaacgcugagcugcucguagcccuugaaaaucagcauaccauugaccugacagauagcgagaugaacaaguuguucgaaaagacuaagaaacagcuacgggagaaugcugaagacaugggcaacggaugcuuuaagauauaccacaagugugauaaugccugcaucggcucaauucgaaacgggaccuaugaccaugauguguaccgcgacgaggcacugaauaacagauuccagaucaaaggagucgagcucaagagugguuacaaagacuggauucuguggaucuccuuugccauaagcugcuuccuucugugugugguuuugcucggcuuuaucaugugggcuugccaaaaggggaauauuagguguaacaucugcauuuga

SEQ ID NO: 132785 - RNA, 1701 nt, Artificial Sequence; identical to SEQ ID NO: 128998
  derived and/or modified sequence opt3 from hemagglutinin__InfluenzaA__AHC60515

SEQ ID NO: 132786 - RNA, 1701 nt, Artificial Sequence; identical to SEQ ID NO: 129798
  derived and/or modified sequence opt3 from hemagglutinin__InfluenzaA__AHC60527

SEQ ID NO: 132787 - RNA, 1701 nt, Artificial Sequence; identical to SEQ ID NO: 128998
  derived and/or modified sequence opt3 from hemagglutinin__InfluenzaA__AHC60539

SEQ ID NO: 132788 - RNA, 1701 nt, Artificial Sequence; identical to SEQ ID NO: 132645
  derived and/or modified sequence opt3 from hemagglutinin__InfluenzaA__AHC60551

SEQ ID NO: 132789 - RNA, 1701 nt, Artificial Sequence; identical to SEQ ID NO: 131090
  derived and/or modified sequence opt3 from hemagglutinin__InfluenzaA__AHC60563

SEQ ID NO: 132790 - RNA, 1701 nt, Artificial Sequence; identical to SEQ ID NO: 131090
  derived and/or modified sequence opt3 from hemagglutinin__InfluenzaA__AHC60575

SEQ ID NO: 132791 - RNA, 1701 nt, Artificial Sequence
  derived and/or modified sequence opt3 from hemagglutinin__InfluenzaA__AHC60587
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcgaaaacuguacccucauagacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcauccggcgcagcaauaacuccuuuuucucacgacugaauuggcucacucauuuaaacuuuaaguauccagcacugaacgugaccaugcccaauaacgagcaguucgacaaacuuuacauuuggggaguccaccauccuggcacagauaaggaccagaucuuuuuguaugcccaagcuaguggccguauuacugugagcaccaagagaucucagcaggccguaaucccaaauauaggguccaggccccggguucgcaacauuccuucaagaaucagcauuuacuggacaaucgugaaaccaggagauauccugcuaauuaauaguaccgguaaccucauagcgccgaggggcuacuucaagauccggucugggaaauccagcauuaugcgcucggacgcacccaucggaaaguguaauucugaaugcauaacgccuaacggcuccauuccaaaugacaagcccuuucagaacgucaaucgaaucacuuauggugccuguccuagauacgugaaacaaaacacacugaaacuugcuaccgggaugaggaaugugccagagaagcagacucggggaaucuucggcgccauugcaggcuuuaucgaaaacgggugggagggaauggucgaugguugguauggcuuccgucaccaaaauucagaggggcgcggacaggcugccgaccugaagaguacacaggcggccauugaucagauaaacggcaaauugaacagacucaucgguaagaccaaugaaaaauuccaccagauugagaaggaauuuagcgagguugaagggaggauccaaaaccuggagaaguacguggaggacacgaaaaucgauuuaugguccuauaaugcagaacugcucguagcucuugagaaccagcauaccauugaccugacagauucugaaaugaauaaguuguucgagaaaacuaagaaacagcuacgggaaaacgccgaggacaugggcaauggaugcuuuaagauauaccacaagugugauaacgcuugcaucggcagcauucgaaaugggaccuaugaccaugauguguaccgcgacgaggcccugaacaauagauuccagaucaaaggagucgaacucaagucagguuacaaagacuggauucuguggaucaguuuugcaauauccugcuuccuucuguguguggccuugcucggcuuuaucaugugggcuugccaaaaggggaacauuagguguaauaucugcauuuga

SEQ ID NO: 132792 - RNA, 1701 nt, Artificial Sequence; identical to SEQ ID NO: 131090
  derived and/or modified sequence opt3 from hemagglutinin__InfluenzaA__AHC60599

SEQ ID NO: 132793 - RNA, 1701 nt, Artificial Sequence; identical to SEQ ID NO: 128871
  derived and/or modified sequence opt3 from hemagglutinin__InfluenzaA__AHC60611

SEQ ID NO: 132794 - RNA, 1701 nt, Artificial Sequence
  derived and/or modified sequence opt3 from hemagglutinin__InfluenzaA__AHC60623
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacucauccuuuuucagccgacugaauuggcucacucauuuaaacuuuaaguauccagcacugaaugugaccaugcccaacaacgagcaguucgacaaacuuuacauuuggggaguccaccauccuggcacagauaaggaccagaucuuuuuguaugcccaaucuuccggccguauuacugugucaaccaagagaagccagcaggcuguaaucccaaauauagggaguaggccccggauucgcaacaucccuucuagaauuuccaucuacuggacaaucguuaaaccaggagauauucugcuaauaaauagcaccgguaaccucaucgccccgaggggcuacuucaagauucggaaugggaaaucgucuaucaugcgcuccgacgcgcccauaggaaaguguaacucagaaugcauuacgccuaauggcaguaucccaaacgacaagcccuuucagaaugugaaccgaaucacuuauggugcauguccuagauacgucaaacaaagcacacugaaacuugccaccgggaugaggaaugugccagagaagcagacucggggaauuuucggcgcuaucgccggcuuuauugaaaacgggugggagggaaugguggaugguugguauggcuuccgucaccagaauagugaggggcgcggacaagcagcugaccugaagucuacacaggccgcgauagaucagaucaacggcaaauugaauagacucauugguaagaccaacgaaaaauuccaccagaucgagaaggaauuuagcgaggucgaagggaggauccaagaccuggagaaguacguugaggauacgaaaauugacuuauggucauauaacgccgaacugcucguggcacuugagaaucagcauaccauagaucugacagacagugaaaugaacaaguuguucgagaaaacuaagaaacagcuacgggaaaaugcugaggauaugggcaacggaugcuuuaagaucuaccacaagugugacaaugccugcauuggcuccauccgaaacgggaccuauaaucaugauguauaccgcgacgaggcucugaacaauagauuccagauuaaaggaguggaacucaagagcgguuacaaagacuggauccuguggauaucuuuugccaucucaugcuuccuucugugugucgcauugcucggcuuuauuaugugggccugccaaaaggggaacaucagguguaauauuugcaucuga

SEQ ID NO: 132795 - RNA, 1701 nt, Artificial Sequence; identical to SEQ ID NO: 131090
  derived and/or modified sequence opt3 from hemagglutinin__InfluenzaA__AHC60635

SEQ ID NO: 132796 - RNA, 1701 nt, Artificial Sequence
  derived and/or modified sequence opt3 from hemagglutinin__InfluenzaA__AHC60647
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacaaaauucuucaaccggugagauuugcgacaguccacaccagauccuagauggcgaaaacuguacucucauagacgcgcugcuuggggauccgcagugcgacggauuucagaauaaaaagugggaucuguucguggagagaagcaaggcuuauuccaacuguuaccccuaugacgucccugauuacgccucuuugaggucgcucguggcaucaagcggcacacuggaauuuaauaacgagaguuucaauuggaccgguguuacgcagaacgggacuuccucugccugcauccggcgcagcaauaacuccuuuuucucacgacugaauuggcucacccauuuaaacuuuaaguauccagcucugaacgugacaaugcccaauaacgagcaguucgacaaacuuuacauuuggggaguccaccauccuggcacugauaaagaccagaucuuuuuguaugcacaagccaguggccguauuaccgugagcacaaagagaucucagcaggcuguaaucccaaauauaggguccaggccccggguucgcaacauuccuucaagaaucagcauuuacuggaccaucgugaaaccaggagauauccugcuaauuaauaguacggguaaccucauagccccgaggggcuacuucaagauccggucugggaaauccagcauuaugcgcucggacgcgcccaucggaaaguguaauucugaaugcauaacuccuaacggcuccauuccaaaugacaagcccuuucagaacgucaaucgaaucacauauggugcauguccuagauacgugaaacaaaacacccugaaacuugccacugggaugaggaaugugccagagaagcagacacggggaaucuucggcgcuauugccggcuuuaucgaaaacgggugggagggaauggucgaugguugguauggcuuccgucaccaaaauucagaggggcgcggacaggcagcugaccugaagaguacccaggccgcgauugaucagauaaacggcaaauugaacagacucaucgguaagacgaaugaaaaauuccaccagauugagaaggaauuuagcgagguugaagggaggauccaagaccuggagaaguacguggaggauaccaaaaucgacuuaugguccuauaacgccgaacugcucguagcacuugagaaucagcauacaauugaucugacugacucugaaaugaacaaguuguucgagaaaaccaagaaacagcuacgggaaaaugcugaggauaugggcaacggaugcuuuaagauauaccacaagugugacaaugccugcaucggcagcauucgaaacgggacauaugaucaugacguguaccgcgacgaggcucugaauaacagauuccagaucaaaggagucgaacucaagucagguuacaaagauuggauucuguggaucaguuuugccauauccugcuuccuucuguguguggcauugcucggcuuuaucaugugggccugccaaaaggggaauauuagguguaacaucugcauuuga

SEQ ID NO: 132797 - RNA, 1701 nt, Artificial Sequence
  derived and/or modified sequence opt3 from hemagglutinin__InfluenzaA__AHC60659
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacagucuucaaguaccggugagauuugcaauagcccacaccagauccuagacggcgaaaacuguacucucauagaugcgcugcuuggggacccgcagugcgauggauuucaaaauaaaaagugggaccuguucguggagagauccaaagcucauucuaacuguuaucccuacgaugucccugacuaugccucguugaggucacucguggcaagcaguggcacacuggaauuuaauaacgaguccuucaauuggaccgguguuacgcagaacgggacuucuagcgccugcauccggcgcuccaauaacucauuuuucagucgacugaauuggcucacccacuuaaacuuuaaguacccagcucugaacgugacaaugcccaauaacgagcaguucgauaaacuuuauauuuggggaguccaucacccuggcacugacaaagaucagaucuuuuuguacgcacaagccgcuggccguauuaccgugagcacaaagagaucucagcaggccguaaucccaaauauaggguccaggccccggguucgcaacauuccuucaagagugagcaucuauuggaccauugucaaaccaggagacauccugcuaaucaauaguacggguaaccucauugcgccgaggggcuacuucaagauacggucugggaaauccagcaucaugcgcucggaugcacccauuggaaaguguaauucugccugcaucacuccuaacggcuccauaccaaaugacaagcccuuucagaacgugaaucgaauuacauacggugcuuguccuagauaugugaaacaaaacacccugaaacuugccacugggaugaggaaugucccagaaaagcagacacggggaaucuucggcgcaaucgcuggcuuuauugagaacgggugggaaggaaugguugacgguugguacggcuuccgucaccaaaauucagaggggcgcggacaggccgcggaucugaagaguacccaggccgcaaucgaccagauuaacggcaaauugaacagacucauagguaagacgaaugagaaauuccaucagaucgaaaaggaguuuagcgaaguggaggggaggauucaagaucuggaaaaguauguagaggacaccaaaaucgauuuaugguccuacaacgcugagcugcucguggcccuugaaaaucagcacacaaucgaccugacugauucugagaugaacaaguuguucgaaaagaccaagaaacagcuacgggagaaugcugaagacaugggcaacggaugcuuuaagauuuaucauaagugugauaaugccugcauaggcagcauccgaaacgggacauacgaccacgaugucuaucgcgacgaggcacugaauaacagauuccagauuaaaggaguggagcucaagucagguuacaaagacuggauccuguggauuaguuuugccaucuccugcuuccuucuguguguugcuuugcucggcuuuauaaugugggcgugccaaaaggggaauaucagguguaacauuugcaucuga

SEQ ID NO: 132798 - RNA, 1701 nt, Artificial Sequence
  derived and/or modified sequence opt3 from hemagglutinin__InfluenzaA__AHC60671
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaagagugggaccuguucguggaaagauccaaggcccauucuaacuguuaucccuacgaugucccugacuaugcaucguugaggucacucguggccagcaguggcacucuggaguuuaauaacgaguccuucaauuggacagguguuacccagaacgggacgucuagcgcuugcauccggcgcuccaauaacucauuuuucagucgacugaauuggcucacucacuuaaacuuuaaauacccagcacugaacgugaccaugcccaauaacgaacaguucgauaaacuuuauauuuggggaguccaucacccuggcacagacaaggaucagaucuuuuuguacgcccaagcuagcggccguauuacugugucuaccaagagaucccagcaggccguaaucccaaauauagggucaaggccccggguucgcaacauuccuagcagagugaguaucuauuggacaauugucaagccaggagacauccugcuaaucaauucuaccgguaaccucauugcgccgaggggcuacuucaaaauacgguccggaaagagcucgaucaugcgcucugaugcacccauugggaaauguaauuccgccugcaucacgccuaacggcucaauaccaaaugacaagcccuuucagaacgugaaucgaauuacuuacggugcuuguccuagauaugugaagcaaaacacacugaaacuugccaccgggaugaggaaugucccagagaagcagacucggggaaucuucggcgcaaucgcuggcuuuauugaaaacgggugggagggaaugguugacgguugguacggcuuccgucaccagaauagugaggggcgcggacaagccgcggaucugaaaagcacacaggccgcaaucgaccagauuaacggcaaguugaacagacucauagguaaaaccaaugaaaaguuccaucagaucgagaaagaauuuuccgagguggaagggaggauucaagaucuggagaaguauguagaggacacgaagaucgauuuauggucuuacaacgcugaacugcucguggcccuugagaaucagcacaccaucgaccugacagauagcgaaaugaacaaauuguucgagaagacuaaaaagcagcuacgggaaaaugcugaggacaugggcaacggaugcuuuaaaauuuaucauaagugugauaaugccugcauaggcucaauccgaaacgggaccuacgaccacgaugucuaucgcgacgaggcacugaauaacagauuccagauuaagggaguggaacucaaaagugguuacaaggacuggauccuguggauuuccuuugccaucagcugcuuccuucuguguguugcuuugcucggcuuuauaaugugggcgugccaaaaagggaauaucagguguaacauuugcaucuga

SEQ ID NO: 132799 - RNA, 1701 nt, Artificial Sequence
  derived and/or modified sequence opt3 from hemagglutinin__InfluenzaA__AHC60683
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcugccggccguauuacugugagcaccaagagaucucagcaggcgguaaucccaaauauaggguccaggccccggguucgcaacauuccuucaagagugagcaucuauuggacaauugucaaaccaggagacauccugcuaaucaauaguaccgguaaccucauugcaccgaggggcuacuucaagauacggucugggaaauccagcaucauucgcucggaugcccccaucggaaaguguaauucugcuugcauaacgccuaacggcuccauuccaaaugacaagcccuuucagaacgugaaucgaaucacuuacggugccuguccuagauaugugaaacaaaacacacugaaacuugcaaccgggaugaggaaugucccagaaaagcagacucggggaaucuucggcgcuauugccggcuuuaucgagaacgggugggaaggaaugguugacgguugguacggcuuccgucaccaaaauucagaggggcgcggacaggcggccgaucugaagaguacacaggcagcuauugaccagauaaacggcaaauugaacagacucaucgguaagaccaaugagaaauuccaucagauugaaaaggaguuuagcgaaguggaggggaggauccaagaucuggaaaaguauguagaggacacgaaaaucgauuuaugguccuacaacgccgagcugcucguggcucuugaaaaucagcacaccauugaccugacagauucugagaugaacaaguuguucgaaaagacuaagaaacagcuacgggagaaugccgaagacaugggcaacggaugcuuuaagauauaucauaagugugauaaugcaugcaucggcagcauucgaaacgggaccuacgaccacgaugucuaucgcgacgaggcccugaauaacagauuccagaucaaaggaguggagcucaagucagguuacaaagacuggauucuguggaucaguuuugcuauauccugcuuccuucuguguguugcguugcucggcuuuaucaugugggcaugccaaaaggggaauauuagguguaacaucugcauuuga

SEQ ID NO: 132800 - RNA, 1701 nt, Artificial Sequence
  derived and/or modified sequence opt3 from hemagglutinin__InfluenzaA__AHC60695
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcaugcggggauccaauaacucauuuuucagucgccugaauuggcucacucacuuaaacuuuaaguacccagcacugaacgugaccaugcccaauaacgagcaguucgauaagcuguauaucuggggcguccaucacccuggcacagacaaagaucagaucuuuuuguacgcccaagcuagcgggcgaauuacugugucuaccaagcguucccagcaggccguaauuccaaauaucggaucaagacccaggguucggaacauaccuagccgcgugaguauuuauuggacaaucgucaaaccaggugacauucugcuaaucaauucuaccggcaaccucaucgcgccgagaggguacuucaagauuagguccggaaaaagcucgauaaugcggucugaugcacccaucggcaaguguaauuccgccugcauuacgccuaacgguucaaucccaaaugacaagcccuuucagaacgugaaucgcauaacuuacggggcuuguccucgauaugugaaacaaaacacacugaaacuugccaccggaaugagaaaugucccagaaaaacagacuaggggcauuuucggcgcaaucgcuggguuuaucgagaacggaugggaagguaugguugacggcugguacggguuccggcaccagaauagugagggacguggccaagccgcggaucuuaagagcacacaggccgcaauugaccagaucaacgguaaauugaaccgccucauugggaagaccaaugagaaauuccaucagauagaaaaggaguuuuccgaaguggagggcagaauccaagaucuggaaaaguauguagaggacacgaaaauugauuuauggucuuacaacgcugagcugcucguggcccuugaaaaucagcacaccaucgaccugacagauagcgagaugaacaaguuguucgaaaagacuaagaaacagcuaagggagaaugcugaagacaugggaaacggcugcuuuaagaucuaucauaagugugauaaugccugcauugggucaauacggaacggaaccuacgaccacgaugucuaucgagacgaggcacugaauaaccgcuuccagaucaaagguguggagcucaagaguggcuacaaagacuggauucuguggaucuccuuugccauuagcugcuuccuucuguguguugcuuugcucggguuuaucaugugggcgugccaaaagggaaauauaagauguaacaucugcauuuga

SEQ ID NO: 132801 - RNA, 1701 nt, Artificial Sequence
  derived and/or modified sequence opt3 from hemagglutinin__InfluenzaA__AHC60707
augaagaccaucauugcccugagcuacauacucugccuuguguucgcucagaaacugcccggcaacgacaauuccacagcaacuuuguguuuagggcaccaugccgucccuaacggaacgaucguuaagaccauuacagaugaccaaaucgaggugacuaaugcgaccgaacugguacagaacucuucaacaggugagauuugcgauaguccacaccagauccuagacggcgaaaauuguacccucauagaugcucugcuuggggacccgcagugcgauggauuucaaaacaaaaagugggaccuguucguggagagaagcaaagccuauuccaauuguuaccccuaugaugucccugacuacgcaucuuugaggucgcucguggccucaagcggcacucuggaauuuaacaaugagaguuucaacuggacagguguuacccagaaugggacguccucugcuugcauccggcgcagcaacaauuccuuuuucucacgacugaacuggcucacucauuuaaauuuuaaguauccagcacugaacgugaccaugcccaacaaugagcaguucgauaaacuuuacauuuggggaguccaccauccuggcacagacaaggaucagaucuuuuuguaugcccaagcuaguggccguauuacugugagcaccaagagaucucagcaggccguaaucccaaacauaggguccaggccccggguucgcaauauuccuucaagaaucagcauuuacuggacaaucgugaaaccaggagacauccugcuaauuaacaguaccgguaaucucauagcgccgaggggcuacuucaagauccggucugggaaauccagcauuaugcgcucggacgcacccaucggaaaguguaacucugaaugcauaacgccuaauggcuccauuccaaacgauaagcccuuucagaaugucaaccgaaucacuuauggugccuguccuagauacgugaaacaaaauacacugaaacuugcuaccgggaugaggaacgugccagagaagcagacucggggaaucuucggcgccauugcaggcuuuaucgaaaaugggugggagggaauggucgacgguugguauggcuuccgucaccagaacucagaggggcgcggacaagcugccgaucugaagaguacacaggcggccauugaccagauaaauggcaaauugaacagacucaucgguaagaccaacgaaaaauuccaccagauugagaaggaauuuagcgagguugaagggaggauccaagaucuggagaaguacguggaggacacgaaaaucgauuuaugguccuauaaugcagaacugcucguagcucuugagaaccagcauaccauugaccugacagauucugaaaugaauaaguuguucgagaaaacuaagaaacagcuacgggaaaacgccgaggacaugggcaauggaugcuuuaagauauaccacaagugugauaacgcuugcaucggcagcauucgaaaugggaccuaugaccaugacguguaccgcgaugaggcccugaacaauagauuccagaucaaaggagucgaacucaagucagguuacaaagacuggauuaucuggauaaguuuugcaaucuccugcuuccugcuuuguguggcccuguugggcuuuauuaugugggcuugccaaaaggggaacaucagguguaauauuugcaucuga

SEQ ID NO: 132802 - RNA, 1701 nt, Artificial Sequence; identical to SEQ ID NO: 128871
  derived and/or modified sequence opt3 from hemagglutinin__InfluenzaA__AHC60719

SEQ ID NO: 132803 - RNA, 1701 nt, Artificial Sequence; identical to SEQ ID NO: 128998
  derived and/or modified sequence opt3 from hemagglutinin__InfluenzaA__AHC60731

SEQ ID NO: 132804 - RNA, 1701 nt, Artificial Sequence; identical to SEQ ID NO: 132709
  derived and/or modified sequence opt3 from hemagglutinin__InfluenzaA__AHC60743

SEQ ID NO: 132805 - RNA, 1701 nt, Artificial Sequence; identical to SEQ ID NO: 125427
  derived and/or modified sequence opt3 from hemagglutinin__InfluenzaA__AHC60767

SEQ ID NO: 132806 - RNA, 1701 nt, Artificial Sequence
  derived and/or modified sequence opt3 from hemagglutinin__InfluenzaA__AHC60779
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgagcgguucaauuggacagguguuacccagaacgggacguccucugcuugcauccgccgaagcaauaacuccuuuuucucacgucugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcugccggcagaauuacugugaguaccaagaggagccagcaggcgguaaucccaaauauagggucucggccccgcguuagaaacauuccuuccagggugucaaucuauuggacaauugucaaaccaggagacauccugcuaaucaauagcaccgguaaccucauugcaccgcggggcuacuucaagauacgcagugggaaaucuuccaucaugcgaagcgaugcccccauuggaaaguguaauucggcuugcaucacgccuaacggcucuauaccaaaugacaagcccuuucagaacgugaauagaauuacuuacggugccuguccuagguaugugaaacaaaacacacugaaacuugcaaccgggaugcggaaugucccagaaaagcagacucguggaaucuucggcgcuaucgccggcuuuauugagaacgggugggaaggaaugguugacgguugguacggcuuccgccaccaaaauuccgaggggagaggacaggcggccgaucugaagucaacacaggcagcuaucgaccagauuaacggcaaauugaacaggcucauagguaagaccaaugagaaauuccaucagaucgaaaaggaguuuagugaaguggaggggcggauucaagaucuggaaaaguauguagaggacacgaaaaucgauuuauggagcuacaacgccgagcugcucguggcucuugaaaaucagcacaccaucgaccugacagauuccgagaugaacaaguuguucgaaaagacuaagaaacagcuacgagagaaugccgaagacaugggcaacggaugcuuuaagauuuaucauaagugugauaaugcaugcauaggcucuauccgcaacgggaccuacgaccacgaugucuauagagacgaggcccugaauaacagguuccagauuaaaggaguggagcucaagagcgguuacaaagacuggauccuguggauuucauuugcuaucaguugcuuccuucuguguguugcguugcucggcuuuauaaugugggcaugccaaaaggggaauauccgguguaacauuugcaucuga

SEQ ID NO: 132807 - RNA, 1701 nt, Artificial Sequence; identical to SEQ ID NO: 128998
  derived and/or modified sequence opt3 from hemagglutinin__InfluenzaA__AHC60791

SEQ ID NO: 132808 - RNA, 1701 nt, Artificial Sequence; identical to SEQ ID NO: 132667
  derived and/or modified sequence opt3 from hemagglutinin__InfluenzaA__AHC60803

SEQ ID NO: 132809 - RNA, 1701 nt, Artificial Sequence; identical to SEQ ID NO: 128871
  derived and/or modified sequence opt3 from hemagglutinin__InfluenzaA__AHC60815

SEQ ID NO: 132810 - RNA, 1701 nt, Artificial Sequence
  derived and/or modified sequence opt3 from hemagglutinin__InfluenzaA__AHC60827
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagacgagauuugcaauagcccacaccagauccuagauggugaaaacuguacccucauagacgcucugcuuggcgauccgcagugcgacggguuucaaaauaaaaagugggaucuguucguggagagauccaaagcccauucuaacuguuaucccuacgacgucccugauuaugcaucguugaggucacucguggccagcaguggaacucuggaauuuaauaacgaguccuucaauuggacaggcguuacccagaacgguacgucuagcgcuugcauccggggguccaauaacucauuuuucagucgccugaauuggcucacucacuuaaacuuuaaguacccagcacugaacgugaccaugcccaauaacgagcaguucgacaagcuguauauuuggggaguccaucacccuggcacagauaaagaccagaucuuuuuguacgcccaagcuagcggccgaauuacugugucuaccaagcguucccagcaggccguaaucccaaauauagggucaagacccaggguucggaacauuccuagccgcgugaguaucuauuggacaauugucaaaccaggagauauccugcuaaucaauucuaccgguaaccucauugcgccgagaggcuacuucaagauaagguccgggaaaagcucgaucaugcggucugacgcacccauuggaaaguguaauuccgccugcaucacgccuaacggcucaauaccaaaugacaagcccuuucagaacgugaaucgcauuacuuacggugcuuguccucgauaugugaaacaaaacacacugaaacuugccaccgggaugagaaaugucccagaaaaacagacuaggggaaucuucggcgcaaucgcuggcuuuauugagaacgggugggaaggaaugguugaugguugguacggcuuccggcaccagaauagugaggggcguggacaagccgcggaccuuaagagcacacaggccgcaaucgaucagauuaacggcaaauugaaccgccucauagguaagaccaaugagaaauuccaucagaucgaaaaggaguuuuccgaaguggaggggaggauucaagaccuggaaaaguauguagaggauacgaaaaucgacuuauggucuuacaacgcugagcugcucguggcccuugaaaaucagcacaccaucgaucugacagacagcgagaugaacaaguuguucgaaaagacuaagaaacagcuaagagagaaugcugaagauaugggcaacggaugcuuuaagauuuaucauaagugugacaaugccugcauaggcucaauccggaacgggaccuacgaucacgacgucuaucgagacgaggcacugaauaaccgcuuccagauuaaaggaguggagcucaagagugguuacaaagauuggauccuguggauuuccuuugccaucagcugcuuccuucuguguguugcuuugcucggcuuuauaaugugggcgugccaaaaggggaauaucagauguaacauuugcaucuga

SEQ ID NO: 132811 - RNA, 1701 nt, Artificial Sequence; identical to SEQ ID NO: 132645
  derived and/or modified sequence opt3 from hemagglutinin__InfluenzaA__AHC60839

SEQ ID NO: 132812 - RNA, 1701 nt, Artificial Sequence; identical to SEQ ID NO: 128998
  derived and/or modified sequence opt3 from hemagglutinin__InfluenzaA__AHC60851

SEQ ID NO: 132813 - RNA, 1701 nt, Artificial Sequence
  derived and/or modified sequence opt3 from hemagglutinin__InfluenzaA__AHC60863
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcugccggccguauuacugugagcaccaagagaucucagcaggcgguaaucccaaauauaggguccaggccccggguucgcaacauuccuucaagagugagcaucuauuggacaauugucaaaccaggagacauccugcuaaucaauaguaccgguaaccucauugcaccgaggggcuacuucaagauacggucugggaaauccagcaucaugcgcucggaugcccccauuggaaaguguaauucugcuugcaucacgccuaacggcuccauaccaaaugacaagcccuuucagaacgugaaucgaauuacuuacggugccuguccuagauaugugaaacaaaacacacugaaacuugcaaccgggaugaggaaugucccagaaaagcagacucggggaaucuucggcgcuaucgccggcuuuauugagaacgggugggaaggaaugguugacgguugguacggcuuccgucaccaaaauucagaggggcgcggacaggcggccgaucugaagaguacacaggcagcuaucgaccagauuaacggcaaauugaacagacucauagguaagaccaaugagaaauuccaucagaucgaaaaggaguuuagcgaaguggaggggaggauucaagaucuggaaaaguauguagaggacacgaaaaucgauuuaugguccuacaacgccgagcugcucguggcucuugaaaaucagcacaccaucgaccugacagauucugagaugaacaaguuguucgaaaagacuaagaaacagcuacgggagaaugccgaagacaugggcaacggaugcuuuaagauuuaucauaagugugauaaugcaugcauaggcagcauccgaaacgggaccuacgaccacgaugucuaucgcgacgaggcccugaauaacagauuccagauuaaaggaguggagcucaaggcugguuacaaagacuggauccuguggauuucauuugcgaucaguugcuuccuucuguguguugcauugcucggcuuuauaaugugggccugccaaaaggggaauaucagguguaacauuugcaucuga

SEQ ID NO: 132814 - RNA, 1701 nt, Artificial Sequence; identical to SEQ ID NO: 128998
  derived and/or modified sequence opt3 from hemagglutinin__InfluenzaA__AHC60875

SEQ ID NO: 132815 - RNA, 1701 nt, Artificial Sequence; identical to SEQ ID NO: 128998
  derived and/or modified sequence opt3 from hemagglutinin__InfluenzaA__AHC60887

SEQ ID NO: 132816 - RNA, 1701 nt, Artificial Sequence; identical to SEQ ID NO: 125427
  derived and/or modified sequence opt3 from hemagglutinin__InfluenzaA__AHC60899

SEQ ID NO: 132817 - RNA, 1701 nt, Artificial Sequence; identical to SEQ ID NO: 129798
  derived and/or modified sequence opt3 from hemagglutinin__InfluenzaA__AHC60911

SEQ ID NO: 132818 - RNA, 1701 nt, Artificial Sequence; identical to SEQ ID NO: 132634
  derived and/or modified sequence opt3 from hemagglutinin__InfluenzaA__AHC60923

SEQ ID NO: 132819 - RNA, 1701 nt, Artificial Sequence; identical to SEQ ID NO: 129798
  derived and/or modified sequence opt3 from hemagglutinin__InfluenzaA__AHC60935

SEQ ID NO: 132820 - RNA, 1701 nt, Artificial Sequence; identical to SEQ ID NO: 128998
  derived and/or modified sequence opt3 from hemagglutinin__InfluenzaA__AHC60947

SEQ ID NO: 132821 - RNA, 1701 nt, Artificial Sequence; identical to SEQ ID NO: 129798
  derived and/or modified sequence opt3 from hemagglutinin__InfluenzaA__AHC60959

SEQ ID NO: 132822 - RNA, 1701 nt, Artificial Sequence; identical to SEQ ID NO: 128871
  derived and/or modified sequence opt3 from hemagglutinin__InfluenzaA__AHC60971

SEQ ID NO: 132823 - RNA, 1701 nt, Artificial Sequence; identical to SEQ ID NO: 129798
  derived and/or modified sequence opt3 from hemagglutinin__InfluenzaA__AHC60983

SEQ ID NO: 132824 - RNA, 1701 nt, Artificial Sequence; identical to SEQ ID NO: 128998
  derived and/or modified sequence opt3 from hemagglutinin__InfluenzaA__AHC61007

SEQ ID NO: 132825 - RNA, 1701 nt, Artificial Sequence; identical to SEQ ID NO: 128871
  derived and/or modified sequence opt3 from hemagglutinin__InfluenzaA__AHC61019

SEQ ID NO: 132826 - RNA, 1701 nt, Artificial Sequence
  derived and/or modified sequence opt3 from hemagglutinin__InfluenzaA__AHC61031
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcugccggccguauuacugugagcaccaagagaucucagcaggcgguaaucccaaauauaggguccaggccccggguucgcaacauuccuucaagagugagcaucuauuggacaauugucaaaccaggagacauccugcuaaucaauaguaccgguaaccucauugcaccgaggggcuacuucaagauacggucugggaaauccagcaucaugcgcucggaugcccccauuggaaaguguaauucugcuugcaucacgccuaacggcuccauaccaaaugacaagcccuuucagaacgugaaucgaauuacuuacggugccuguccuagauaugugaaacaaaacacacugaaacuugcaaccgggaugaggaaugucccagaaaagcagacucggggaaucuucggcgcuaucgccggcuuuauugagaacgggugggaaggaaugguugacgguugguacggcuuccgucaccaaaauucagaggggcgcggacaggcggccgaucugaagaguacacaggcagcuaucgaccagauuaacggcaaauugaacagacucauagguaagaccaaugagaaauuccaucagaucgaaaaggaguuuagcgaaguggaggggaggauucaagaucuggaaaaguauguagaggacacgaaaaucgauuuaugguccuacaacgccgagcugcucguggcucuugaaaaucagcacaccaucgaccugacagauucugagaugaacaaguuguucgaaaagacuaagaaacagcuacgggagaaugccgaagacaugggcaacggaugcuuuaagauuuaucauaagugugauaaugcaugcauaggcagcauccgaaacgggaccuacgaccacgaugucuaucgcgacgaggcccugaauaacagauuccagauuaaaggaguggagcucaagucagguuacaaagacuggauccuguggauuaguuuugcuaucuccugcuuccuucuguguguuguguugcucggcuuuauaaugugggcgugccaaaaggggaauaucagguguaacauuugcaucuga

SEQ ID NO: 132827 - RNA, 1701 nt, Artificial Sequence; identical to SEQ ID NO: 129798
  derived and/or modified sequence opt3 from hemagglutinin__InfluenzaA__AHC61043

SEQ ID NO: 132828 - RNA, 1701 nt, Artificial Sequence
  derived and/or modified sequence opt3 from hemagglutinin__InfluenzaA__AHC61055
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcugccggccguauuacugugagcaccaagagaucucagcaggcgguaaucccaaauauaggguccaggccccggguucgcaacauuccuucaagagugagcaucuauuggacaauugucaaaccaggagacauccugcuaaucaauaguaccgguaaccucauugcaccgaggggcuacuucaagauacggucugggaaauccagcaucaugcgcucggaugcccccauuggaaaguguaauucugcuugcaucacgccuaacggcuccauaccaaaugacaagcccuuucagaacgugaaucgaauuacuuacggugccuguccuagauaugugaaacaaaacacacugaaacuugcaaccgggaugaggaaugucccagaaaagcagacucggggaaucuucggcgcuaucgccggcuuuauugagaacgggugggaaggaaugguugacgguugguacggcuuccgucaccaaaauucagaggggcgcggacaggcggccgaucugaagaguacacaggcagcuaucgaccagauuaacggcaaauugaacagacucauagguaagaccaaugagaaauuccaucagaucgaaaaggaguuuagcgaaguggaggggaggauucaaaaccuggaaaaguauguagaggauacgaaaaucgacuuaugguccuacaaugccgagcugcucguggcucuugaaaaccagcacaccaucgaucugacagacucugagaugaauaaguuguucgaaaagacuaagaaacagcuacgggagaacgccgaagauaugggcaauggaugcuuuaagauuuaucauaagugugacaacgcaugcauaggcagcauccgaaaugggaccuacgaucacgacgucuaucgcgaugaggcccugaacaauagauuccagauuaaaggaguggagcucaagucagguuacaaagacuggauccuguggauuaguuuugcuaucuccugcuuccuucuguguguugcguugcucggcuuuauaaugugggcaugccaaaaggggaacaucagguguaauauuugcaucuga

SEQ ID NO: 132829 - RNA, 1701 nt, Artificial Sequence; identical to SEQ ID NO: 132695
  derived and/or modified sequence opt3 from hemagglutinin__InfluenzaA__AHC61067

SEQ ID NO: 132830 - RNA, 1701 nt, Artificial Sequence; identical to SEQ ID NO: 131090
  derived and/or modified sequence opt3 from hemagglutinin__InfluenzaA__AHC61079

SEQ ID NO: 132831 - RNA, 1701 nt, Artificial Sequence; identical to SEQ ID NO: 128998
  derived and/or modified sequence opt3 from hemagglutinin__InfluenzaA__AHC61103

SEQ ID NO: 132832 - RNA, 1701 nt, Artificial Sequence; identical to SEQ ID NO: 128998
  derived and/or modified sequence opt3 from hemagglutinin__InfluenzaA__AHC61115

SEQ ID NO: 132833 - RNA, 1701 nt, Artificial Sequence; identical to SEQ ID NO: 129798
  derived and/or modified sequence opt3 from hemagglutinin__InfluenzaA__AHC61127

SEQ ID NO: 132834 - RNA, 1701 nt, Artificial Sequence
  derived and/or modified sequence opt3 from hemagglutinin__InfluenzaA__AHC61139
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaggaucagaucuuuuuguacgcccaagcuagcggccguauuacugugucuacccagagaucccagcaggccguaaucccaaauauagggucaaggccccggguucgcaacauuccuagcagagugaguaucuauuggacaauugucaagccaggagacauccugcuaaucaauucuaccgguaaccucauugcgccgaggggcuacuucaaaauacgguccggaaagagcucgaucaugcgcucugaugcacccauugggaaauguaauuccgccugcaucacgccuaacggcucaauaccaaaugacaagcccuuucaaaacgugaaucgaauuacuuacggugcuuguccuagauaugugaagcagaacacacugaaacuugccaccgggaugaggaaugucccagaaaagcagacucggggaaucuucggcgcaaucgcuggcuuuauugagaacgggugggaaggaaugguugacgguugguacggcuuccgucaccaaaauagugaggggcgcggacaggccgcggaucugaaaagcacacaggccgcaaucgaccagauuaacggcaaguugaacagacucauagguaaaaccaaugagaaguuccaucaaaucgaaaaagaguuuuccgaaguggaggggaggauucaggaucuggaaaaguauguagaggacacgaagaucgauuuauggucuuacaacgcugagcugcucguggcccuugaaaaucagcacaccaucgaccugacagauagcgagaugaacaaauuguucgaaaagacuaaaaagcagcuacgggagaaugcugaagacaugggcaacggaugcuuuaaaauuuaucauaagugugauaaugccugcauaggcucaauccgaaacgggaccuacaaucacgacgucuaucgcgaugaggcacugaacaauagauuccaaauuaagggaguggagcucaaaagugguuacaaggacuggauccuguggauuuccuuugccaucagcugcuuccuucuguguguugcuuugcucggcuuuauaaugugggcgugccagaaagggaacaucagguguaauauuugcaucuga

SEQ ID NO: 132835 - RNA, 1701 nt, Artificial Sequence; identical to SEQ ID NO: 128998
  derived and/or modified sequence opt3 from hemagglutinin__InfluenzaA__AHC61151

SEQ ID NO: 132836 - RNA, 1701 nt, Artificial Sequence
  derived and/or modified sequence opt3 from hemagglutinin__InfluenzaA__AHC61163
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaagaaugaguccuucaacuggacagguguuacccagaaugggacgucuagcgcuugcauccggcgcuccaacaauucauuuuucagucgacugaacuggcucacucacuuaaauuuuaaguacccagcacugaacgugaccaugcccaacaaugagcaguucgauaaacuuuauauuuggggaguccaucacccuggcacagacaaggaucagaucuuuuuguacgcccaagcuagcggccguauuacugugucuaccaaaagaucccagcaggccguaguuccaaacaucgggucaaggccccgggugcgcaauauaccuagcagagucaguauuuauuggacaaucgugaagccaggagacauucugcuaaucaacucuaccgguaaucucaucgcgccgaggggcuacuucaaaauucgguccggaaagagcucgauaaugcgcucugaugcacccaucgggaaguguaacuccgccugcauuacgccuaauggcucaaucccaaacgacaaacccuuucagaaugugaaccgaauaacuuacggugcuuguccuagauaugucaagcaaaauacacugaaacuugccaccgggaugaggaacguuccagaaaagcagacucggggaauuuucggcgcaaucgcuggcuuuaucgagaaugggugggaaggaaugguggacgguugguacggcuuccgucaccagaacagugaggggcgcggacaagccgcggaucugaaaagcacacaggccgcaauugaccagaucaauggcaaguugaacagacucauugguaaaaccaacgagaaguuccaucagauagaaaaggaguuuuccgaaguagaggggaggauccaagaucuggaaaaauauguggaggacacgaagauugauuuauggucuuacaaugcugagcugcucgucgcccuugaaaaccagcacaccaucgaccugacagauagcgagaugaauaaauuguucgaaaagacuaaaaagcagcuacgggagaacgcugaagacaugggcaauggaugcuuuaagaucuaucauaaaugugauaacgccugcauuggcucaauacgaaaugggaccuacgaccacgauguguaucgcgacgaggcacugaacaauagauuccagaucaagggaguugagcucaaaagugguuacaaggacuggauucuguggaucuccuuugccauuagcugcuuccuucuguguguggcuuugcucggcuuuaucaugugggcgugccaaaaagggaacauaagguguaauaucugcauuuga

SEQ ID NO: 132837 - RNA, 1701 nt, Artificial Sequence; identical to SEQ ID NO: 129798
  derived and/or modified sequence opt3 from hemagglutinin__InfluenzaA__AHC61175

SEQ ID NO: 132838 - RNA, 1701 nt, Artificial Sequence; identical to SEQ ID NO: 128998
  derived and/or modified sequence opt3 from hemagglutinin__InfluenzaA__AHC61187

SEQ ID NO: 132839 - RNA, 1701 nt, Artificial Sequence; identical to SEQ ID NO: 128871
  derived and/or modified sequence opt3 from hemagglutinin__InfluenzaA__AHC61199

SEQ ID NO: 132840 - RNA, 1701 nt, Artificial Sequence; identical to SEQ ID NO: 132634
  derived and/or modified sequence opt3 from hemagglutinin__InfluenzaA__AHC61211

SEQ ID NO: 132841 - RNA, 1701 nt, Artificial Sequence; identical to SEQ ID NO: 128871
  derived and/or modified sequence opt3 from hemagglutinin__InfluenzaA__AHC61223

SEQ ID NO: 132842 - RNA, 1701 nt, Artificial Sequence; identical to SEQ ID NO: 128998
  derived and/or modified sequence opt3 from hemagglutinin__InfluenzaA__AHC61235

SEQ ID NO: 132843 - RNA, 1701 nt, Artificial Sequence; identical to SEQ ID NO: 129798
  derived and/or modified sequence opt3 from hemagglutinin__InfluenzaA__AHC61247

SEQ ID NO: 132844 - RNA, 1701 nt, Artificial Sequence; identical to SEQ ID NO: 129798
  derived and/or modified sequence opt3 from hemagglutinin__InfluenzaA__AHC61259

SEQ ID NO: 132845 - RNA, 1701 nt, Artificial Sequence; identical to SEQ ID NO: 128998
  derived and/or modified sequence opt3 from hemagglutinin__InfluenzaA__AHC61271

SEQ ID NO: 132846 - RNA, 1701 nt, Artificial Sequence; identical to SEQ ID NO: 128871
  derived and/or modified sequence opt3 from hemagglutinin__InfluenzaA__AHC61283

SEQ ID NO: 132847 - RNA, 1701 nt, Artificial Sequence; identical to SEQ ID NO: 131090
  derived and/or modified sequence opt3 from hemagglutinin__InfluenzaA__AHC61295

SEQ ID NO: 132848 - RNA, 1701 nt, Artificial Sequence; identical to SEQ ID NO: 132702
  derived and/or modified sequence opt3 from hemagglutinin__InfluenzaA__AHC61307

SEQ ID NO: 132849 - RNA, 1701 nt, Artificial Sequence; identical to SEQ ID NO: 128998
  derived and/or modified sequence opt3 from hemagglutinin__InfluenzaA__AHC61319

SEQ ID NO: 132850 - RNA, 1701 nt, Artificial Sequence; identical to SEQ ID NO: 132634
  derived and/or modified sequence opt3 from hemagglutinin__InfluenzaA__AHC61331

SEQ ID NO: 132851 - RNA, 1701 nt, Artificial Sequence
  derived and/or modified sequence opt3 from hemagglutinin__InfluenzaA__AHC61343
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggggauccaauaacucauuuuucagucgccugaauuggcucacucacuuaaacuuuaaguacccagcacugaacgugaccaugcccaauaacgagcaguucgauaagcuguauauuuggggcguccaucacccuggcacagacaaagaucagaucuuuuuguacgcccaagcuagcgggcgaauuacugugucuaccaagcguucccagcaggccguaaucccaaauauaggaucaagacccaggguucggaacauuccuagccgcaucaguauuuauuggacaaucgugaaaccaggugacauccugcuaauuaauucuaccggcaaccucauagcgccgagaggguacuucaagaucagguccggaaaaagcucgauuaugcggucugaugcacccaucggcaaguguaauuccgccugcauaacgccuaacgguucaauuccaaaugacaagcccuuucagaacgucaaucgcaucacuuacggggcuuguccucgauaugugaaacaaaacacacugaaacuugccaccggaaugagaaaugugccagaaaaacagacuaggggcaucuucggcgcaauugcuggguuuaucgagaacggaugggaagguauggucgacggcugguacggguuccggcaccagaauagugagggacguggccaagccgcggaucuuaagagcacacaggccgcaauugaccagauaaacgguaaauugaaccgccucaucgggaagaccaaugagaaauuccaucagauugaaaaggaguuuuccgaaguugagggcagaauccaagaucuggaaaaguauguggaggacacgaaaaucgauuuauggucuuacaacgcugagcugcucguagcccuugaaaaucagcacaccauugaccugacagauagcgagaugaacaaguuguucgaaaagacuaagaaacagcuaagggagaaugcugaagacaugggaaacggcugcuuuaagauauaucauaagugugauaaugccugcaucgggucaauucggaacggaaccuacgaccacgauguguaucgagacgaggcacugaauaaccgcuuccagaucaaaggugucgagcucaagaguggcuacaaagacuggauucuguggaucuccuuugccauaagcugcuuccuucuguguguggcuuugcucggguuuaucaugugggcgugccaaaagggaaauauuagauguaacaucugcauuuga

SEQ ID NO: 132852 - RNA, 1701 nt, Artificial Sequence; identical to SEQ ID NO: 128871
  derived and/or modified sequence opt3 from hemagglutinin__InfluenzaA__AHC61355

SEQ ID NO: 132853 - RNA, 1701 nt, Artificial Sequence; identical to SEQ ID NO: 128871
  derived and/or modified sequence opt3 from hemagglutinin__InfluenzaA__AHC61367

SEQ ID NO: 132854 - RNA, 1701 nt, Artificial Sequence; identical to SEQ ID NO: 128998
  derived and/or modified sequence opt3 from hemagglutinin__InfluenzaA__AHC61379

SEQ ID NO: 132855 - RNA, 1701 nt, Artificial Sequence; identical to SEQ ID NO: 128871
  derived and/or modified sequence opt3 from hemagglutinin__InfluenzaA__AHC61391

SEQ ID NO: 132856 - RNA, 1701 nt, Artificial Sequence
  derived and/or modified sequence opt3 from hemagglutinin__InfluenzaA__AHC61403
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcuagcggccguauuacugugucuaccaagagaucccagcaggccguaaucccaaauauagggucaaggccccggguucgcaacauuccuagcagagugaguaucuauuggacaauugucaaaccaggagacauccugcuaaucaauucuaccgguaaccucauugcgccgaggggcuacuucaagauacgguccgggaaaagcucgaucaugcgcucugaugcacccauuggaaaguguaauuccgccugcaucacgccuaacggcucaauaccaaaugacaagcccuuucagaacgugaaucgaauuacuuacggugcuuguaguagauaugugaaacaaaacacacugaaacuugccaccgggaugaggaaugucccugaaaagcagacucggggaaucuucggcgcaaucgcuggcuuuauugagaacgggugggaaggaaugguugacgguugguacggcuuccgucaccagaauagcgaggggcgcggacaagccgcggaucugaaguccacacaggccgcaaucgaccagauuaacggcaaauugaacagacucauagguaagaccaaugagaaauuccaucagaucgaaaaggaguuuucugaaguggaggggaggauucaagaucuggaaaaguauguagaggacacgaaaaucgauuuauggagcuacaacgcugagcugcucguggcccuugaaaaucagcacaccaucgaccugacagauucagagaugaacaaguuguucgaaaagacuaagaaacagcuacgggagaaugcugaagacaugggcaacggaugcuuuaagauuuaucauaagugugauaaugccugcauaggcaguauccgaaacgggaccuacgaccacgaugucuaucgcgacgaggcacugaauaacagauuccagauuaaaggaguggagcucaaguccgguuacaaagacuggauccuguggauuagcuuugccaucucuugcuuccuucuguguguugcuuugcucggcuuuauaaugugggcgugccaaaaggggaauaucagguguaacauuugcaucuga

SEQ ID NO: 132857 - RNA, 1701 nt, Artificial Sequence; identical to SEQ ID NO: 128998
  derived and/or modified sequence opt3 from hemagglutinin__InfluenzaA__AHC61415

SEQ ID NO: 132858 - RNA, 1701 nt, Artificial Sequence
  derived and/or modified sequence opt3 from hemagglutinin__InfluenzaA__AHC61427
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaacaaaugggaccuguucguggagagauccaaggcccauucuaauuguuaucccuacgaugucccugacuaugcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucacuuaaacuuuaaauacccagcacugaaugugaccaugcccaacaaugagcaguucgauaaacuuuauauuuggggaguccaucacccuggcacagacaaggaucagaucuuuuuguacgcccaagcugccggccguauuacugugagcaccaagagaucucagcaggcgguaaucccaaacauaggguccaggccccggguucgcaauauuccuucaagagugagcaucuauuggacaauugucaagccaggagacauccugcuaaucaacaguaccgguaaucucauugcaccgaggggcuacuucaaaauacggucugggaaguccagcaucauucgcucggaugcccccaucggaaaauguaacucugcuugcauaacgccuaauggcuccauuccaaacgacaagcccuuucagaaugugaaccgaaucacuuacggugccuguccuagauaugugaagcaaaauacacugaaacuugcaaccgggaugaggaacgucccagaaaagcagacucggggaaucuucggcgcuauugccggcuuuaucgagaaugggugggaaggaaugguugacgguugguacggcuuccgucaccagaacucagaggggcgcggacaagcggccgaucugaaaaguacacaggcagcuauugaccagauaaacggcaaguugaauagacucaucgguaaaaccaacgagaaguuccaucagauugaaaaagaguuuagcgaaguggaggggaggauccaagaucuggaaaaguauguagaggacacgaagaucgauuuaugguccuacaaugccgagcugcucguggcucuugaaaaccagcacaccauugaccugacagauucugagaugaauaaauuguucgaaaagacuaaaaagcagcuacgggagaacgccgaagacaugggcaauggaugcuuuaaaauauaucauaagugugauaacgcaugcaucggcagcauucgaaaugggaccuacgaccacgaugucuaucgcgacgaggcccugaacaauagauuccagaucaagggaguggagcucaaaucagguuacaaggacuggauucuguggaucaguuuugcuauauccugcuuccuucuguguguugcguugcucggcuuuaucaugugggcaugccaaaaagggaacauuagguguaauaucugcauuuga

SEQ ID NO: 132859 - RNA, 1701 nt, Artificial Sequence
  derived and/or modified sequence opt3 from hemagglutinin__InfluenzaA__AHC61439
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcugccggccguauuacugugagcaccaagagaucucagcaggcgguaaucccaaauauaggguccaggccccggguucgcaacauuccuucaagagugagcaucuauuggacaauugucaaaccaggagacauccugcuaaucaauaguaccgguaaccucauugcaccgaggggcuacuucaagauacggucugggaaauccagcaucaugcgcucggaugcccccauuggaaaguguaauucuacgugcaucacuccuaacggcuccauaccaaaugacaagcccuuucagaacgugaaucgaauuacauacggugcuuguccuagauaugugaaacaaaacacccugaaacuugccacugggaugaggaaugucccagaaaagcagacacggggaaucuucggcgcaaucgcuggcuuuauugagaacgggugggaaggaaugguugacgguugguacggcuuccgucaccaaaauucagaggggcgcggacaggccgcggaucugaagaguacccaggccgcaaucgaccagauuaacggcaaauugaacagacucauagguaagacgaaugagaaauuccaucagaucgaaaaggaguuuagcgaaguggaggggaggauucaagaucuggaaaaguauguagaggacaccaaaaucgauuuaugguccuacaacgcugagcugcucguggcccuugaaaaucagcacacaaucgaccugacugauucugagaugaacaaguuguucgaaaagaccaagaaacagcuacgggagaaugcugaagacaugggcaacggaugcuuuaagauuuaucauaagugugauaaugccugcauaggcagcauccgaaacgggacauacgaccacgaugucuaucgcgacgaggcacugaauaacagauuccagauuaaaggaguggagcucaagucagguuacaaagacuggauccuguggauuaguuuugccaucuccugcuuccuucuguguguugcuuugcucggcuuuauaaugugggcgugccaaaaggggaauaucagguguaacauuugcaucuga

SEQ ID NO: 132860 - RNA, 1701 nt, Artificial Sequence; identical to SEQ ID NO: 128871
  derived and/or modified sequence opt3 from hemagglutinin__InfluenzaA__AHC61451

SEQ ID NO: 132861 - RNA, 1701 nt, Artificial Sequence; identical to SEQ ID NO: 128871
  derived and/or modified sequence opt3 from hemagglutinin__InfluenzaA__AHC61463

SEQ ID NO: 132862 - RNA, 1701 nt, Artificial Sequence; identical to SEQ ID NO: 129798
  derived and/or modified sequence opt3 from hemagglutinin__InfluenzaA__AHC61475

SEQ ID NO: 132863 - RNA, 1701 nt, Artificial Sequence; identical to SEQ ID NO: 128998
  derived and/or modified sequence opt3 from hemagglutinin__InfluenzaA__AHC61487

SEQ ID NO: 132864 - RNA, 1701 nt, Artificial Sequence; identical to SEQ ID NO: 129798
  derived and/or modified sequence opt3 from hemagglutinin__InfluenzaA__AHC61499

SEQ ID NO: 132865 - RNA, 1701 nt, Artificial Sequence; identical to SEQ ID NO: 128871
  derived and/or modified sequence opt3 from hemagglutinin__InfluenzaA__AHC61511

SEQ ID NO: 132866 - RNA, 1701 nt, Artificial Sequence; identical to SEQ ID NO: 131090
  derived and/or modified sequence opt3 from hemagglutinin__InfluenzaA__AHC61523

SEQ ID NO: 132867 - RNA, 1701 nt, Artificial Sequence
  derived and/or modified sequence opt3 from hemagglutinin__InfluenzaA__AHC61535
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuggcacagacaaagaucagaucuuuuuguacgcccaagcuagcggccguauuacugugucuaccaagagaucccagcaggccguaaucccaaauauagggucaaggccccggguucgcaacauuccuagcagagugaguaucuauuggacaauugucaaaccaggagacauccugcuaaucaauucuaccgguaaccucauugcgccgaggggcuacuucaagauacgguccgggaaaagcucgaucaugcgcucugaugcacccauuggaaaguguaauuccgccugcaucacgccuaacggcucaauaccaaaugacaagcccuuucagaacgugaaucgaauuacuuacggugcuuguccuagauaugugaaacaaaacacacugaaacuugccaccgggaugaggaaugucccagaaaaacagacucggggaaucuucggcgcaaucgcuggcuuuauugagaacgggugggaaggaaugguugacgguugguacggcuuccgucaccagaauagugaggggcgcggacaagccgcggaucuuaagagcacacaggccgcaaucgaccagauuaacggcaaauugaacagacucauagguaagaccaaugagaaauuccaucagaucgaaaaggaguuuuccgaaguggaggggaggauucaagaucuggaaaaguauguagaggacacgaaaaucgauuuauggucuuacaacgcugagcugcucguggcccuugaaaaucagcacaccaucgaccugacagauagcgagaugacuaaguuguucgaaaagaccaagaaacagcuacgggagaacgcugaagacaugggcaauggaugcuuuaagauuuaucauaagugugauaacgccugcauaggcucaauccgaaaugggacauacgaccacgaugucuaucgcgacgaggcacugaacaauagauuccagauuaaaggaguggagcucaagagugguuacaaagacuggauccuguggauuuccuuugccaucagcugcuuccuucuguguguugcuuugcucggcuuuauaaugugggcgugccaaaaggggaacaucagguguaauauuugcaucuga

SEQ ID NO: 132868 - RNA, 1701 nt, Artificial Sequence; identical to SEQ ID NO: 128871
  derived and/or modified sequence opt3 from hemagglutinin__InfluenzaA__AHC61547

SEQ ID NO: 132869 - RNA, 1701 nt, Artificial Sequence
  derived and/or modified sequence opt3 from hemagglutinin__InfluenzaA__AHC61559
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagaucauagauggcgaaaacuguacccuaaucgacgcucuccugggggauccgcagugcgacggauuucagaauaaaaagugggaucuuuucguggagagaagcaaagccuauuccaacuguuaccccuaugacgucccugauuacgcaucucugaggucguugguggccucaagcggcacucucgaauuuaauaacgagaguuucaauuggacagguguuacccagaacgggacguccucugcuugcauucggcgcagcaauaacuccuuuuucucacgacugaauuggcugacucaucucaacuuuaaguauccagcauuaaacgugaccaugcccaauaacgagcaguucgacaagcuguacaucuggggaguccaccauccuggcacagauaaagaccagauuuuucuuuaugcccaagcuaguggccguaucacugugagcaccaagagaucucagcaggccguaauaccaaauauuggguccaggccccggguucgcaacaucccuucaagaauuagcaucuacuggacaaucgugaaaccaggagauauuuugcugauaaauaguaccgguaaccuaaucgcgccgaggggcuacuucaagauucggucugggaaauccagcaucaugcgcucggacgcacccauaggaaaguguaauucugaaugcauuacgccuaacggcuccaucccaaaugacaagcccuuucagaacgucaaucgaaucacuuauggugccuguccuagauacgugaaacaaaacacacucaagcuggcuaccgggaugaggaaugugccagagaaacagacucggggaauuuucggcgccaucgcaggcuuuauugaaaacgggugggagggaauggucgaugguugguauggcuuccgucaccaaaauucagaggggcgcggacaggcugccgaccuuaagaguacacaggcggccauagaucagaucaacggcaaacugaacagauugauuaggaagaccaaugaaaaauuccaccagaucgagaaggaauuuagcgagguugaaggucggauccaagaccucgagaaguacguggaggauacgaaaauugaccugugguccuauaacgcagaauuacugguagcucucgagaaucagcauaccauagaucuuacagacucugaaaugaacaagcuguucgagaaaacuaagaaacaguugcgagaaaaugccgaggauauggggaacggcugcuuuaagaucuaccacaagugugacaaugcuugcauuggaagcauccgcaacggcaccuaugaucaugacguguacagagacgaggcccuaaauaacagguuccagauuaaaggggucgaacugaagucaggacacaaagauuggauccucuggauaaguuuugcaaucuccugcuuccugcuuuguguggcccuguuggguuuuauuaugugggcuugccaaaagggcaauauccgguguaacauuugcaucuga

SEQ ID NO: 132870 - RNA, 1701 nt, Artificial Sequence; identical to SEQ ID NO: 131090
  derived and/or modified sequence opt3 from hemagglutinin__InfluenzaA__AHC61571

SEQ ID NO: 132871 - RNA, 1701 nt, Artificial Sequence; identical to SEQ ID NO: 128871
  derived and/or modified sequence opt3 from hemagglutinin__InfluenzaA__AHC61583

SEQ ID NO: 132872 - RNA, 1701 nt, Artificial Sequence; identical to SEQ ID NO: 131090
  derived and/or modified sequence opt3 from hemagglutinin__InfluenzaA__AHC61595

SEQ ID NO: 132873 - RNA, 1701 nt, Artificial Sequence
  derived and/or modified sequence opt3 from hemagglutinin__InfluenzaA__AHC61607
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcgaaaacuguacccucauagacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcauccggcgcagcaauaacuccuuuuucucacgacugaauuggcucacucauuuaaacuuuaaguauccagcacugaacgugaccaugcccaauaacgagcaguucgacaaacuuuacauuuggggaguccaccauccuggcacagauaaggaccagaucuuuuuguaugcccaagcuaguggccguauuacugugagcaccaagagaucucagcaggccguaaucccaaauauaggguccaggccccggguucgcaacauuccuucaagaaucagcauuuacuggacaaucgugaaaccaggagauauccugcuaauuaauaguaccgguaaccucauagcgccgaggggcuacuucaagauccggucugggaaauccagcauuaugcgcucggacgcacccaucggaaaguguaauucugaaugcauaacgccuaacggcuccauuccaaaugacaagcccuuucagaacgucaaucgaaucacuuauggugccuguccuagauacgugaaacaacacacacugaaacuugcuaccgggaugaggaacgugccagagaagcagacucggggaaucuucggcgccauugcaggcuuuaucgaaaaugggugggagggaauggucgaugguugguauggcuuccgucaccagaacucagaggggcgcggacaagcugccgaccugaagaguacacaggcggccauugaucagauaaauggcaaauugaacagacucaucgguaagaccaacgaaaaauuccaucagauugagaaggaauuuagcgagguugaagggaggauccaagaccuggagaaguacguggaggauacgaaaaucgacuuaugguccuauaaugcagaacugcucguagcucuugagaaccagcacaccauugaucugacagacucugaaaugaauaaguuguucgagaaaacuaagaaacagcuacgggaaaacgccgaggauaugggcaauggaugcuuuaagauauaccauaagugugacaacgcuugcaucggcagcauucgaaaugggaccuaugaucacgacguguaccgcgacgaggcccugaacaauagauuccagaucaaaggagucgaacucaagucagguuacaaagauuggauucuguggaucaguuuugcaauauccugcuuccuucuguguguggccuugcucggcuuuaucaugugggcuugccaaaaggggaacauuagguguaauaucugcauuuga

SEQ ID NO: 132874 - RNA, 1701 nt, Artificial Sequence; identical to SEQ ID NO: 131090
  derived and/or modified sequence opt3 from hemagglutinin__InfluenzaA__AHC61619

SEQ ID NO: 132875 - RNA, 1701 nt, Artificial Sequence
  derived and/or modified sequence opt3 from hemagglutinin__InfluenzaA__AHC61631
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguaccauaaucgaugcucuccugggggacccgcagugcgauggauuucaaaauaaaaagugggaccuuuucguggagagauccaaagcccauucuaacuguuaucccuacgaugucccugacuaugcaucgcugaggucauugguggccagcaguggcacucucgaauuuaauaacgaguccuucaauuggacagguguuacccagaacgggacgucuagcgcuugcauucggcgcuccaauaacucauuuuucagucgacugaauuggcugacucaccucaacuuuaaguacccagcauuaaacgugaccaugcccaauaacgagcaguucgauaagcuguauaucuggggaguccaucacccuggcacagacaaagaucagauuuuucuuuacgcccaagcugccggccguaucacugugagcaccaagagaucucagcaggcgguaauaccaaauauuggguccaggccccggguucgcaacaucccuucaagagugagcauuuauuggacaaucgucaaaccaggagacaucuugcugauuaauaguaccgguaaccuaauagcaccgaggggcuacuucaagauccggucugggaaauccagcauuaugcgcucggaugcccccaucggaaaguguaauucugcuugcauaacgccuaacggcuccauuccaaaugacaagcccuuucagaacgugaaucgaaucacuuacggugccuguccuagauaugugaaacaaaacacacucaagcuggcaaccgggaugaggaaugucccagaaaaacagacucggggaaucuucggcgcuauugccggcuuuaucgagaacgggugggaaggaaugguugacgguugguacggcuuccgucaccaaaauucagaggggcgcggacaggcggccgaucuuaagaguacacaggcagcuauugaccagauaaacggcaaacugaacagauugaucgguaagaccaaugagaaauuccaucagauugaaaaggaguuuagcgaaguggaggggaggauccaagaucucgaaaaguauguagaggacacgaaaaucgaucugugguccuacaacgccgaguuacugguggcucucgaaaaucagcacaccauugaccuuacagauucugagaugaacaagcuguucgagaaaacuaagaaacaguugcgggaaaaugccgaagacaugggcaacggaugcuuuaagauauaucauaagugugauaaugcaugcaucggcagcauucgaaacgggaccuacgaccacgaugucuaucgcgacgaggcccuaaauaacagauuccagaucaaaggaguggagcugaagucagguuacaaagacuggauucucuggaucaguuuugcuauauccugcuuccugcuuuguguugcgcuguugggcuuuaucaugugggcaugccaaaaggggaauauuagguguaacaucugcauuuga

SEQ ID NO: 132876 - RNA, 1701 nt, Artificial Sequence
  derived and/or modified sequence opt3 from hemagglutinin__InfluenzaA__AHC61643
augaagaccaucauugcccugagcuacgugcucugccuugucuucgcucagaaacugcccggcaacgacaauuccacagcaacuuuguguuuagggcaccaugccguuccuaacggaacgauagugaagaccaucacaaaugaucaaauugagguaacuaacgcgaccgaacuggugcagucuucaaguacaggugagaucugcaauagcccacaccagauucuagacggcgaaaacuguacccucaucgaugcucugcuuggggacccgcagugcgauggauuucaaaauaaaaagugggaccuguucgucgagagauccaaagcccauucuaacuguuaucccuacgaugugccugacuaugcaucguugaggucacucguugccagcaguggcacucuggaauuuaauaacgaguccuucaauuggacaggugugacccagaacgggacgucuagcgcuugcauacggcgcuccaauaacucauuuuucagucgacugaauuggcucacucacuuaaacuuuaaguacccagcacugaacgucaccaugcccaauaacgagcaguucgauaaguuguauaucuggggagugcaucacccuggcacagacaaagaucagauuuuucuuuacgcccaagcugccggccguaucacuguaagcaccaagagaucucagcaggcgguuauuccaaauaucggguccaggccccgggugcgcaacauaccuucaagagucagcauuuauuggacaaucgugaaaccaggagacauucugcuaaucaauaguaccgguaaccucaucgcaccgaggggcuacuucaagauucggucugggaaauccagcauaaugcgcucggaugcccccaucggaaaguguaauucugcuugcauuacgccuaacggcuccaucccaaaugacaagcccuuucagaacgugaaucgaauaacuuacggugccuguccuagauaugucaaacaaaacacacugaaacuugcaaccgggaugaggaauguuccagaaaaacagacucggggaauuuucggcgcuaucgccggcuuuaucgagaacgggugggaaggaaugguggacgguugguacggcuuccgucaccaaaauucagaggggcgcggacaggcggccgaucugaagaguacacaggcagcuauugaccagaucaacggcaaauugaacagacucauugguaagaccaaugagaaauuccaucagauagaaaaggaguuuagcgaaguagaggggaggauccaagaucuggaaaaguauguggaggacacgaaaauugauuuaugguccuacaacgccgagcugcucgucgcucuugaaaaucagcacaccaucgaccugacagauucugagaugaacaaguuguucgaaaagacuaagaaacagcuacgggagaaugccgaagacaugggcaacggaugcuuuaagaucuaucauaagugugauaaugcaugcauuggcagcauacgaaacgggaccuacgaccacgauguguaucgcgacgaggcccugaauaacagauuccagaucaaaggaguugagcucaagucagguuacaaagacuggauucuguggaucaguuuugcuauuuccugcuuccuucuguguguggcguugcucggcuuuaucaugugggcaugccaaaaggggaauauaagguguaacaucugcauuuga

SEQ ID NO: 132877 - RNA, 1701 nt, Artificial Sequence
  derived and/or modified sequence opt3 from hemagglutinin__InfluenzaA__AHC61655
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacagucuucaaguaccggugagauuugcaauagcccacaccagauccuagacggcgaaaacuguacucucauagaugcgcugcuuggggacccgcagugcgauggauuucaaaauaacaaaugggaccuguucguggagagauccaaggcucauucuaauuguuaucccuacgaugucccugacuaugccucguugaggucacucguggcaagcaguggcacacuggaauuuaacaaugaguccuucaacuggaccgguguuacgcagaaugggacuucuagcgccugcauccggcgcuccaacaauucauuuuucagucgacugaacuggcucacccacuuaaacuuuaaauacccagcucugaaugugacaaugcccaacaaugagcaguucgauaaacuuuauauuuggggaguccaucacccuggcacugacaaggaucagaucuuuuuguacgcacaagccgcuggccguauuaccgugagcacaaagagaucucagcaggccguaaucccaaacauaggguccaggccccggguucgcaauauuccuucaagagugagcaucuauuggaccauugucaagccaggagacauccugcuaaucaacaguacggguaaucucauugcgccgaggggcuacuucaaaauacggucugggaaguccagcaucauucgcucggaugcacccaucggaaaauguaacucugccugcauaacuccuaauggcuccauuccaaacgacaagcccuuucagaaugugaaccgaaucacauacggugcuuguccuagauaugugaagcaaaauacccugaaacuugccacugggaugaggaacgucccagaaaagcagacacggggaaucuucggcgcaauugcuggcuuuaucgagaaugggugggaaggaaugguugacgguugguacggcuuccgucaccagaacucagaggggcgcggacaagccgcggaucugaaaaguacccaggccgcaauugaccagauaaacggcaaguugaauagacucaucgguaaaacgaacgagaaguuccaucagauugaaaaagaguuuagcgaaguggaggggaggauccaagaucuggaaaaguauguagaggacaccaagaucgauuuaugguccuacaaugcugagcugcucguggcccuugaaaaccagcacacaauugaccugacugauucugagaugaauaaauuguucgaaaagaccaaaaagcagcuacgggagaacgcugaagacaugggcaauggaugcuuuaaaauauaucauaagugugauaacgccugcaucggcagcauucgaaaugggacauacgaccacgaugucuaucgcgacgaggcacugaacaauagauuccagaucaagggaguggagcucaaaucagguuacaaggacuggauucuguggaucaguuuugccauauccugcuuccuucuguguguugcuuugcucggcuuuaucaugugggcgugccaaaaagggaacauuagguguaauaucugcauuuga

SEQ ID NO: 132878 - RNA, 1701 nt, Artificial Sequence
  derived and/or modified sequence opt3 from hemagglutinin__InfluenzaA__AHC61667
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaauuuuaaguauccagcacugaacgugaccaugcccaacaaugagcaguucgacaaacuuuacauuuggggaguccaccauccuggcacagauaaggaccagaucuuuuuguaugcccaaagcucuggccguauuacuguguccaccaagagaucacagcaggcuguaaucccaaacauagggagcaggccccggauucgcaauaucccuaguagaauuucuaucuacuggacaaucguuaaaccaggagauauucugcuaauaaacuccaccgguaaucucaucgccccgaggggcuacuucaagauucggagcgggaaaucgucuaucaugcgcuccgacgcgcccauaggaaaguguaacucagaaugcauuacgccuaauggcaguaucccaaacgacaagcccuuucagaaugugaaccgaaucacuuauggugcauguccuagauacgucaaacaaagcacacugaaacuugccaccgggaugaggaaugugccagagaagcagacucggggaauuuucggcgcuaucgccggcuuuauugaaaacgggugggagggaaugguggaugguugguauggcuuccgucaccaaaauuccgaggggcgcggacaggcagcugaccugaagucuacacaggccgcgauagaucagaucaacggcaaauugaauagacucauugguaagaccaacgaaaaauuccaccagaucgagaaggaauuuagcgaggucgaagggaggauccaagaccuggagaaguacguugaggauacgaaaauugacuuauggucauauaacgccgaacugcucguggcacuugagaaucagcauaccauagaucugacagacagugaaaugaacaaguuguucgagaaaacuaagaaacagcuacgggaaaaugcugaggauaugggcaacggaugcuuuaagaucuaccacaagugugacaaugccugcauuggcuccauccgaaacgggaccuauaaucaugauguauaccgcgacgaggcucugaacaauagauuccagauuaaaggaguggaacucaagagcgguuacaaagacuggauccuguggauaucuuuugccaucucaugcuuccuucugugugucgcauugcucggcuuuauuaugugggccugccaaaaggggaacaucagguguaauauuugcaucuga

SEQ ID NO: 132879 - RNA, 1701 nt, Artificial Sequence; identical to SEQ ID NO: 132634
  derived and/or modified sequence opt3 from hemagglutinin__InfluenzaA__AHC61679

SEQ ID NO: 132880 - RNA, 1701 nt, Artificial Sequence; identical to SEQ ID NO: 131090
  derived and/or modified sequence opt3 from hemagglutinin__InfluenzaA__AHC61691

SEQ ID NO: 132881 - RNA, 1701 nt, Artificial Sequence; identical to SEQ ID NO: 128871
  derived and/or modified sequence opt3 from hemagglutinin__InfluenzaA__AHC61703

SEQ ID NO: 132882 - RNA, 1701 nt, Artificial Sequence; identical to SEQ ID NO: 132667
  derived and/or modified sequence opt3 from hemagglutinin__InfluenzaA__AHC61715

SEQ ID NO: 132883 - RNA, 1701 nt, Artificial Sequence; identical to SEQ ID NO: 129798
  derived and/or modified sequence opt3 from hemagglutinin__InfluenzaA__AHC61727

SEQ ID NO: 132884 - RNA, 1701 nt, Artificial Sequence; identical to SEQ ID NO: 128871
  derived and/or modified sequence opt3 from hemagglutinin__InfluenzaA__AHC61739

SEQ ID NO: 132885 - RNA, 1701 nt, Artificial Sequence
  derived and/or modified sequence opt3 from hemagglutinin__InfluenzaA__AHC61751
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcgaaaacuguacccucauagacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcauccggcgcagcaauaacuccuuuuucucacgacugaauuggcucacucauuuaaacuuuaaguauccagcacugaacgugaccaugcccaauaacgagcaguucgacaaacuuuacauuuggggaguccaccauccuggcacagauaaggaccagaucuuuuuguaugcccaagcuaguggccguauuacugugagcaccaagagaucucagcaggccguaaucccaaauguuggguccaggccccgggugcgcaacauaccuucaagaauuagcaucuacuggacaauugucaaaccaggagauauccugcuaaucaauaguaccgguaaccucauugcgccgaggggcuacuucaagauacggucugggaaauccagcaucaugcgcucggacgcacccauuggaaaguguaauucugaaugcaucacgccuaacggcuccauaccaaaugacaagcccuuucagaacgugaaucgaauuacuuauggugccuguccuagauacgugaaacaaaacacacugaaacuugcuaccgggaugaggaaugucccagagaagcagacucggggaaucuucggcgccaucgcaggcuuuauugaaaacgggugggagggaaugguugaugguugguauggcuuccgucaccaaaauucagaggggcgcggacaggcugccgaccugaagaguacacaggcggccaucgaucagauuaacggcaaauugaacagacucauagguaagaccaaugaaaaauuccaccagaucgagaaggaauuuagcgagguggaagggaggauucaagaccuggagaaguacguagaggauacgaaaaucgacuuaugguccuauaacgcagaacugcucguggcucuugagaaucagcauaccaucgaucugacagacucugaaaugaacaaguuguucgagaaaacuaagaaacagcuacgggaaaaugccgaggauaugggcaacggaugcuuuaagauuuaccacaagugugacaaugcuugcauaggcagcauccgaaacgggaccuaugaucaugacgucuaccgcgacgaggcccugaauaacagauuccagauuaaaggaguggaacucaagucagguuacaaagauuggauccuguggauuaguuuugcaaucuccugcuuccuucuguguguugccuugcucggcuuuauaaugugggcuugccaaaaggggaauaucagguguaacauuugcaucuga

SEQ ID NO: 132886 - RNA, 1701 nt, Artificial Sequence
  derived and/or modified sequence opt3 from hemagglutinin__InfluenzaA__AHC61763
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcugccggccguauuacugugagcaccaagagaucucagcagacaguaaucccaaauauaggguccaggccccggguucgcaacauuccuucaagagugagcaucuauuggaccauugucaaaccaggagacauccugcuaaucaauaguacggguaaccucauugcgccgaggggcuacuucaagauacggucugggaaauccagcaucaugcgcucggaugcacccauuggaaaguguaauucugccugcaucacuccuaacggcuccauaccaaaugacaagcccuuucagaacgugaaucgaauuacauacggugcuuguccuagauaugugaaacaaaacacccugaaacuugccacugggaugaggaaugucccagaaaagcagacacggggaaucuucggcgcaaucgcuggcuuuauugagaacgggugggaaggaaugguugacgguugguacggcuuccgucaccaaaauucagaggggcgcggacaggccgcggaucugaagaguacccaggccgcaaucgaccagauuaacggcaaauugaacagacucauagguaagacgaaugagaaauuccaucagaucgaaaaggaguuuagcgaaguggaggggaggauucaagaucuggaaaaguauguagaggacaccaaaaucgauuuaugguccuacaacgcugagcugcucguggcccuugaaaaucagcacacaaucgaccugacugauucugagaugaacaaguuguucgaaaagaccaagaaacagcuacgggagaaugcugaagacaugggcaacggaugcuuuaagauuuaucauaagugugauaaugccugcauaggcagcauccgaaacgggacauacgaccacgaugucuaucgcgacgaggcacugaauaacagauuccagauuaaaggaguggagcucaagucagguuacaaagacuggauccuguggauuaguuuugccaucuccugcuuccuucuguguguugcuuugcucggcuuuauaaugugggcgugccaaaaggggaauaucagguguaacauuugcaucuga

SEQ ID NO: 132887 - RNA, 1701 nt, Artificial Sequence; identical to SEQ ID NO: 128998
  derived and/or modified sequence opt3 from hemagglutinin__InfluenzaA__AHC61775

SEQ ID NO: 132888 - RNA, 1701 nt, Artificial Sequence; identical to SEQ ID NO: 129798
  derived and/or modified sequence opt3 from hemagglutinin__InfluenzaA__AHC61787

SEQ ID NO: 132889 - RNA, 1701 nt, Artificial Sequence; identical to SEQ ID NO: 132634
  derived and/or modified sequence opt3 from hemagglutinin__InfluenzaA__AHC61799

SEQ ID NO: 132890 - RNA, 1701 nt, Artificial Sequence
  derived and/or modified sequence opt3 from hemagglutinin__InfluenzaA__AHC61823
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacucaaguuucuuuagccgacugaauuggcucacucauuuaaacuuuaaguauccagcacugaaugugaccaugcccaacaacgagcaguucgacaaacuuuacauuuggggaguccaccauccuggcacagauaaggaccagaucuuuuuguaugcccaaucuuccggccguauuacugugucaaccaagagaagccagcaggcuguaaucccaaauauagggaguaggccccggauucgcaacaucccuucuagaauuuccaucuacuggacaaucguuaaaccaggagauauucugcuaauaaauagcaccgguaaccucaucgccccgaggggcuacuucaagauucggucggggaaaucuuccaucaugaagucagacgcgcccauagacaaguguaauagugaaugcauuacgccuaacggaagcaucccaaaugauaaacccuuucagaacgugaaucgcaucacuuauggcgcauguccucgauacgucaagcaauccacacugaaacuugccaccgguaugagaaacgugccagagaagcagacuagggggauuuucggagcuaucgccggcuuuauugaaaauggcugggaggggaugguggacggaugguaugguuuccggcaccagaacucugagggccgugggcaagcagcugaucugaaaagcacacaggccgcgauagaccagaucaauggaaaguugaaccgccucauuggcaaaaccaaugaaaaguuccaccagaucgagaaggaauuuucagaggucgaagguagaauccaagaucuggagaaauacguugaggacacgaagauugauuuauggaguuauaacgccgaacugcucguggcacuugagaaccagcauaccauagaccugacagauuccgaaaugaauaaauuguucgagaagacuaaaaagcagcuaagggaaaacgcugaggacauggggaauggcugcuuuaagaucuaccacaaaugugauaacgccugcauuggaagcauccggaauggcaccuauaaccaugacguauaccgagacgaggcucugaauaaccgcuuccagauuaaggggguggaacucaaaucuggauacaaggauuggauccuguggauaucauuugccaucaguugcuuccuucugugugucgcauugcucgguuuuauuaugugggccugccaaaaaggcaauaucagauguaacauuugcaucuga

SEQ ID NO: 132891 - RNA, 1701 nt, Artificial Sequence; identical to SEQ ID NO: 129798
  derived and/or modified sequence opt3 from hemagglutinin__InfluenzaA__AHC61835

SEQ ID NO: 132892 - RNA, 1701 nt, Artificial Sequence; identical to SEQ ID NO: 128998
  derived and/or modified sequence opt3 from hemagglutinin__InfluenzaA__AHC61847

SEQ ID NO: 132893 - RNA, 1701 nt, Artificial Sequence; identical to SEQ ID NO: 128871
  derived and/or modified sequence opt3 from hemagglutinin__InfluenzaA__AHC61859

SEQ ID NO: 132894 - RNA, 1701 nt, Artificial Sequence; identical to SEQ ID NO: 129798
  derived and/or modified sequence opt3 from hemagglutinin__InfluenzaA__AHC61871

SEQ ID NO: 132895 - RNA, 1701 nt, Artificial Sequence
  derived and/or modified sequence opt3 from hemagglutinin__InfluenzaA__AHC61883
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacucaaguuucuuuagccgacugaauuggcucacucauuuaaacuuuaaguauccagcacugaaugugaccaugcccaacaacgagcaguucgacaagcuguacauuuggggaguccaccauccuggcacagauaaagaccagaucuuuuuguaugcccaaucuuccggccguauuacugugucaaccaagagaagccagcaggcuguaaucccaaauauagggaguaggccccggauucgcaacaucccuucuagaauuuccaucuacuggacaaucguuaaaccaggagauauucugcuaauaaauagcaccgguaaccucaucgccccgaggggcuacuucaagauucggucggggaaaucuuccaucaugcgcucagacgcgcccauaggaaaguguaauagugaaugcauuacgccuaacggcagcaucccaaaugacaagcccuuucagaacgugaaucgaaucacuuauggugcauguccuagauacgucaaacaauccacacugaaacuugccaccgggaugaggaacgugccagagaagcagacucggggaauuuucggcgcuaucgccggcuuuauugaaaaugggugggagggaaugguggaugguugguauggcuuccgucaccagaacucugaggggcgcggacaagcagcugaccuuaagagcacacaggccgcgauagaucagaucaauggcaaauugaacagacucauugguaagaccaaugaaaaauuccaccagaucgagaaggaauuuucagaggucgaagggaggauccaagaccuggagaaguacguugaggauacgaaaauugacuuauggaguuauaacgccgaacugcucguggcacuugagaaccagcauaccauagaucuggcugacuccgaaaugaauaaguuguucgagaaaacaaagaaacagcuacgggaaaacgccgaggauaugggcaauggaugcuuuaagaucuaccacaagugugacaacgcuugcauuggcagcauccgaaaugggacuuauaaccaugauguauaccgcgacgaggcccugaauaacagauuccagauuaaaggaguggaacucaagucugguuacaaagacuggauccuguggauaucauuugcaaucaguugcuuccuucugugugucgccuugcucggcuuuauuaugugggcuugccaaaaggggaauaucagguguaacauuugcaucuga

SEQ ID NO: 132896 - RNA, 1701 nt, Artificial Sequence; identical to SEQ ID NO: 128998
  derived and/or modified sequence opt3 from hemagglutinin__InfluenzaA__AHC61895

SEQ ID NO: 132897 - RNA, 1701 nt, Artificial Sequence; identical to SEQ ID NO: 128998
  derived and/or modified sequence opt3 from hemagglutinin__InfluenzaA__AHC61907

SEQ ID NO: 132898 - RNA, 1701 nt, Artificial Sequence
  derived and/or modified sequence opt3 from hemagglutinin__InfluenzaA__AHC61931
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcugccggccguauuacugugagcaccaagagaucucagcaggcgguaaucccaaauauaggguccaggccccggguucgcaacauuccuucaagagugagcaucuauuggacaauugucaaaccaggagacauccugcuaaucaauaguaccgguaaccucauugcaccgaggggcuacuucaagauacggucugggaaauccagcaucaugcgcucggaugcccccauuggaaaguguaauucugcuugcaucacgccuaacggcuccauaccaaaugacaagcccuuucagaacgugaaucgaauuacuuacggugccuguccuagauaugugaaacaaaacacacugaaacuugcaaccgggaugaggaaugucccagaaaagcagacucggggaaucuucggcgcuaucgccggcuuuauugagaacgggugggaaggaaugguugacgguugguacggcuuccgucaccaaaauucagaggggcgcggacaggcggccgaucugaagaguacacaggcagcuaucgaccagauuaacggcaaauugaacagacucauagguaagaccaaugagaaauuccaucagaucgaaaaggaguuuagcgaaguggaggggaggauucaagaucuggaaaaguauguagaggacacgaaaaucgauuuaugguccuacaacgccgagcugcucguggcucuugaaaaucagcacaccaucgaccugacagauucugagaugaacaaguuguucgaaaagacuaagaaacagcuacgggagaaugccgaagacaugggcaacggaugcuuuaagauuuaucauaagugugauaaugcaugcauaggcagcauccgaaacgggaccuacgaccacgaugucuaucgcgacgaggcccugaauaacagauuccagauuaaaggaguggagcucaagucagguuacaaaggcuggauccuguggauuaguuuugcuaucuccugcuuccuucuguguguugcguugcucggguuuauaaugugggcaugccaaaagggaaauaucagguguaacauuugcaucuga

SEQ ID NO: 132899 - RNA, 1701 nt, Artificial Sequence; identical to SEQ ID NO: 129798
  derived and/or modified sequence opt3 from hemagglutinin__InfluenzaA__AHC61943

SEQ ID NO: 132900 - RNA, 1701 nt, Artificial Sequence; identical to SEQ ID NO: 131090
  derived and/or modified sequence opt3 from hemagglutinin__InfluenzaA__AHC61955

SEQ ID NO: 132901 - RNA, 1701 nt, Artificial Sequence; identical to SEQ ID NO: 129798
  derived and/or modified sequence opt3 from hemagglutinin__InfluenzaA__AHC61967

SEQ ID NO: 132902 - RNA, 1701 nt, Artificial Sequence; identical to SEQ ID NO: 128871
  derived and/or modified sequence opt3 from hemagglutinin__InfluenzaA__AHC61979

SEQ ID NO: 132903 - RNA, 1701 nt, Artificial Sequence; identical to SEQ ID NO: 128998
  derived and/or modified sequence opt3 from hemagglutinin__InfluenzaA__AHC61991

SEQ ID NO: 132904 - RNA, 1701 nt, Artificial Sequence; identical to SEQ ID NO: 132709
  derived and/or modified sequence opt3 from hemagglutinin__InfluenzaA__AHC62003

SEQ ID NO: 132905 - RNA, 1701 nt, Artificial Sequence; identical to SEQ ID NO: 129798
  derived and/or modified sequence opt3 from hemagglutinin__InfluenzaA__AHC62015

SEQ ID NO: 132906 - RNA, 1701 nt, Artificial Sequence; identical to SEQ ID NO: 131090
  derived and/or modified sequence opt3 from hemagglutinin__InfluenzaA__AHC62027

SEQ ID NO: 132907 - RNA, 1701 nt, Artificial Sequence
  derived and/or modified sequence opt3 from hemagglutinin__InfluenzaA__AHC62039
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggggauccaauaacucauuuuucagucgccugaauuggcucacucacuuaaacuuuaaguacccagcacugaacgugaccaugcccaauaacgagcaguucgauaaacuuuauauuuggggcguccaucacccuggcacagacaaggaucagaucuuuuuguacgcccaagcuagcgggcgaauuacugugucuaccaagcguucccagcaggccguaaucccaaauauaggaucaagacccaggguucggaacauuccuagccgcgugaguaucuauuggacaauugucaaaccaggugacauccugcuaaucaauucuaccggcaaccucauugcgccgagaggguacuucaagauaagguccggaaaaagcucgaucaugaagucugaugcacccauuggcaaguguaauuccgccugcaucacgccuaacgguucaauaccaaaugacaaacccuuucagaacgugaaucggauuacuuacggggcuuguccucgcuaugugaagcaaaacacacugaaacuugccaccggaaugcgaaaugucccagaaaagcagacuagaggcaucuucggcgcaaucgcuggguuuauugagaacggaugggaagguaugauggacggcugguacggguucaggcaccagaauagugagggacggggccaagccgcggaucugaaaagcacacaggccgcaaucgaccagauuaacgguaaguugaaccgucucauagggaaaaccaaugagaaguuccaucagaucgaaaaggaguuuuccgaaguugagggccgcauucaagaucuggaaaaauauguggaggacacgaagaucgauuuauggucuuacaacgcugagcugcucguagcccuugaaaaucagcacaccaucgaccugacagauagcgagaugaacaaauuguucgaaaagacuaaaaagcagcuaagagagaaugcugaagacaugggaaacggcugcuuuaagauuuaucauaaaugugauaaugccugcauagggucaaucaggaacggaaccuacgaccacgauguguaucgggacgaggcacugaauaaccgauuccagauuaagggugucgagcucaaaaguggcuacaaggacuggauccuguggauuuccuuugccaucagcugcuuccuucuguguguggcuuugcucggguuuauaaugugggcgugccaaaaaggaaauauccgcuguaacauuugcaucuga

SEQ ID NO: 132908 - RNA, 1701 nt, Artificial Sequence
  derived and/or modified sequence opt3 from hemagglutinin__InfluenzaA__AHC62050
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuggcacagacaaagaucagaucuuuuuguacgcccaagcuagcggccguauuacugugucuaccaagagaucccagcaggccguaaucccaaauauagggucaaggccccggguucgcaacgugccuagcagagucaguauuuauuggacaaucgugaaaccaggagacauucugcuaaucaauucuaccgguaaccucaucgcgccgaggggcuacuucaagauucgguccgggaaaagcucgauaaugcgcucugaugcacccaucggaaaguguaauuccgccugcauuacgccuaacggcucaaucccaaaugacaagcccuuucagaacgugaaucgaauaacuuacggugcuuguccuagauaugucaaacaaaacacacugaaacuugccaccgggaugaggaauguuccagaaaaacagacucggggaauuuucggcgcaaucgcuggcuuuaucgagaacgggugggaaggaaugguggacgguugguacggcuuccgucaccagaauagugaggggcgcggacaagccgcggaucuuaagagcacacaggccgcaauugaccagaucaacggcaaauugaacagacucauugguaagaccaaugagaaauuccaucagauagaaaaggaguuuuccgaaguagaggggaggauccaagaucuggaaaaguauguggaggacacgaaaauugauuuauggucuuacaacgcugagcugcucgucgcccuugaaaaucagcacaccaucgaccugacagauagcgagaugaacaaguuguucgaaaagacuaagaaacagcuacgggagaaugcugaagacaugggcaacggaugcuuuaagaucuaucauaagugugauaaugccugcauuggcucaauacgaaacgggaccuacgaccacgauguguaucgcgacgaggcacugaauaacagauuccagaucaaaggaguugagcucaagagugguuacaaagacuggauucuguggaucuccuuugccauuagcugcuuccuucuguguguggcuuugcucggcuuuaucaugugggcgugccaaaaggggaauauaagguguaacaucugcauuuga

SEQ ID NO: 132909 - RNA, 1701 nt, Artificial Sequence; identical to SEQ ID NO: 131090
  derived and/or modified sequence opt3 from hemagglutinin__InfluenzaA__AHC62062

SEQ ID NO: 132910 - RNA, 1701 nt, Artificial Sequence
  derived and/or modified sequence opt3 from hemagglutinin__InfluenzaA__AHC62074
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaauuuuaaguauccagcacugaacgugaccaugcccaacaaugagcaguucgacaaacuuuacauuuggggaguccaccauccuggcacagauaaggaccagaucuuuuuguaugcccaagcuagcggccguauuacugugucuaccaagagaaaccagcaggccguaaucccaaauauaggguccaggccccggguucgcaacauuccuucaagaaucagcauuuacuggacaaucgugaaaccaggagauauccugcuaauuaauaguaccgguaaccucauagcgccgaggggcuacuucaagauccggucugggaaauccagcauuaugcgcucggacgcacccaucggaaaguguaauucugaaugcauaacgccuaacggcuccauuccaaaugacaagcccuuucagaacgucaaucgaaucacuuauggugccuguccuagauacgugaaacaaaacacacugaaacuugcuaccgggaugaggaaugugccagagaagcagacucggggaaucuucggcgccauugcaggcuuuaucgaaaacgggugggagggaauggucgaugguugguauggcuuccgucaccaaaauucagaggggcgcggacaggcugccgaccugaagaguacacaggcggccauugaucagauaaacggcaaauugaacagacucaucgguaagaccaaugaaaaauuccaccagauugagaaggaauuuagcgagguugaagggaggauccaagaccuggagaaguacguggaggauacgaaaaucgacuuaugguccuauaacgcagaacugcucguagcucuugagaaucagcauaccauugaucugacagacucugaaaugaacaaguuguucgagaaaacuaagaaacagcuacgggaaaaugccgaggauaugggcaacggaugcuuuaagauauaccacaagugugacaaugcuugcaucggcagcauucgaaacgggaccuauaaucaugauguguaccgcgacgaggcccugaacaauagauuccagaucaaaggagucgaacucaagucagguuacaaagacuggauucuguggaucaguuuugcaauauccugcuuccuucuguguguggccuugcucggcuuuaucaugugggcuugccaaaaggggaacauuagguguaauaucugcauuuga

SEQ ID NO: 132911 - RNA, 1701 nt, Artificial Sequence; identical to SEQ ID NO: 128871
  derived and/or modified sequence opt3 from hemagglutinin__InfluenzaA__AHC62086

SEQ ID NO: 132912 - RNA, 1701 nt, Artificial Sequence; identical to SEQ ID NO: 129798
  derived and/or modified sequence opt3 from hemagglutinin__InfluenzaA__AHC62098

SEQ ID NO: 132913 - RNA, 1701 nt, Artificial Sequence; identical to SEQ ID NO: 128871
  derived and/or modified sequence opt3 from hemagglutinin__InfluenzaA__AHC62110

SEQ ID NO: 132914 - RNA, 1701 nt, Artificial Sequence
  derived and/or modified sequence opt3 from hemagglutinin__InfluenzaA__AHC62122
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaaaugguacagucuucaaguacaggugagauuugcaauagcccacaccagauccuggacggcgaaaacuguacccuaauagaugcucuccugggggacccgcagugcgauggauuucaaaauaaaaagugggaccuuuucguggagagauccaaagcccauucuaacuguuaucccuacgaugucccugacuaugcaucgcugaggucauugguggccagcaguggcacucucgaauuuaauaacgaguccuucaauuggacagguguuacccagaacgggacgucuagcgcuugcauccggggauccaauaacucauuuuucagucgccugaauuggcugacucacagcaacuuuaaguacccagcacucaacgugaccaugcccaauaacgagcaguucgauaaguuauauauuuggggcguccaucacccuggcacagacaaagaucagaucuuucuguacgcccaggcuucugggcgaauuacuguguccaccaagcguucacaacaggccguaaucccaaauauaggaagcagacccaggguucggaacauuccuagucgcgugucuaucuauuggacaauugucaaaccaggugacauccuuuugaucaauuccaccggcaaccugauugcgccgagaggguacuucaagauaaggagcggaaaaucgucuaucaugcgguccgaugcacccauuggcaaguguaauucagccugcaucacgccuaacgguaguauaccaaaugacaagcccuuucagaacgugaaucgcauuacuuacggggcuuguccucgauaugugaaacaaaacacacuaaagcucgccaccggaaugagaaaugucccagaaaaacagacuaggggcaucuucggcgcaaucgcuggguuuauugagaacggaugggaagguaugguugacggcugguacggguuccggcaccagaauagcgagggacguggccaagccgcggaucugaaguccacacaggccgcaaucgaccagauuaacgguaaacuuaaccgccugauagggaagaccaaugagaaauuccaucagaucgaaaaggaguuuucugaaguggagggcaggauucaagauuuggaaaaguauguagaggacacgaaaaucgaucucuggagcuacaacgcugagcuguuaguggcccuggaaaaucagcacaccaucgaccucacagauucagagaugaacaaacuuuucgaaaagacuaagaaacagcugagagagaaugcugaagacaugggaaacggcugcuuuaagauuuaucauaagugugauaaugccugcauagggaguauccggaacggaaccuacgaccacgaugucuaucgagacgaggcauugaauaaccgcuucagaauuaaagguguggagcuaaaguccggcuacaaagacuggauccuguggauuagcuuugccaucucuugcuuccuccuguguguugcgcuucugggguuuauaaugugggcuugccagaagggaaauaucagguguaacauuugcaucuga

SEQ ID NO: 132915 - RNA, 1701 nt, Artificial Sequence; identical to SEQ ID NO: 128871
  derived and/or modified sequence opt3 from hemagglutinin__InfluenzaA__AHC62134

SEQ ID NO: 132916 - RNA, 1701 nt, Artificial Sequence
  derived and/or modified sequence opt3 from hemagglutinin__InfluenzaA__AHC62146
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagccuauucuaacuguuaccccuaugaugucccugacuacgcaucguugaggucacucguggccagcaguggcacucuggaauuuaauaacgaguccuucaauuggacagguguuacccagaacgggacgucuagcgcuugcauccggcgcuccaauucaaguuucuuuagccgacugaacuggcucacucauuuaaauuuuaaguauccagcacugaacgugaccaugcccaacaaugagcaguucgauaaacuuuacauuuggggaguccaccauccuggcacagacaaggaucagaucuuuuuguaugcccaaucuuccggccguauuacugugucaaccaagagaagccagcaggcuguaaucccaaacauagggaguaggccccggauucgcaauaucccuucuagaauuuccaucuacuggacaaucguuaaaccaggagacauucugcuaauaaacagcaccgguaaucucaucgccccgaggggcuacuucaagauucggucggggaaaucuuccaucaugcgcucagaugcgcccauaggaaaguguaacagugaaugcauuacgccuaauggcagcaucccaaacgacaagcccuuucagaaugugaaccgaaucacuuauggugcauguccuagauacgucaaacaauccacacugaaacuugccaccgggaugaggaaugugccagagaagcagacucggggaauuuucggcgcuaucgccggcuuuauugaaaacgggugggagggaaugguggacgguugguauggcuuccgucaccagaauuacgaggggcgcggacaagcagcugaucugaagucuacacaggccgcgauagaccagaucaacggcaaauugaauagacucauugguaagaccaacgaaaaauuccaccagaucgagaaggaauuuagcgaggucgaagggaggauccaagaucuggagaaguauguugaggacacgaaaauugauuuauggucauacaacgccgaacugcucguggcacuugagaaucagcauaccauagaccugacagauagugaaaugaacaaguuguucgagaaaacuaagaaacagcuacgggaaaaugcugaggacaugggcaacggaugcuuuaagaucuaucacaagugugauaaugccugcauuggcuccauccgaaacgggaccuacaaucaugacguauaccgcgaugaggcucugaacaauagauuccagauuaaaggaguggaacucaagagcgguuauaaagacuggauccuguggauaucuuuugccaucucaugcuuccuucugugugucgcauugcucggcuuuauuaugugggccugccaaaaggggaacaucagguguaauauuugcaucuga

SEQ ID NO: 132917 - RNA, 1701 nt, Artificial Sequence; identical to SEQ ID NO: 128998
  derived and/or modified sequence opt3 from hemagglutinin__InfluenzaA__AHC62158

SEQ ID NO: 132918 - RNA, 1701 nt, Artificial Sequence
  derived and/or modified sequence opt3 from hemagglutinin__InfluenzaA__AHC62170
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggggauccaauaacucauuuuucagucgccugaauuggcucacucacuuaaacuuuaaguacccagcacugaacgugaccaugcccaauaacgagcaguucgauaagcuguauauuuggggcguccaucacccuggcacagacaaagaucagaucuuuuuguacgcccaagcuagcgggcgaauuacugugucuaccaagcguucccagcaggccguaaucccaaauauaggaucaagacccaggguucggaacauuccuagccgcgugaguaucuauuggacaauugucaaaccaggugacauccugcuaaucaauucuaccggcaaccucauugcgccgagaggguacuucaagauaagguccggaaaaagcucgaucaugcggucugaugcacccauuggcaaguguaauuccgccugcaucacgccuaacgguucaauaccaaaugacaagcccuuucagaacgugaaucgcauuacuuacggggcuuguccucgauaugugaaacaaaacacacugaaacuugccaccggaaugagaaaugucccagaaaaacagacuaggggcaucuucggcgcaaucgcuggguuuauugagaacggaugggaagguaugauggacggcugguacggguuccggcaccagaauagugagggacguggccaagccgcggaucuuaagagcacacaggccgcaaucgaccagauuaacgguaaauugaaccgccucauagggaagaccaaugagaaauuccaucagaucgaaaaggaguuuuccgaaguugagggcaggauucaagaucuggaaaaguauguggaggacacgaaaaucgauuuauggucuuacaacgcugagcugcucguagcccuugaaaaucagcacaccaucgaccugacagauagcgagaugaacaaguuguucgaaaagacuaagaaacagcuaagagagaaugcugaagacaugggaaacggcugcuuuaagauuuaucauaagugugauaaugccugcauagggucaauccggaacggaaccuacgaccacaauguguaucgagaugaggcacugaacaaucgcuuccagauuaaaggugucgagcucaagaguggcuacaaagacuggauccuguggauuuccuuugccaucagcugcuuccuucuguguguggcuuugcucggguuuauaaugugggcgugccaaaagggaaacaucagauguaauauuugcaucuga

SEQ ID NO: 132919 - RNA, 1701 nt, Artificial Sequence; identical to SEQ ID NO: 128871
  derived and/or modified sequence opt3 from hemagglutinin__InfluenzaA__AHC62182

SEQ ID NO: 132920 - RNA, 1701 nt, Artificial Sequence; identical to SEQ ID NO: 131090
  derived and/or modified sequence opt3 from hemagglutinin__InfluenzaA__AHC62194

SEQ ID NO: 132921 - RNA, 1701 nt, Artificial Sequence
  derived and/or modified sequence opt3 from hemagglutinin__InfluenzaA__AHC62206
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaucuggacagguguuacccagaacgggacgucuagcgcuugcauucggcgcuccaauucaaguuucuuuagccgacugaacuggcucacucauuuaaauuuuaaguauccagcacugaacgugaccaugcccaauaacgagcaguucgacaagcuguacaucuggggaguccaccauccuggcacagauaaagaccagauuuuucuuuaugcccaaucuuccggccguaucacugugucaaccaagagaagccagcaggcuguaauaccaaacauugggaguaggccccggauccgcaauauuccuucuagaaucuccaucuacuggacaauuguuaaaccaggagauauacugcuaaucaacagcaccgguaaucucauugccccgaggggcuacuucaagauccggucggggaaaucuuccauaaugcgcucagacgcgcccauuggaaaguguaacagugaaugcaucacgccuaauggcagcaucccaaacgacaagcccuuucagaaugugaaccgaauuacuuauggugcauguccuagauacgucaaacaauccacacugaaguuggccaccgggaugaggaaugugccagagaaacagacucggggaaucuucggcgcuauugccggcuuuauagaaaacgggugggagggaaugguggaugguugguauggcuuccgucaccaaaauucugaggggcgcggacaggcagcugaccuuaagagcacacaggccgcgaucgaucagauuaacggcaaauugaauagacucaucgguaagaccaacgaaaaauuccaccagaucgagaaggaauuuucagaggucgaagggaggauucaagaccuggagaaguacguugaggauacgaaaauagacuuauggaguuauaaugccgaacugcucguggcacuugagaaccagcauaccaucgaucugacagacuccgaaaugaacaaguuguucgagaaaacuaagaaacagcuacgggaaaaugcugaggauaugggcaacggaugcuuuaagauuuaccacaagugugacaaugccugcaucggcagcauucgaaacgggaccuauaaucaugauguauaccgcgacgaggcucugaacaauagauuccagaucaaaggaguggaacucaagucugguuacaaagacuggauacuguggaucucauuugccauuaguugcuuccuucugugugucgcauugcucggcuuuaucaugugggccugccaaaaggggaacauuagguguaauaucugcauauga

SEQ ID NO: 132922 - RNA, 1701 nt, Artificial Sequence; identical to SEQ ID NO: 128998
  derived and/or modified sequence opt3 from hemagglutinin__InfluenzaA__AHC62218

SEQ ID NO: 132923 - RNA, 1701 nt, Artificial Sequence
  derived and/or modified sequence opt3 from hemagglutinin__InfluenzaA__AHC62242
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacaaaauucuucaacaggugagaucugcgacaguccacaccagauacuggauggcgaaaacuguacccuaaucgacgcucuccugggggauccgcagugcgacggauuucagaauaaaaagugggaucuuuucguggagagaagcaaagccuauuccaacuguuaccccuaugacgucccugauuacgcaucucugaggucguugguggccucaagcggcacucucgaauuuaauaacgagaguuucaauuggacagguguuacccagaacgggacguccucugcuugcauucggcgcagcaauaacuccuuuuucucacgacugaauuggcugacucaucucaacuuuaaguauccagcauuaaacgugaccaugcccaauaacgagcaguucgacaagcuguacaucuggggaguccaccauccuggcacagauaaagaccagauuuuucuuuaugcccaagcuaguggccguaucacugugagcaccaagagaucucagcaggccguaauaccaaauauuggguccaggccccggguucgcaacaucccuucaagaauuagcaucuacuggacaaucgugaaaccaggagauauuuugcugauaaauaguaccgguaaccuaaucgcgccgaggggcuacuucaagauucggucugggaaauccagcaucaugcgcucggacgcacccauaggaaaguguaauucugaaugcauuacgccuaacggcuccaucccaaaugacaagcccuuucagaacgucaaucgaaucacuuauggugccuguccuagauacgugaaacaaaacacacucaagcuggcuaccgggaugaggaaugugccagagaaacagacucggggaauuuucggcgccaucgcaggcuuuauugaaaacgggugggagggaauggucgaugguugguauggcuuccgucaccaaaauucagaggggcgcggacaggcugccgaccuuaagaguacacaggcggccauagaucagaucaacggcaaacugaacagauugauugguaagaccaaugaaaaauuccaccagaucgagaaggaauuuagcgagguugaagggaggauccaagaccucgagaaguacguggaggauacgaaaauugaccugugguccuauaacgcagaauuacugauagcucucgagaaucagcauaccaucgaucuuacagacucugaaaugaacaagcuguucgagaaaacuaagaaacaguugcgggaaaaugccgaggauaugggcaacggaugcuuuaagauuuaccacaagugugacaaugcuugcaucggcagcauucgaaacgggaccuaugaucaugacguauaccgcgacgaggcccuaaauaacagauuccagaucaaaggaguggaacugaagucagguuacaaagauuggauacucuggaucaguuuugcaauuuccugcuuccugcuuugugucgcccuguugggcuuuaucaugugggcuugccaaaaggggaauauuagguguaacaucugcauauga

SEQ ID NO: 132924 - RNA, 1701 nt, Artificial Sequence; identical to SEQ ID NO: 132633
  derived and/or modified sequence opt3 from hemagglutinin__InfluenzaA__AHC62254

SEQ ID NO: 132925 - RNA, 1701 nt, Artificial Sequence; identical to SEQ ID NO: 128998
  derived and/or modified sequence opt3 from hemagglutinin__InfluenzaA__AHC62266

SEQ ID NO: 132926 - RNA, 1701 nt, Artificial Sequence; identical to SEQ ID NO: 132797
  derived and/or modified sequence opt3 from hemagglutinin__InfluenzaA__AHC62278

SEQ ID NO: 132927 - RNA, 1701 nt, Artificial Sequence
  derived and/or modified sequence opt3 from hemagglutinin__InfluenzaA__AHC62290
augaagaccaucauugcccugagcuacauacucugccuuaucuucgcucagaaacugcccggcaacgacaauuccacagcaacuuuguguuuagggcaccaugccgugccuaacggaacgauugucaagaccaucacaaaugaucaaauugagguuacuaacgcgaccgaacuggugcagucuucaaguacaggugagaucugcaauagcccacaccagauacuagacggcgaaaacuguacccucaucgaugcucugcuuggggacccgcagugcgauggauuucaaaauaaaaagugggaccuguucguagagagauccaaagcccauucuaacuguuaucccuacgaugugccugacuaugcaucguugaggucacucgucgccagcaguggcacucuggaauuuaauaacgaguccuucaauuggacaggugugacccagaacgggacgucuagcgcuugcauucggcgcuccaauaacucauuuuucagucgacugaauuggcucacucacuuaaacuuuaaguacccagcacugaacguuaccaugcccaauaacgagcaguucgauaagcuguauaucuggggagugcaucacccuggcacagacaaagaucagaucuuuuuguacgcccaagcuagcggccguauuacugucucuaccaagagaucccagcaggccgugauaccaaauauugggucaaggccccggguacgcaacaucccuagcagaguuaguauuuauuggacaaucgugaaaccaggagacauccugcuaauuaauucuaccgguaaccucauagcgccgaggggcuacuucaagauccgguccgggaaaagcucgauuaugcgcucugaugcacccaucggaaaguguaauuccgccugcauaacgccuaacggcucaauuccaaaugacaagcccuuucagaacgucaaucgaaucacuuacggugcuuguccuagauaugugaaacaaaacacacugaaacuugccaccgggaugaggaaugugccagaaaaacagacucggggaaucuucggcgcaauugcuggcuuuaucgagaacgggugggaaggaauggucgacgguugguacggcuuccgucaccagaauagugaggggcgcggacaagccgcggaucuuaagagcacacaggccgcaauugaccagauaaacggcaaauugaacagacucaucgguaagaccaaugagaaauuccaucagauugaaaaggaguuuuccgaaguugaggggaggauccaagaucuggaaaaguauguggaggacacgaaaaucgauuuauggucuuacaacgcugagcugcucguagcccuugaaaaucagcacaccauugaccugacagauagcgagaugaacaaguuguucgaaaagacuaagaaacagcuacgggagaaugcugaagacaugggcaacggaugcuuuaagauauaucauaagugugauaaugccugcaucggcucaauucgaaacgggaccuacgaccacgauguguaucgcgacgaggcacugaauaacagauuccagaucaaaggagucgagcucaagagugguuacaaagacuggauucuguggaucuccuuugccauaagcugcuuccuucuguguguggcuuugcucggcuuuaucaugugggcgugccaaaaggggaauauuagguguaacaucugcauuuga

SEQ ID NO: 132928 - RNA, 1701 nt, Artificial Sequence
  derived and/or modified sequence opt3 from hemagglutinin__InfluenzaA__AHC62302
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcugccggccguauuacugugagcaccaagagaucucagcaggcgguaaucccaaauauaggguccaggccccggguucgcaacauuccuucaagagugagcaucuauuggacaauugucaaaccaggagacauccugcuaaucaauaguaccgguaaccucauugcaccgaggggcuacuucaagauacggaaugggaaaucuuccaucaugcgcagcgaugcccccauuggaaaguguaacucggcuugcaucacgccuaauggcucuauaccaaacgacaagcccuuucagaaugugaaccgaauuacuuacggugccuguccuagauaugugaaacaaaauacacugaaacuugcaaccgggaugaggaacgucccagaaaagcagacucggggaaucuucggcgcuaucgccggcuuuauugagaaugggugggaaggaaugguugacgguugguacggcuuccgucaccagaacuccgaggggcgcggacaagcggccgaucugaagucaacacaggcagcuaucgaccagauuaacggcaaauugaauagacucauagguaagaccaacgagaaauuccaucagaucgaaaaggaguuuagugaaguggaggggaggauucaagaucuggaaaaguauguagaggacacgaaaaucgauuuauggagcuacaaugccgagcugcucguggcucuugaaaaccagcacaccaucgaccugacagauuccgagaugaauaaguuguucgaaaagacuaagaaacagcuacgggagaacgccgaagacaugggcaauggaugcuuuaagauuuaucauaagugugauaacgcaugcauaggcucuauccgaaaugggaccuacgaccacgaugucuaucgcgacgaggcccugaacaauagauuccagauuaaaggaguggagcucaagagcgguuacaaagacuggauccuguggauuucauuugcuaucaguugcuuccuucuguguguugcguugcucggcuuuauaaugugggcaugccaaaaggggaacaucagguguaauauuugcaucuga

SEQ ID NO: 132929 - RNA, 1701 nt, Artificial Sequence
  derived and/or modified sequence opt3 from hemagglutinin__InfluenzaA__AHC62314
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcgaaaacuguacccucauagacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcauccggcgcagcaauaacuccuuuuucucacgacugaauuggcucacucauuuaaacuuuaaguauccagcacugaacgugaccaugcccaauaacgagcaguucgacaaacuuuacauuuggggaguccaccauccuggcacagauaaggaccagaucuuuuuguaugcccaagcuaguggccguauuacugugagcaccaagagaucucagcaggccguaaucccaaauauaggguccaggccccggguucgcaacauuccuucaagaaucagcauuuacuggacaaucgugaaaccaggagauauccugcuaauuaauaguaccgguaaccucauagcgccgaggggcuacuucaagauccggucugggaaauccagcauuaugcgcucggacgcacccaucggaaaguguaauucugaaugcauaacgccuaacggcuccauuccaaaugacaagcccuuucagaacgucaaucgaaucacuuauggugccuguccuagauacgugaaacaaaacacacugaaacuugcuaccgggaugaggaaugugccagagaagcagacucggggaaucuucggcgccauugcaggcuuuaucgaaaacgggugggagggaauggucgaugguugguauggcuuccgucaccaaaauucagaggggcgcggacaggcugccgaccugaagaguacacaggcggccauugaucagauaaacggcaaauugaacagacucaucgguaagaccaaugaaaaauuccaccagauugagaaggaauuuagcgagguugaagggaggauccaagaccuggagaaguacguggaggauacgaaaaucgacuuaugguccuauaacgcagaacugcucguagcucuugagaaucagcauaccauugaucugacagacucugaaaugaacaaguuguucgagaaaacuaagaaacagcuacgggaaaaugccgaggauaugggcaacggaugcuuuaagauauaccacaagugugacaaugcuugcaucggcagcauucgaaacgggaccuaugaucaugacguguaccgcgacgaggcccugaauaacagauuccagaucaggggagucgaacucaaaucagguuacaaggauuggauucuguggaucaguuuugcaauauccugcuuccuucuguguguggccuugcucggcuuuaucaugugggcuugccaaaaagggaauauucgguguaacaucugcauuuga

SEQ ID NO: 132930 - RNA, 1701 nt, Artificial Sequence; identical to SEQ ID NO: 132794
  derived and/or modified sequence opt3 from hemagglutinin__InfluenzaA__AHC62326

SEQ ID NO: 132931 - RNA, 1701 nt, Artificial Sequence; identical to SEQ ID NO: 129798
  derived and/or modified sequence opt3 from hemagglutinin__InfluenzaA__AHC62338

SEQ ID NO: 132932 - RNA, 1701 nt, Artificial Sequence; identical to SEQ ID NO: 128871
  derived and/or modified sequence opt3 from hemagglutinin__InfluenzaA__AHC62350

SEQ ID NO: 132933 - RNA, 1701 nt, Artificial Sequence; identical to SEQ ID NO: 129798
  derived and/or modified sequence opt3 from hemagglutinin__InfluenzaA__AHC62362

SEQ ID NO: 132934 - RNA, 1701 nt, Artificial Sequence; identical to SEQ ID NO: 129798
  derived and/or modified sequence opt3 from hemagglutinin__InfluenzaA__AHC62374

SEQ ID NO: 132935 - RNA, 1701 nt, Artificial Sequence; identical to SEQ ID NO: 132797
  derived and/or modified sequence opt3 from hemagglutinin__InfluenzaA__AHC62386

SEQ ID NO: 132936 - RNA, 1701 nt, Artificial Sequence; identical to SEQ ID NO: 128871
  derived and/or modified sequence opt3 from hemagglutinin__InfluenzaA__AHC62398

SEQ ID NO: 132937 - RNA, 1701 nt, Artificial Sequence
  derived and/or modified sequence opt3 from hemagglutinin__InfluenzaA__AHC62410
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuggcacagacaaagaucagaucuuuuuguacgcccaagcuagcggccguauuacugugucuaccaagagaucccagcaggccguaaucccaaauauagggucaaggccccggguucgcaacauuccuagcagagugaguaucuauuggacaauugucaaaccaggagacauccugcuaaucaauucuaccgguaaccucauugcgccgaggggcuacuucaagauacgguccgggaaaagcucgaucauucgcucugaugcacccaucggaaaguguaauuccgccugcauaacgccuaacggcucaauuccaaaugacaagcccuuucagaacgugaaucgaaucacuuacggugcuuguccuagauaugugaaacaaaacacacugaaacuugccaccgggaugaggaaugucccagaaaaacagacucggggaaucuucggcgcaauugcuggcuuuaucgagaacgggugggaaggaaugguugacgguugguacggcuuccgucaccagaauagugaggggcgcggacaagccgcggaucuuaagagcacacaggccgcaauugaccagauaaacggcaaauugaacagacucaucgguaagaccaaugagaaauuccaucagauugaaaaggaguuuuccgaaguggaggggaggauccaagaucuggaaaaguauguagaggacacgaaaaucgauuuauggucuuacaacgcugagcugcucguggcccuugaaaaucagcacaccauugaccugacagauagcgagaugaacaaguuguucgaaaagacuaagaaacagcuacgggagaaugcugaagacaugggcaacggaugcuuuaagauauaucauaagugugauaaugccugcaucggcucaauucgaaacgggaccuacgaccacgaugucuaucgcgacgaggcacugaauaacagauuccagaucaaaggaguggagcucaagagugguuacaaagacuggauucuguggaucuccuuugccauaagcugcuuccuucuguguguugcuuugcucggcuuuaucaugugggcgugccaaaaggggaauauuagguguaacaucugcauuuga

SEQ ID NO: 132938 - RNA, 1701 nt, Artificial Sequence; identical to SEQ ID NO: 132740
  derived and/or modified sequence opt3 from hemagglutinin__InfluenzaA__AHC62422

SEQ ID NO: 132939 - RNA, 1701 nt, Artificial Sequence
  derived and/or modified sequence opt3 from hemagglutinin__InfluenzaA__AHC62434
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcugccggccguauuacugugagcaccaagagaucucagcaggcgguaaucccaaauauaggguccaggccccggguucgcaacauuccuucaagagugagcaucuauuggacaauugucaaaccaggagacauccugcuaaucaauaguaccgguaaccucauugcaccgaggggcuacuucaagauacagucugggaaauccagcaucaugcggucggaugcccccauuggaaaguguaauucugcuugcaucacgccuaacggcuccauaccaaaugacaagcccuuucaaaacgugaaucgcauuacuuacggugccuguccucgauaugugaaacagaacacacugaaacuugcaaccgggaugagaaaugucccagaaaagcagacuaggggaaucuucggcgcuaucgccggcuuuauugagaacgggugggaaggaaugguugacgguugguacggcuuccggcaccaaaauucagaggggcguggacaggcggccgaucugaagaguacacaggcagcuaucgaccagauuaacggcaaauugaaccgccucauagguaagaccaaugagaaauuccaucaaaucgaaaaggaguuuagcgaaguggaggggaggauucaggaucuggaaaaguauguagaggacacgaaaaucgauuuaugguccuacaacgccgagcugcucguggcucuugaaaaucagcacaccaucgaccugacagauucugagaugaacaaguuguucgaaaagacuaagaaacagcuaagagagaaugccgaagacaugggcaacggaugcuuuaagauuuaucauaagugugauaaugcaugcauaggcagcauccggaacgggaccuacgaccacgaugucuaucgagacgaggcccugaauaaccgcuuccaaauuaaaggaguggagcucaagucagguuacaaagacuggauccuguggauuaguuuugcuaucuccugcuuccuucuguguguugcguugcucggcuuuauaaugugggcaugccagaaggggaauaucagauguaacauuugcaucuga

SEQ ID NO: 132940 - RNA, 1701 nt, Artificial Sequence; identical to SEQ ID NO: 128871
  derived and/or modified sequence opt3 from hemagglutinin__InfluenzaA__AHC62446

SEQ ID NO: 132941 - RNA, 1701 nt, Artificial Sequence; identical to SEQ ID NO: 128998
  derived and/or modified sequence opt3 from hemagglutinin__InfluenzaA__AHC62458

SEQ ID NO: 132942 - RNA, 1701 nt, Artificial Sequence
  derived and/or modified sequence opt3 from hemagglutinin__InfluenzaA__AHC62470
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcgaaaacuguacccucauagacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcauccggcgcagcaauaacuccuuuuucucacgacugaauuggcucacucauuuaaacuuuaaguauccagcacugaacgugaccaugcccaauaacgagcaguucgacaaacuuuacauuuggggaguccaccauccuggcacagauaaggaccagaucuuuuuguaugcccaagcuaguggccguauuacugugagcaccaagagaucucagcaggccguaaucccaaauauaggguccaggccccggguucgcaacauuccuucaagaaucagcauuuacuggacaaucgugaaaccaggagauauccugcuaauuaauaguaccgguaaccucauagcgccgaggggcuacuucaagauccggucugggaaauccagcauuaugcgcucggacgcacccaucggaaaguguaauucugaaugcauaacgccuaacggcuccauuccaaaugguaagcccuuucagaacgucaaucgaaucacuuauggggccuguccuagauacgugaaacaaaacacacugaaacuugcuaccggaaugaggaaugugccagagaagcagacucggggcaucuucggcgccauugcaggguuuaucgaaaacggaugggaggguauggucgacggcugguauggguuccgucaccaaaauucagagggacgcggccaggcugccgaucugaagaguacacaggcggccauugaccagauaaacgguaaauugaacagacucaucgggaagaccaaugaaaaauuccaccagauugagaaggaauuuagcgagguugaaggcaggauccaagaucuggagaaguacguggaggacacgaaaaucgauuuaugguccuauaacgcagaacugcucguagcucuugagaaucagcauaccauugaccugacagauucugaaaugaacaaguuguucgagaaaacuaagaaacagcuacgggaaaaugccgaggacaugggaaacggcugcuuuaagauauaccacaagugugauaaugcuugcaucgggagcauucgaaacggaaccuaugaccaugauguguaccgcgacgaggcccugaauaacagauuccagaucaaaggugucgaacucaagucaggcuacaaagacuggauucuguggaucaguuuugcaauauccugcuuccuucuguguguggccuugcucggguuuaucaugugggcuugccaaaagggaaauauuagguguaacaucugcauuuga

SEQ ID NO: 132943 - RNA, 1701 nt, Artificial Sequence; identical to SEQ ID NO: 132695
  derived and/or modified sequence opt3 from hemagglutinin__InfluenzaA__AHC62482

SEQ ID NO: 132944 - RNA, 1701 nt, Artificial Sequence; identical to SEQ ID NO: 128871
  derived and/or modified sequence opt3 from hemagglutinin__InfluenzaA__AHC62506

SEQ ID NO: 132945 - RNA, 1701 nt, Artificial Sequence; identical to SEQ ID NO: 128998
  derived and/or modified sequence opt3 from hemagglutinin__InfluenzaA__AHC62518

SEQ ID NO: 132946 - RNA, 1701 nt, Artificial Sequence
  derived and/or modified sequence opt3 from hemagglutinin__InfluenzaA__AHC62530
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacagucuucaaguacaggugagaucugcaauagcccacaccagauacuggacggcgaaaacuguacccuaaucgaugcucuccugggggacccgcagugcgauggauuucaaaauaaaaagugggaccuuuucguggagagauccaaagcccauucuaacuguuaucccuacgaugucccugacuaugcaucgcugaggucauugguggccagcaguggcacucucgaauuuaauaacgaguccuucaauuggacagguguuacccagaacgggacgucuagcgcuugcauucggcgcuccaauaacucauuuuucagucgacugaauuggcugacucaccucaacuuuaaguacccagcauuaaacgugaccaugcccaauaacgagcaguucgauaagcuguauaucuggggaguccaucacccuggcacagacaaagaucagauuuuucuuuacgcccaagcuagcggccguaucacugugucuaccaagagaucccagcaggccguaauaccaaauauugggucaaggccccggguucgcaacaucccuagcagagugaguauuuauuggacaaucgucaaaccaggagacaucuugcugauuaauucuaccgguaaccuaauagcgccgaggggcuacuucaagauccgguccgggaaaagcucgauuaugcgcucugaugcacccaucggaaaguguaauuccgccugcauaacgccuaacggcucaauuccaaaugacaagcccuuucagaacgugaaucgaaucacuuacggugcuuguccuagauaugugaaacaaaacacacucaagcuggccaccgggaugaggaaugucccagaaaaacagacucggggaaucuucggcgcaauugcuggcuuuaucgagaacgggugggaaggaaugguugacgguugguacggcuuccgucaccagaauagugaggggcgcggacaagccgcggaucuuaagagcacacaggccgcaauugaccagauaaacggcaaacugaacagauugaucgguaagaccaaugagaaauuccaucagauugaaaaggaguuuuccgaaguggaggggaggauccaagaucucgaaaaguauguagaggacacgaaaaucgaucuguggucuuacaacgcugaguuacugguggcccucgaaaaucagcacaccauugaccuuacagauagcgagaugaacaagcuguucgagaaaacuaagaaacaguugcgggaaaaugcugaagacaugggcaacggaugcuuuaagauauaucauaagugugauaaugccugcaucggcucaauucgaaacgggaccuacgaccacgaugucuaucgcgacgaggcacuaaauaacagauuccagaucaaaggaguggagcugaagagugguuacaaagacuggauucucuggaucuccuuugccauaagcugcuuccugcuuuguguugcucuguugggcuuuaucaugugggcgugccaaaaggggaauauuagguguaacaucugcauuuga

SEQ ID NO: 132947 - RNA, 1701 nt, Artificial Sequence; identical to SEQ ID NO: 132667
  derived and/or modified sequence opt3 from hemagglutinin__InfluenzaA__AHC62542

SEQ ID NO: 132948 - RNA, 1701 nt, Artificial Sequence; identical to SEQ ID NO: 128871
  derived and/or modified sequence opt3 from hemagglutinin__InfluenzaA__AHC62554

SEQ ID NO: 132949 - RNA, 1701 nt, Artificial Sequence
  derived and/or modified sequence opt3 from hemagglutinin__InfluenzaA__AHC62566
augaagaccaucauugcccugagcuacauacucugccuuguguucgcucagaaacugcccggcaacgacaauuccacagcaacuuuguguuuagggcaccaugccgucccuaacggaacgaugguuaagaccaucacaaaugaucaaauugaggugacuaacgcgaccgaacugguacaaaauucuucaacaggugagaucugcgacaguccacaccagauucuagauggcgaaaacuguacccucaucgacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcauacggcgcagcaauaacuccuuuuucucacgacugaauuggcucacucauuuaaacuuuaaguauccagcacugaacgugaccaugcccaauaacgagcaguucgacaaguuguacaucuggggaguccaccauccuggcacagauaaagaccagauuuuucuuuaugcccaagcuaguggccguaucacugugagcaccaagagaucucagcaggccguaauuccaaauaucggguccaggccccggguucgcaacauaccuucaagaauuagcaucuacuggacaauugugaaaccaggagauauccugcuaaucaauaguaccgguaaccucauugcgccgaggggcuacuucaagauacggucugggaaauccagcaucaugcgcucggacgcacccauuggaaaguguaauucugaaugcaucacgccuaacggcuccauaccaaaugacaagcccuuucagaacgucaaucgaauuacuuauggugccuguccuagauacgugaaacaaaacacacugaaacuugcuaccgggaugaggaaugugccagagaagcagacucggggaaucuucggcgccaucgcaggcuuuauugaaaacgggugggagggaauggucgaugguugguauggcuuccgucaccaaaauucagaggggcgcggacaggcugccgaccugaagaguacacaggcggccaucgaucagauuaacggcaaauugaacagacucauagguaagaccaaugaaaaauuccaccagaucgagaaggaauuuagcgagguugaagggaggauucaagaccuggagaaguacguggaggauacgaaaaucgacuuaugguccuauaacgcagaacugcucguagcucuugagaaucagcauaccaucgaucugacagacucugaaaugaacaaguuguucgagaaaacuaagaaacagcuacgggaaaaugccgaggauaugggcaacggaugcuuuaagauuuaccacaagugugacaaugcuugcauaggcagcauccgaaacgggaccuaugaucaugacguguaccgcgacgaggcccugaauaacagauuccagauuaaaggagucgaacucaagucagguuacaaagauuggauccuguggauuaguuuugcaaucuccugcuuccuucuguguguggccuugcucggcuuuauaaugugggcuugccaaaaggggaauaucagguguaacauuugcaucuga

SEQ ID NO: 132950 - RNA, 1701 nt, Artificial Sequence; identical to SEQ ID NO: 128871
  derived and/or modified sequence opt3 from hemagglutinin__InfluenzaA__AHC62578

SEQ ID NO: 132951 - RNA, 1701 nt, Artificial Sequence; identical to SEQ ID NO: 128871
  derived and/or modified sequence opt3 from hemagglutinin__InfluenzaA__AHC62590

SEQ ID NO: 132952 - RNA, 1701 nt, Artificial Sequence; identical to SEQ ID NO: 128998
  derived and/or modified sequence opt3 from hemagglutinin__InfluenzaA__AHC62602

SEQ ID NO: 132953 - RNA, 1701 nt, Artificial Sequence
  derived and/or modified sequence opt3 from hemagglutinin__InfluenzaA__AHC62614
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagaucauagacggcgaaaacuguacccuaaucgaugcucuccugggggacccgcagugcgauggauuucaaaauaaaaagugggaccuuuucguggagagauccaaagcccauucuaacuguuaucccuacgaugucccugacuaugcaucgcugaggucauugguggccagcaguggcacucucgaauuuaauaacgaguccuucaauuggacagguguuacccagaacgggacgucuagcgcuugcauucggggauccaauaacucauuuuucagucgccugaauuggcugacucaccucaacuuuaaguacccagcauuaaacgugaccaugcccaauaacgagcaguucgauaagcuguauaucuggggcguccaucacccuggcacagacaaagaucagauuuuucuuuacgcccaagcuagcgggcgaaucacugugucuaccaagcguucccagcaggccguaauaccaaauauuggaucaagacccaggguucggaacaucccuagccgcgugaguauuuauuggacaaucgucaaaccaggugacaucuugcugauuaauucuaccggcaaccuaauagcgccgagaggguacuucaagaucagguccggaaaaagcucgauuaugcggucugaugcacccaucggcaaguguaauuccgccugcauaacgccuaacgguucaauuccaaaugacaagcccuuucagaacgugaaucgcaucacuuacggggcuuguccucgauaugugaaacaaaacacacucaagcuggccaccggaaugagaaaugucccagaaaaacagacuaggggcaucuucggcgcaauugcuggguuuaucgagaacggaugggaagguaugguugacggcugguacggguuccggcaccagaauagugagggacguggccaagccgcggaucuuaagagcacacaggccgcaauugaccagauaaacgguaaacugaaccgcuugaucgggaagaccaaugagaaauuccaucagauugaaaaggaguuuuccgaaguggagggcagaauccaagaucucgaaaaguauguagaggacacgaaaaucgaucuguggucuuacaacgcugaguuacugguggcccucgaaaaucagcacaccauugaccuuacagauagcgagaugaacaagcuguucgagaaaacuaagaaacaguugagggaaaaugcugaagacaugggaaacggcugcuuuaagauauaucauaagugugauaaugccugcaucgggucaauucggaacggaaccuacgaccacgaugucuaucgagacgaggcacuaaauaaccgcuuccagaucaaagguguggagcugaagaguggcuacaaagacuggauucucuggaucuccuuugccauaagcugcuuccugcuuuguguugcucuguugggguuuaucaugugggcgugccaaaagggaaauauuagauguaacaucugcauuuga

SEQ ID NO: 132954 - RNA, 1701 nt, Artificial Sequence; identical to SEQ ID NO: 132634
  derived and/or modified sequence opt3 from hemagglutinin__InfluenzaA__AHC62626

SEQ ID NO: 132955 - RNA, 1701 nt, Artificial Sequence; identical to SEQ ID NO: 128998
  derived and/or modified sequence opt3 from hemagglutinin__InfluenzaA__AHC62638

SEQ ID NO: 132956 - RNA, 1701 nt, Artificial Sequence; identical to SEQ ID NO: 132798
  derived and/or modified sequence opt3 from hemagglutinin__InfluenzaA__AHC62650

SEQ ID NO: 132957 - RNA, 1701 nt, Artificial Sequence
  derived and/or modified sequence opt3 from hemagglutinin__InfluenzaA__AHC62662
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuucguguuaucccuacgaugucccugacuaugcaucauugaggagccucguggccaguuccggcacucuggaauuuaacaaugagucuuucaacuggacagguguuacccagaaugggacgagcuccgcuugcauccggggaucaaacaauagcuuuuucagucgccugaacuggcucacucacuuaaauuuuaaguacccagcacugaacgugaccaugcccaacaaugagcaguucgauaaacuuuauauuuggggcguccaucacccuggcacagacaaagaucagaucuuuuuguacgcccaggcuucugggcgaauuacuguguccaccaagcguucacaacaggccguaaucccaaacauaggaagcagacccaggguucggaauauuccuagucgcgugucuaucuauuggacaauugucaaaccaggugacauccugcuaaucaacuccaccggcaaucucauugcgccgagaggguacuucaagauaaggagcggaaaaucgucuaucaugcgguccgaugcacccauuggcaaguguaacucagccugcaucacgccuaaugguaguauaccaaacgacaagcccuuucagaaugugaaccgcauuacuuacggggcuuguccucgauaugugaaacaaaauacacugaaacuugccaccggaaugagaaacgucccagaaaagcagacuaggggcaucuucggcgcaaucgcuggguuuauugagaauggaugggaagguaugguugacggcugguacggguuccggcaccagaacagcgagggacguggccaagccgcggaucugaaguccacacaggccgcaaucgaccagauuaaugguaaauugaaccgccucauagggaagaccaacgagaaauuccaucagaucgaaaaggaguuuucugaaguggagggcaggauucaagaucuggaaaaguauguagaggacacgaaaaucgauuuauggagcuacaaugcugagcugcucguggcccuugaaaaccagcacaccaucgaccugacagauucagagaugaauaaguuguucgaaaagacuaagaaacagcuaagagagaacgcugaagacaugggaaauggcugcuuuaagauuuaucauaagugugauaacgccugcauagggaguauccggaauggaaccuacgaccacgaugucuaucgagacgaggcacugaacaaucgcuuccagauuaaagguguggagcucaaguccggcuacaaagacuggauccuguggauuagcuuugccaucucuugcuuccuucuguguguugcuuugcucggguuuauaaugugggcgugccaaaagggaaacaucagauguaauauuugcaucuga

SEQ ID NO: 132958 - RNA, 1701 nt, Artificial Sequence
  derived and/or modified sequence opt3 from hemagglutinin__InfluenzaA__AHC62674
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucaucgccagcaguggcacucuggaauuuaauaacgaguccuucaauuggacaggugugacccagaacgggacgucuagcgcuugcauucggggauccaauaacucauuuuucagucgccugaauuggcucacucacuuaaacuuuaaguacccagcacugaacguuaccaugcccaauaacgagcaguucgauaagcuguauaucuggggcgugcaucacccuggcacagacaaagaucagaucuuuuuguacgcccaagcuagcgggcgaauuacugucucuaccaagcguucccagcaggccgugauaccaaauauuggaucaagacccaggguacggaacaucccuagccgcguuaguauuuauuggacaaucgugaaaccaggugacauccugcuaauuaauucuaccggcaaccucauagcgccgagaggguacuucaagaucagguccggaaaaagcucgauuaugcggucugaugcacccaucggcaaguguaauuccgccugcauaacgccuaacgguucaauuccaaaugacaagcccuuucagaacgucaaucgcaucacuuacggggcuuguccucgauaugugaaacaaaacacacugaaacuugccaccggaaugagaaaugugccagaaaaacagacuaggggcaucuucggcgcaauugcuggguuuaucgagaacggaugggaagguauggucgacggcugguacggguuccggcaccagaauagugagggacguggccaagccgcggaucuuaagagcacacaggccgcaauugaccagauaaacgguaaauugaaccgccucaucgggaagaccaaugagaaauuccaucagauugaaaaggaguuuuccgaaguugagggcagaauccaagaucuggaaaaguauguggaggacacgaaaaucgauuuauggucuuacaacgcugagcugcucguagcccuugaaaaucagcacaccauugaccugacagauagcgagaugaacaaguuguucgaaaagacuaagaaacagcuaagggagaaugcugaagacaugggaaacggcugcuuuaagauauaucauaagugugauaauaccugcaucgagucaauucggaacgggacauacgaccacgauguguaucgagacgaggcccugaauaaccgcuuccagaucaaaggagucgaacucaagagugguuacaaagacuggauucuguggaucuccuuugcaauaagcugcuuccuucuguguguggccuugcucggcuuuaucaugugggcuugccaaaaggggaauauuagauguaacaucugcauuuga

SEQ ID NO: 132959 - RNA, 1701 nt, Artificial Sequence; identical to SEQ ID NO: 132076
  derived and/or modified sequence opt3 from hemagglutinin__InfluenzaA__AHE37972

SEQ ID NO: 132960 - RNA, 1701 nt, Artificial Sequence
  derived and/or modified sequence opt3 from hemagglutinin__InfluenzaA__AHE37973
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcagggacgaaaaguuuuuauaagaaccugaucuggcucgugaaaaagggaaauagcuacccaaaauuaucuaaguccuauauaaacgauaagggcaaagaaguacugguucuuuggggcauccaccaccccucaacuaccgccgaccaacagagcuuguaccagaaugcugaugccuacguguucgucgggacaagucgcuauucuaagaaauuuaagccugagauugcgauccgaccaaaagugcgugaccaggagggaagaauuaacuacuauuggacucugaucgaacccggugauaagauaaccuucgaggcaacaggcaaccuaguggucccuagguacgccuuugcuauggaacggaaugccggguccggaauuaucauuagcgacaccccaguucaugauugcaacacgacuugucaaacaccggagggcgcaaucaauaccucgcuccccuuccagaacauccacccuauuacuauagguaaaugcccaaaguaugugaagucuacaaaacugcgccuugcuaccgggcugagaaauguacccuccauccagucaaggggauuguuuggcgccauugcgggcuucaucgaagggggauggacggguaugguggacggcugguacggguaucaucaccagaacgagcaaggaaguggcuacgccgcagaccucaagagcacccagaaugcuauagauaaaauuacaaacaaggucaauuccgugaucgagaaaaugaacacucaguuuaccgccguugguaaggaguucaaucaccuggagaagcggaucgaaaacuuaaauaaaaagguggacgauggguuccuggacauuuggacauacaacgcugagcuccuuguccuguuggaaaaugagcgcacucuagauuaucaugacucuaacgugaaaaaccuguacgagaagguacgaaaucagcucaaaaacaaugccaaggaaaucggcaacggauguuuugaguucuaucacaagugcgauaauaccuguauggaaagcguuaaaaacggcacauacgacuauccuaaguacucagaggaagcaaaacugaauagagagaagauugauggggugaaacuugagaguaccaggauauaucaaauccuggccauuuacuccacugucgcuagcucuuuggugcucgucgugucacugggagcgaucaguuuuuggaugugcagcaacgguuccuuacagugccggaucuguauuuga

SEQ ID NO: 132961 - RNA, 1701 nt, Artificial Sequence
  derived and/or modified sequence opt3 from hemagglutinin__InfluenzaA__AHE37974
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauguucccgaagacaagcuccuggcccaaccacgacucaaauaagggugucaccgccgcuuguccucaugcaggggccaaaaguuuuuauaagaaccugauuuggcucgugaaaaagggaaauagcuacccaaaauuaucuaaguccuauaucaacgauaagggcaaagaaguacugguucuuuggggcauacaccaccccucaacgacugcugaccaacagagcuuguaccagaaugccgaugcguacguguucgucgggaccaguaaguauucuaaaaaguuuaaaccugagaucgcaauucgcccaaaggugcgagaccaggagggacguaugaacuacuauuggacacugaucgaacccggugauaaaauuacuuucgaggccaccggcaaccuaguggucccuagauacgcuuuugccauggaaaggaaugcaggguccggaaucauaauuagcgacacaccaguucaugauugcaacaccacgugucaaacuccggagggcgcuaucaauacaucgcuccccuuccagaacauucacccuaucaccaucgguaagugcccaaaguaugugaaaucuacuaagcugcggcuugccacagggcugcgcaauguacccuccauucagucaagaggauuguuuggcgcgauagccggcuucaucgaagggggauggaccgguaugguggacggcugguacggguaucaucaccagaacgagcaaggaaguggcuacgcagcugaccucaaaagcacgcagaaugccauugauaagaucaccaacaaagucaauuccgugauagagaagaugaacacacaguuuacugcuguugguaaggaguucaaucaccuggagaaaaggauugaaaacuuaaauaagaaaguggacgauggguuccuggacaucuggaccuacaacgccgagcuccuuguccuguuggaaaaugagcggacacuagauuaucaugacucuaacgugaagaaccuguacgagaaaguacgcaaucagcucaagaacaaugcaaaggaaaucggcaacggauguuuugaguucuaucacaaaugcgauaauacuuguauggaaagcguuaagaacggcaccuacgacuauccuaaauacucagaggaagccaagcugaaucgagagaaaauugauggggugaaacuugagaguacaagaaucuaucaaauucuggcuauauacuccaccgucgcgagcucuuuggugcucgucgugucacugggagcaaucaguuuuuggaugugcagcaacgguuccuuacagugcaggauuuguaucuga

SEQ ID NO: 132962 - RNA, 1701 nt, Artificial Sequence; identical to SEQ ID NO: 132056
  derived and/or modified sequence opt3 from hemagglutinin__InfluenzaA__AHE37975

SEQ ID NO: 132963 - RNA, 1701 nt, Artificial Sequence
  derived and/or modified sequence opt3 from hemagglutinin__InfluenzaA__AHE37976
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucagcagccaguagcugguccuacauuguugagacaucuucgucaaacaauggaaccugcuauccaggcgacuuuaucaacuacgaagaacucagggagcagcugagcaguguguccucuuucgaacgguuugagauuuucccgaagacuagcuccuggcccaaucacgauucaaacaagggugucacagcugcauguccucaugccggggcuaaaaguuuuuauaagaaucugaucuggcucgugaaaaagggaaacagcuacccaaaauuaucuaaguccuauauaaaugacaagggcaaagaaauccugguacuuuggggcauucaccaccccucaaccacgacugaucaacagagcuuguaccagaacgccgacgcguacguuuucguggggaccagucgcuauucuaagaaauuuaagccugagaucgcaauucgaccaaaaguccgugaucaggagggaagaaugaacuacuauuggacacugaucgaacccggugacaagauaacuuucgaggccaccggcaaucuaguggugccuagguacgcuuuugccauggaacggaacgcaggguccggaauuaucauuagcgauacaccaguccaugacugcaauaccacgugucaaacuccggagggcgcuaucaacacaucgcuccccuuccagaauauccacccuauuaccauagguaaaugcccaaaguauguuaagucuacuaaacugcgccuugccacagggcugagaaacgugcccuccauccagucaaggggauuguuuggcgcgauugccggcuucaucgaagggggauggaccgguaugguagauggcugguacggguaucaucaccagaaugagcaaggaaguggcuacgcagcugaccucaagagcacgcagaacgccauagacaaaauuaccaauaaggugaacuccgucaucgagaaaaugaauacacaguuuacugcuguggguaaggaguucaaccaccuggagaagcggaucgaaaauuuaaacaaaaagguugaugacggguuccuggauauuuggaccuacaaugccgagcuccuugugcuguuggaaaacgagcgcacacuagacuaucaugauucuaacgucaaaaaucuguacgagaaggugcgaaaccagcucaaaaauaacgcaaaggaaaucggcaauggauguuuugaguucuaucacaagugcgacaacacuuguauggaaagcguuaaaaauggcaccuacgauuauccuaaguacucagaggaagccaaacugaacagagggaagauugacggaguaaaacuugagaguacaaggauauaucaaauccuggcuauuuacuccaccguggcgagcucuuugguccucguggucucacugggugcaaucaguuuuuggaugugcagcaauggcuccuuacagugccggaucuguauuuga

SEQ ID NO: 132964 - RNA, 1701 nt, Artificial Sequence; identical to SEQ ID NO: 132056
  derived and/or modified sequence opt3 from hemagglutinin__InfluenzaA__AHE37977

SEQ ID NO: 132965 - RNA, 1701 nt, Artificial Sequence; identical to SEQ ID NO: 132076
  derived and/or modified sequence opt3 from hemagglutinin__InfluenzaA__AHE37978

SEQ ID NO: 132966 - RNA, 1701 nt, Artificial Sequence; identical to SEQ ID NO: 132056
  derived and/or modified sequence opt3 from hemagglutinin__InfluenzaA__AHE37979

SEQ ID NO: 132967 - RNA, 1701 nt, Artificial Sequence
  derived and/or modified sequence opt3 from hemagglutinin__InfluenzaA__AHE37980
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggagugacaccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaagaacucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuaucuaaguccuauauaaacgauaagggcaaagaaguacugguucuuuggggcauccaccaccccucaacuaccgccgaccaacagagcuuguaccagaaugcugaugccuacguguucgucgggacaagucgcuauucuaagaaauuuaagccugagauugcgauccgaccaaaagugcgugaccaggagggaagaaugaacuacuauuggacucugauugaacccggugauaagaucaccuucgaggcaacaggcaaccuaguggucccuagguacgccuuugcuauggaacggaaugccggguccggaauaauuaucagcgacaccccaguucaugauugcaacacgacuugucaaacaccggagggcgcaauuaauaccucgcuccccuuccagaacauccacccuaucacuauugguaaaugcccaaaguaugugaagucuacaaaacugcgccuugcuaccgggcugagaaauguacccuccauacagucaaggggauuguuuggcgccaucgcgggcuucauugaagggggauggacggguaugguggacggcugguacggguaucaucaccagaacgagcaaggaaguggcuacgccgcagaccucaagagcacccagaaugcuaucgauaaaauaacaaacaaggucaauuccgugauugagaaaaugaacacucaguuuaccgccguugguaaggaguucaaucaccuggagaagcggaucgaaaacuuaaauaaaaagguggacgauggguuccuggacaucuggacauacaacgcugagcuccuuguccuguuggaaaaugagcgcacucuagauuaucaugacucuaacgugaaaaaccuguacgagaagguacgaaaucagcucaaaaacaaugccaaggaaauuggcaacggauguuuugaguucuaucacaagugcgauaauaccuguauggaaagcguuaaaaacggcacauacgacuauccuaaguacucagaggaagcaaaacugaauagagagaagaucgauggggugaaacuugagaguaccaggauuuaucaaauacuggccaucuacuccacugucgcuagcucuuuggugcucgucgugucacugggagcgauuaguuuuuggaugugcagcaacgguuccuuacagugccggaucuguaucuga

SEQ ID NO: 132968 - RNA, 1701 nt, Artificial Sequence
  derived and/or modified sequence opt3 from hemagglutinin__InfluenzaA__AHE37981
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauguucccgaagacaagcuccuggcccaaccacgacucaaauaagggugucaccgccgcuuguccucaugcaggggccaaaaguuuuuauaagaaccugauuuggcucgugaaaaagggaaauagcuacccaaaauuaucuaaguccuauaucaacgauaagggcaaagaaguacugguucuuuggggcauacaccaccccucaacgacugcugaccaacagagcuuguaccagaaugccgaugcguacguguucgucgggaccaguaaguauucuaaaaaguuuaaaccugagaucgcaauucgcccaaaggugcgagaccaggagggacguaugaacuacuauuggacacugaucgaacccggugauaaaauuacuuucgaggccaccggcaaccuaguggucccuagauacgcuuuugccauggaaaggaaugcaggguccggaaucauaauuagcgacacaccaguucaugauugcaacaccacgugucaaacuccggagggcgcuaucaauacaucgcuccccuuccagaacauucacccuaucaccaucgguaagugcccaaaguaugugaaaucuacuaagcugcggcuugccacagggcugcgcaauguacccuccauucagucaagaggauuguuuggcgcgauagccggcuucaucgaagggggauggaccgguaugguggacggcugguacggguaucaucaccagaacgagcaaggaaguggcuacgcagcugaccucaaaagcacgcagaaugccauugauaagaucaccaacaaagucaauuccgugauagagaagaugaacauucaguuuacagcuguugguaaggaguucaaucaccuggagaaaaggaucgaaaacuuaaauaagaaaguggacgauggguuccuggacaucuggacuuacaacgccgagcuccuuguccuguuggaaaaugagcggacccuagauuaucaugacucuaacgugaagaaccuguacgagaaaguacgcaaucagcucaagaacaaugcaaaggaaauuggcaacggauguuuugaguucuaucacaaaugcgauaauacauguauggaaagcguuaagaacggcacuuacgacuauccuaaauacucagaggaagccaagcugaaucgagagaaaaucgauggggugaaacuugagaguaccagaauuuaucaaauacuggcuaucuacuccacagucgcgagcucuuuggugcucgucgugucacugggagcaauuaguuuuuggaugugcagcaacgguuccuuacagugcaggaucuguaucuga

SEQ ID NO: 132969 - RNA, 1701 nt, Artificial Sequence; identical to SEQ ID NO: 132056
  derived and/or modified sequence opt3 from hemagglutinin__InfluenzaA__AHE37982

SEQ ID NO: 132970 - RNA, 1701 nt, Artificial Sequence
  derived and/or modified sequence opt3 from hemagglutinin__InfluenzaA__AHE37983
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucugaauccuauauaaacgauaagggcaaggagguacugguucuuuggggcauccaccaccccucaacgacugcugaccaacagagcuuguaccagaaugccgaugcguacguguucgucgggaccagucgcuauucuaaaaaguuuaaaccugagauugcaauccgaccaaaggugcgugaccaggaaggaagaaugaacuacuauuggacacugauugagcccggugauaaaaucacuuucgaagccaccggcaaccuaguggucccuagguacgcuuuugccauggagcggaaugcaggguccggaauaauuaucagcgacacaccaguucaugauugcaacaccacgugucaaacuccggaaggcgcuauuaauacaucgcuccccuuccagaacauccacccuaucaccauugguaagugcccaaaauaugugaagucuacuaagcugcgccuugccacagggcugagaaauguacccuccauacagucaaggggauuguuuggcgcgaucgccggcuucauugaagggggauggaccgguaugguggacggcugguacggguaucaucaccagaacgagcaaggaaguggcuacgcagcugaccucaaaagcacgcagaaugccaucgauaagauaaccaacaaagucaauuccgugauugaaaagaugaacacacaguuuacugcuguugguaaagaguucaaucaccuggaaaagcggaucgagaacuuaaauaagaaaguggacgauggguuccuggacaucuggaccuacaacgccgaacuccuuguccuguuggagaaugagcgcacacuagauuaucaugacucuaacgugaagaaccuguacgaaaaaguacgaaaucagcucaagaacaaugcaaaagagauuggcaacggauguuuugaguucuaucacaagugcgauaauacuuguauggaaagcguuaagaacggcaccuacgacuauccuaaauacucagaagaggccaagcugaauagagagaaaaucgauggggugaaacuugaaaguacaaggauuuaucaaauacuggcuaucuacuccaccgucgcgagcucuuuggugcucgucgugucacugggagcaauuaguuuuuggaugugcagcaacgguuccuuacagugccggaucuguaucuga

SEQ ID NO: 132971 - RNA, 1701 nt, Artificial Sequence
  derived and/or modified sequence opt3 from hemagglutinin__InfluenzaA__AHE37984
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaagcacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucaauuacgaggagcucagggaacagcugagcaguguguccucuuucgagcgguuugaaauuuucccgaaaacaagcuccuggcccaaccacgacucaaauaagggugucaccgccgcuuguccucaugcaggggccaagaguuuuuauaaaaaccugaucuggcucgugaagaaaggaaauagcuacccaaaguuaucuaaauccuauauaaacgauaagggcaaggagguacugguucuuuggggcauccaccaccccucaacgacugcugaccaacagagcuuguaccagaaugccgaugcguacguguucgucgggaccagucgcuauucuaaaaaguuuaaaccugagauugcaauccgaccaaaggugcgugaccaggaaggaagaaugaacuacuauuggacacugauugagcccggugauaaaaucacuuucgaagccaccggcaaccuaguggucccuagguacgcuuuugccauggagcggaaugcaggguccggaauaauuaucagcgacacaccaguucaugauugcaacaccacgugucaaacuccggaaggcgcuauuaauacaucgcuccccuuccagaacauccacccuaucaccauugguaagugcccaaaauaugugaagucuacuaagcugcgccuugccacagggcugagaaauguacccuccauacagucaaggggauuguuuggcgcgaucgccggcuucauugaagggggauggaccgguaugguggacggcugguacggguaucaucaccagaacgagcaaggaaguggcuacgcagcugaccucaaaagcacgcagaaugccaucgauaagauaaccaacaaagucaauuccgugauugaaaagaugaacacacaguuuacugcuguugguaaagaguucaaucaccuggaaaagcggaucgagaacuuaaauaagaaaguggacgauggguuccuggacaucuggaccuacaacgccgaacuccuuguccuguuggagaaugagcgcacacuagauuaucaugacucuaacgugaagaaccuguacgaaaaaguacgaaaucagcucaagaacaaugcaaaagagauuggcaacggauguuuugaguucuaucacaagugcgauaauacuuguauggagagcguuaagaacggcaccuacgacuauccuaaauacucagaagaggccaagcugaauagagagaaaaucgauggggugaaacuugaaaguacaaggauuuaucaaauacuggcuaucuacuccaccgucgcgagcucuuuggugcucgucgugucacugggagcaauuaguuuuuggaugugcagcaacgguuccuuacagugccggaucuguaucuga

SEQ ID NO: 132972 - RNA, 1701 nt, Artificial Sequence
  derived and/or modified sequence opt3 from hemagglutinin__InfluenzaA__AHE37985
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgaccaaaucgaagugacuaaugcgaccgagcugguacagucuucaaguacaggugaaauuugcaacagcccacaccagauccuagauggcgagaauuguacccucauagacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacucuggaguuuaacaaugaguccuucaacuggacagguguuacccagaaugggacgucuagcgcuugcauccggcgcuccaacaauucauuuuucagucgacugaacuggcucacucacuuaaauuuuaaauacccagcacugaacgugaccaugcccaacaaugaacaguucgacaagcuguauauuuggggaguccaucacccuggcacagauaaggaccagaucuuuuuguacgcccaagcuagcggccguauuacugugucuaccaaaagaucccagcaggccguaaucccaaacauagggucaaggccccggguucgcaauauuccuagcagagugaguaucuauuggacaauugucaagccaggagauauccugcuaaucaacucuaccgguaaucucauugcgccgaggggcuacuucaaaauacgguccggaaagagcucgaucaugaaaucugacgcacccauugggaaguguaacuccgccugcaucacgccuaauggcucaauaccaaacgacaagcccuuucagaaugugaaccgcauuacuuacggugcuuguccucgauaugugaaacaaaauacacugaaacuugccaccgggaugagaaacgucccagagaagcagacuaggggaaucuucggcgcaaucgcuggcuuuauugaaaaugggugggagggaaugguugaugguugguacggcuuccggcaccagaacagugaggggcguggacaagccgcggaccuuaagagcacacaggccgcaaucgaucagauuaauggcaaauugaaccgccucauagguaagaccaacgaaaaauuccaucagaucgagaaggaauuuuccgagguggaagggaggauucaagaccuggagaaguauguagaggauacgaaaaucgacuuauggucuuacaaugcugaacugcucguggcccuugagaaccagcacaccaucgaucugacagacagcgaaaugaauaaguuguucgagaaaacuaagaaacagcuaagagaaaacgcugaggauaugggcaauggaugcuuuaagauuuaucauaagugugacaacgccugcauaggcucaauccggaaugggaccuacgaucacgacgucuaucgagacgaggcacugaacaaucgcuuccagauuaaaggaguggaacucaagagugguuacaaagauuggauccuguggauuuccuuugccaucagcugcuuccuucuguguguugcuuugcucggcuuuauaaugugggcgugccaaaaggggaacaucagauguaauauuugcaucuga

SEQ ID NO: 132973 - RNA, 1701 nt, Artificial Sequence; identical to SEQ ID NO: 131938
  derived and/or modified sequence opt3 from hemagglutinin__InfluenzaA__AHE37986

SEQ ID NO: 132974 - RNA, 1701 nt, Artificial Sequence; identical to SEQ ID NO: 131874
  derived and/or modified sequence opt3 from hemagglutinin__InfluenzaA__AHE37987

SEQ ID NO: 132975 - RNA, 1701 nt, Artificial Sequence
  derived and/or modified sequence opt3 from hemagglutinin__InfluenzaA__AHE37988
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugauggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgagguggaagggcggauucagaaccuggagaaauacgucgaggacaccaagauagauuuauggucauauaacgccgaacugcucguugcacuugagaaucaacauacgaucgaccugaccgauagugaaaugaacaaauuguucgagaagacaaagaagcagcuacgagaaaaugcugaggacaugggcaacggaugcuuuaagauuuaccacaaaugugauaaugccugcaucggcuccauucgcaacgggacuuaugaccauaauguguacagagaugaggcucugaacaauagguuccagaucaagggaguagaacucaaaagcgguuacaaggacuggauacuguggaucucuuuugccauuucaugcuuccuucuguguguggcauugcucggcuuuaucaugugggccugccagaaagggaacauucgguguaauaucugcauauga

SEQ ID NO: 132976 - RNA, 1701 nt, Artificial Sequence; identical to SEQ ID NO: 132010
  derived and/or modified sequence opt3 from hemagglutinin__InfluenzaA__AHE37989

SEQ ID NO: 132977 - RNA, 1701 nt, Artificial Sequence; identical to SEQ ID NO: 131874
  derived and/or modified sequence opt3 from hemagglutinin__InfluenzaA__AHE37990

SEQ ID NO: 132978 - RNA, 1701 nt, Artificial Sequence; identical to SEQ ID NO: 131874
  derived and/or modified sequence opt3 from hemagglutinin__InfluenzaA__AHE37991

SEQ ID NO: 132979 - RNA, 1701 nt, Artificial Sequence
  derived and/or modified sequence opt3 from hemagglutinin__InfluenzaA__AHE37992
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgaccaaaucgaagugacuaaugcgaccgagcugguacagucuucaaguacaggugaaauuugcaacagcccacaccagauccuagauggcgagaauuguacccucauagacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacucuggaguuugacaacgaguccuucaauuggacagguguuacccagaacgggacgucuagcgcuugcauccggcgcuccaauaacucauuuuucagucgacugaauuggcucacucacuuaaacuuuaaauacccagcacugaaugugaccaugcccaacaacgaacaguucgauaaacuuuauauuuggggaguccaucacccuggcacagacaaggaucagaucuuuuuguacgcccaagcuagcggccguauuacugugucuaccaagagaucccagcaggccguaaucccaaauauagggucaaggccccggguucgcaacauuccuagcagagugaguaucuauuggacaauugucaagccaggagacauccugcuaaucaauucuaccgguaaccucauugcgccgaggggcuacuucaaaauacgguccggaaagagcucgaucaugcgcucugacgcacccauugggaaauguaauuccgccugcaucacgccuaacggcucaauaccaaaugauaagcccuuucagaacgugaaucgaauuacuuacggugcuuguccuagauaugugaagcaaaacacacugaaacuugccaccgggaugaggaaugucccagagaagcagacucggggaaucuucggcgcaaucgcuggcuuuauugaaaacgggugggagggaaugguugacgguugguacggcuuccgucaccagaauagugaggggcgcggacaagccgcggaucugaaaagcacacaggccgcaaucgaccagauuaacggcaaguugaauagacucauagguaaaaccaacgaaaaguuccaucagaucgagaaagaauuuuccgagguggaagggaggauucaagaucuggagaaguauguagaggacacgaagaucgauuuauggucuuacaacgcugaacugcucguggcccuugagaaucagcacaccaucgaccugacagauagcgaaaugaacaaauuguucgagaagacuaaaaagcagcuacgggaaaaugcugaggacaugggcaacggaugcuuuaaaauuuaucauaagugugauaaugccugcauaggcucaauccgaaacgggaccuacgaccacgacgucuaucgcgaugaggcacugaauaacagauuccagauuaagggaguggaacucaaaagugguuacaaggacuggauccuguggauuuccuuugccaucagcugcuuccuucuguguguugcuuugcucggcuuuauaaugugggcgugccaaaaagggaauaucagguguaacauuugcaucuga

SEQ ID NO: 132980 - RNA, 1701 nt, Artificial Sequence; identical to SEQ ID NO: 132056
  derived and/or modified sequence opt3 from hemagglutinin__InfluenzaA__AHE38023

SEQ ID NO: 132981 - RNA, 1701 nt, Artificial Sequence
  derived and/or modified sequence opt3 from hemagglutinin__InfluenzaA__AHE38024
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaacacgaccaaaggugcgugaccaagagggaagaaugaacuacuauuggacucugguggaacccggugauaaaaucaccuucgaggccacaggcaaccuagucguuccuagguacgcuuuuaccauggaacggaaugccggguccggaauuaucauaagcgacacgccagugcaugauugcaacacuacaugucagaccccggagggcgcaauuaauacuucgcuccccuuccagaacauccacccuauuacaaucgguaagugcccaaaauauguaaagucuaccaagcugcgccuugcuacggggcugagaaaugugcccuccauccagucaaggggauuguuuggcgccauugcgggcuucauagaagggggauggaccgguauggucgacggcugguacggguaucaucaccaaaacgagcagggaaguggcuacgccgcagaccucaaaagcacacagaaugcuaucgauaagauuacuaacaaaguuaauuccgugaucgagaagaugaacacccaguuuacagccguggguaaagaguucaaucaccuggagaagcggauagaaaacuuaaauaagaaagucgacgauggguuccuggacauuuggacuuacaacgcugagcuccuugugcuguuggaaaaugagcgcacccuagauuaucaugacucuaacguaaagaaccuguacgagaaaguucgaaaucaacucaagaacaaugccaaagaaaucggcaacggauguuuugaguucuaucacaagugcgauaauacauguauggaaagcgugaagaacggcaccuacgacuauccuaaauacucagaggaagcaaagcugaauagagagaaaaucgauggggucaaacuugagaguacuaggauuuaucagauccuggccauuuacuccacgguggcuagcucuuugguccucgugguuucacugggagcgauaaguuuuuggaugugcagcaacgguuccuuacagugccggaucuguauuuga

SEQ ID NO: 132982 - RNA, 1701 nt, Artificial Sequence
  derived and/or modified sequence opt3 from hemagglutinin__InfluenzaA__AHE38026
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgaaaagggcaaggagguacugguucuuuggggcauccaccaccccucaacgacugcugaucagcagagcuuguaccagaaugccgacgcguacguguucgucgggaccagucgcuauucuaaaaaguuuaaaccugagauugcaauccgaccaaaggugcgugaucaagaaggaagaaugaacuacuauuggacacugguggagcccggugacaaaauuacuuucgaagccaccggcaaccuagucguuccuagguacgcuuuuacaauggagcggaaugccggguccggaaucauaauuagcgauaccccagugcaugacugcaacacgacuugucagacaccggaaggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgauggcugguacggguaucaucaccaaaacgagcagggaaguggcuacgccgcagaccucaaaagcacccagaaugcuauugacaagaucacaaacaaaguuaauuccgugauagaaaagaugaacacucaguuuaccgccguggguaaagaguucaaucaccuggaaaagcggauugagaacuuaaauaagaaagucgaugacggguuccuggauaucuggacauacaacgcugaacuccuugugcuguuggagaaugagcgcacucuagacuaucaugauucuaacguaaagaaccuguacgaaaaaguucgaaaucaacucaagaacaaugccaaagagaucggcaacggauguuuugaguucuaucacaagugcgacaauaccuguauggaaagcgugaagaacggcacauacgauuauccuaaauacucagaagaggcaaagcugaauagagagaaaauugacggggucaaacuugaaaguaccaggaucuaucagauucuggccauauacuccacuguggcuagcucuuugguccucgugguuucacugggagcgaucaguuuuuggaugugcagcaacgguuccuuacagugccggauuuguaucuga

SEQ ID NO: 132983 - RNA, 1701 nt, Artificial Sequence; identical to SEQ ID NO: 131899
  derived and/or modified sequence opt3 from hemagglutinin__InfluenzaA__AHE38027

SEQ ID NO: 132984 - RNA, 1683 nt, Artificial Sequence
  derived and/or modified sequence opt3 from hemagglutinin__InfluenzaA__AHF20558
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaacgcacaguggauuugggccaaugcggguuacugggaaccaucacuggcccaccgcagugugaccaguuucuagaguucucugcugaucucauaaucgaacgacgugaggguucagacguuugcuaccccgggaaguuugugaacgaggaagcccugagacagauucuuagggagaguggaggcaucgauaaagaagcaaugggcuucacauauagcgggauucggaccaauggagccacguccgcuugucgcagaucugguucgucauuuuacgcagagaugaaguggcuguugagcaacacugacaaugccgcuuucccucaaaugaccaagaguuauaaaaacacaaggaaguccccagcccucaucgucuggggcauacaccauucugugagcacugcggagcagaccaaacuguacggguccggaaauaagcugguaacaguuggcucaaguaacuaucagcagagcuuugugcccucuccuggugcacggccacaagucaaugggcucuccggacgcauugauuuccacugguuaaugcugaaccccaaugacaccgugacguuuucauucaacggcgccuuuaucgcuccugaucgagccagcuuccuuagaggcaaaaguauggggauucagucuggagugcaggucgacgcaaacugcgaaggugauuguuaccauuccggcgggacuaucaucagcaauuugccauuucagaacauugacucgagggcuguuggaaagugcccgcgguaugugaagcaacguucucugcuacucgccacaggcaugaaaaauguacccgagauaccuaagggucgcgggcuguucggcgcgaucgccggauucauugaaaacggcugggaggggcuuaucgauggaugguacgguuuuagacaccagaaugcacagggcgaagggaccgcugccgacuacaaauccacucaaucagcuauagaccagauuacaggaaagcugaacagguugaucgagaaaaccaaucagcaguucgagcucaucgauaacgaauuuaaugagguggaaaagcaaauuggcaacgucaucaauuggacgcgggacaguauuaccgagguguggagcuauaacgccgaacuguuaguugcaauggagaaucagcacacaauagaucuggccgacuccgagauggauaaacucuacgaacgagugaagcgccagcuuagagagaacgcugaagaggacgguacuggguguuucgaaaucuuucauaagugcgaugacgauuguauggcgucuauuaggaauaacaccuaugaccacagcaaauaccgggaggaggcaaugcagaaccgcauccaaaucgauccagucaagcugucaaguggcuauaaagacgugauuuugugguucuccuuuggagccagcugcuucauacuacuggcuaucguaaugggccucguuuuuauuugcgugcagaaugggaacaugagauguacaaucggaauuuga

SEQ ID NO: 132985 - RNA, 1683 nt, Artificial Sequence
  derived and/or modified sequence opt3 from hemagglutinin__InfluenzaA__AHF20568
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaacgcacaguggauuugggccaaugcggguuacugggaaccaucacuggcccaccgcagugugaccaguuucuagaguucucugcugaucucauaaucgaacgacgugaggguucagacguuugcuaccccgggaaguuugugaacgaggaagcccugagacagauucuuagggagaguggaggcaucgauaaagaagcaaugggcuucacauauagcgggauucggaccaauggagccacguccgcuugucgcagaucugguucgucauuuuacgcagagaugaaguggcuguugagcaacacugacaaugccgcuuucccucaaaugaccaagaguuauaaaaacacaaggaaguccccagcccucaucgucuggggcauacaccauucugugagcacugcggagcagaccaaacuguacggguccggaaauaagcugguaacaguuggcucaaguaacuaucagcagagcuuugugcccucuccuggugcacggccacaagucaaugggcucuccggacgcauugauuuccacugguuaaugcugaaccccaaugacaccgugacguuuucauucaacggcgccuuuaucgcuccugaucgagccagcuuccuuagaggcaaaaguauggggauucagucuggagugcaggucgacgcaaacugcgaaggugauuguuaccauuccggcgggacuaucaugagcaauuugccauuucagaacaucgacucgagggcuguuggaaagugcccgcgguaugugaagcaacguucucugcuacucgccacaggcaugaaaaauguacccgagauuccuaagggucgcgggcuguucggcgcgauagccggauucaucgaaaacggcugggaggggcuuauugauggaugguacgguuuuagacaccagaaugcacagggcgaagggaccgcugccgacuacaaauccacucaaucagcuaucgaccagauaacaggaaagcugaacagguugauugagaaaaccaaucagcaguucgagcucaucgauaacgaauuuaaugagguggaaaagcaaaucggcaacgucauuaauuggacgcgggacaguaucaccgagguguggagcuauaacgccgaacuguuaguugcaauggagaaucagcacacaauugaucuggccgacuccgagauggauaaacucuacgaacgagugaagcgccagcuuagagagaacgcugaagaggacgguacuggguguuucgaaauauuucauaagugcgaugacgauuguauggcgucuaucaggaauaacaccuaugaccacagcaaauaccgggaggaggcaaugcagaaccgcauucaaaucgauccagucaagcugucaaguggcuauaaagacgugaucuugugguucuccuuuggagccagcugcuucauucuacuggcuauaguaaugggccucguuuuuaucugcgugaagaaugggaacaugagauguacaauuugcaucuga

SEQ ID NO: 132986 - RNA, 1698 nt, Artificial Sequence; identical to SEQ ID NO: 129809
  derived and/or modified sequence opt3 from hemagglutinin__InfluenzaA__AHG96108

SEQ ID NO: 132987 - RNA, 1698 nt, Artificial Sequence; identical to SEQ ID NO: 129809
  derived and/or modified sequence opt3 from hemagglutinin__InfluenzaA__AHG96120

SEQ ID NO: 132988 - RNA, 1698 nt, Artificial Sequence; identical to SEQ ID NO: 129809
  derived and/or modified sequence opt3 from hemagglutinin__InfluenzaA__AHG96132

SEQ ID NO: 132989 - RNA, 1698 nt, Artificial Sequence
  derived and/or modified sequence opt3 from hemagglutinin__InfluenzaA__AHG96144
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgggguccagaaagcccuguaccauacggagaaugcuuacguguccguggucucaagccacuauagucgcaaguucacucccgaaauagcaaagcgaccuaaaguucgugaccaggagggaagaaucaacuacuauuggacccuucuggagccaggugauacaauuaucuuugaagccaauggcaacuugauugcuccgagguacgccuucgcgcucucucggggguuuggauccggcaucauaaauagcaacgcacccauggacaagugugaugccaaaugccagacuccucaaggugcuauuaauucgucucugccauuccagaacgugcaucccguaaccaucggggaguguccuaaguaugugcgcuccgccaaauuaagaauggucacaggacugaggaauauuccaucaauccagagucggggccucuuuggcgcaaucgcuggguucauugaaggagguuggaccggcaugguggacgggugguacggauaucaccaccagaacgagcaaggcagcgguuacgccgcggaucagaaguccacgcagaaugccauaaacgggaucacuaauaaaguuaacucugugauugaaaagaugaauacacaguuuaccgcagucggcaaggaguucaacaaacuugagcgccgaauggaaaaccugaauaagaaaguggacgauggauucaucgacauauggacuuacaacgcugaguugcuaguacugcucgaaaaugagagaacacuggauuuucaugacagcaacguuaagaaucuuuaugaaaaagugaagucacaacugaagaacaaugccaaagagauuggcaacgggugcuucgaguuuuaccacaaguguaaugacgaaugcauggagagugucaaaaacggaaccuaugauuaccccaaguauuccgaagagagcaaauugaauagggagaagaucgacggugugaagcucgaaucuaugggcgucuaccagauccuggcuauuuauucaacgguggccaguagcuuaguucugcuagugucccucggggcaaucucuuucuggaugugcucgaacggaagccugcagugucggauuugcauauga

SEQ ID NO: 132990 - RNA, 1698 nt, Artificial Sequence; identical to SEQ ID NO: 129809
  derived and/or modified sequence opt3 from hemagglutinin__InfluenzaA__AHG96156

SEQ ID NO: 132991 - RNA, 1698 nt, Artificial Sequence; identical to SEQ ID NO: 129809
  derived and/or modified sequence opt3 from hemagglutinin__InfluenzaA__AHG96168

SEQ ID NO: 132992 - RNA, 1698 nt, Artificial Sequence; identical to SEQ ID NO: 129809
  derived and/or modified sequence opt3 from hemagglutinin__InfluenzaA__AHG96180

SEQ ID NO: 132993 - RNA, 1698 nt, Artificial Sequence; identical to SEQ ID NO: 129809
  derived and/or modified sequence opt3 from hemagglutinin__InfluenzaA__AHG96192

SEQ ID NO: 132994 - RNA, 1698 nt, Artificial Sequence; identical to SEQ ID NO: 129809
  derived and/or modified sequence opt3 from hemagglutinin__InfluenzaA__AHG96204

SEQ ID NO: 132995 - RNA, 1698 nt, Artificial Sequence; identical to SEQ ID NO: 129809
  derived and/or modified sequence opt3 from hemagglutinin__InfluenzaA__AHG96216

SEQ ID NO: 132996 - RNA, 1698 nt, Artificial Sequence; identical to SEQ ID NO: 129809
  derived and/or modified sequence opt3 from hemagglutinin__InfluenzaA__AHG96228

SEQ ID NO: 132997 - RNA, 1698 nt, Artificial Sequence; identical to SEQ ID NO: 132989
  derived and/or modified sequence opt3 from hemagglutinin__InfluenzaA__AHG96240

SEQ ID NO: 132998 - RNA, 1698 nt, Artificial Sequence; identical to SEQ ID NO: 129809
  derived and/or modified sequence opt3 from hemagglutinin__InfluenzaA__AHG96252

SEQ ID NO: 132999 - RNA, 1698 nt, Artificial Sequence; identical to SEQ ID NO: 129809
  derived and/or modified sequence opt3 from hemagglutinin__InfluenzaA__AHG96264

SEQ ID NO: 133000 - RNA, 1698 nt, Artificial Sequence; identical to SEQ ID NO: 129809
  derived and/or modified sequence opt3 from hemagglutinin__InfluenzaA__AHG96276

SEQ ID NO: 133001 - RNA, 1698 nt, Artificial Sequence; identical to SEQ ID NO: 129809
  derived and/or modified sequence opt3 from hemagglutinin__InfluenzaA__AHG96288

SEQ ID NO: 133002 - RNA, 1698 nt, Artificial Sequence; identical to SEQ ID NO: 129809
  derived and/or modified sequence opt3 from hemagglutinin__InfluenzaA__AHG96300

SEQ ID NO: 133003 - RNA, 1701 nt, Artificial Sequence
  derived and/or modified sequence opt3 from hemagglutinin__InfluenzaA__AHG96312
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggagugguuccccugcaucuugguaaaugcaacauagcuggcuggauccuggggaauccugagugugaaucuuugucaacagccaguagcugguccuacauuguggagaccucuucgucagacaacggaacuugcuauccaggcgauuuuaucaauuacgaagaacucagggagcagcugagcagugucuccucuuucgaacgguuugagauuuucccgaagacaagcuccuggcccaaccacgacucaaauaagggugugaccgcagccuguccucaugcuggggcaaaaaguuuuuauaagaaccugaucuggcucguaaagaagggaaauagcuacccaaaauuaucucaauccuauauaaacgauaagggcaaggaaguucuggugcuuuggggcauccaccaccccucaacgacugccgaccagcagagcuuguaccagaaugcugaugccuacgucuucguggggaccagucgcuauucuaaaaaguuuaaaccugagauugcgauccgaccaaaggugcgugaccaagagggaagaaugaacuacuauuggacacuggucgaacccggugauaaaauuacuuucgaggcaaccggcaaccuaguugugccuagguacgccuuuacaauggaacggaaugcuggguccggaaucauaauuagcgacaccccaguacaugauugcaacacgacuugucagacaccggagggcgccaucaauaccucgcuccccuuccagaacauucacccuaucacuaucgguaagugcccaaaauaugugaagucuacaaagcugcgccuugcaaccgggcugagaaauguccccuccauucagucaaggggauuguuuggcgcuauagccggcuucaucgaagggggauggacggguaugguggacggcugguacggguaucaucaccaaaacgagcagggaaguggcuacgcggccgaccucaaaagcacccagaaugcaauugauaagaucacaaacaaaguuaauuccgugauagagaagaugaacacucaguuuaccgcugucgguaaagaguucaaucaccuggagaagcggauugaaaacuuaaauaagaaaguggacgauggguuccuggacaucuggacauacaacgccgagcuccuuguacuguuggaaaaugagcgcacucuagauuaucaugacucuaacguuaagaaccuguacgagaaagugcgaaaucaacucaagaacaaugcuaaagaaaucggcaacggauguuuugaguucuaucacaagugcgauaauaccuguauggaaagcgucaagaacggcacauacgacuauccuaaauacucagaggaagccaagcugaauagagagaaaauugauggggugaaacuugagaguaccaggaucuaucagauucuggcaauauacuccacugucgccagcucuuuggugcucguugugucacugggagcuaucaguuuuuggaugugcagcaacgguuccuuacagugccggauuuguaucuga

SEQ ID NO: 133004 - RNA, 1701 nt, Artificial Sequence; identical to SEQ ID NO: 132056
  derived and/or modified sequence opt3 from hemagglutinin__InfluenzaA__AHG96313

SEQ ID NO: 133005 - RNA, 1701 nt, Artificial Sequence
  derived and/or modified sequence opt3 from hemagglutinin__InfluenzaA__AHG96314
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccucaaaagcacccagaaugcuauugauaagaucacaaacaaaguuaauuccgugauagagaagaugaacacucaguacaccgccguggguaaagaauuuaaucaccuggagaagcggauugaaaacuuaaauaagaaagucgacgauggguuccuggacaucuggacauauaacgcugagcuccuugugcuguuggaaaaugagcgcacucuagauuaccaugacucuaacguaaagaaccuguaugagaaaguucgaaaucaacucaagaacaaugccaaagaaaucggcaacggauguuucgaguuuuaccacaagugcgauaauaccuguauggaaagcgugaagaacggcacauaugacuacccuaaauauucagaggaagcaaagcugaauagagagaaaauugauggggucaaacuugagaguaccaggaucuaccagauucuggccauauacuccacuguggcuagcucuuugguccucgugguuucacugggagcgaucaguuucuggaugugcagcaacgguuccuuacagugccggauuuguaucuga

SEQ ID NO: 133006 - RNA, 1701 nt, Artificial Sequence; identical to SEQ ID NO: 132056
  derived and/or modified sequence opt3 from hemagglutinin__InfluenzaA__AHG96315

SEQ ID NO: 133007 - RNA, 1701 nt, Artificial Sequence; identical to SEQ ID NO: 132056
  derived and/or modified sequence opt3 from hemagglutinin__InfluenzaA__AHG96316

SEQ ID NO: 133008 - RNA, 1701 nt, Artificial Sequence; identical to SEQ ID NO: 132056
  derived and/or modified sequence opt3 from hemagglutinin__InfluenzaA__AHG96317

SEQ ID NO: 133009 - RNA, 1701 nt, Artificial Sequence; identical to SEQ ID NO: 132056
  derived and/or modified sequence opt3 from hemagglutinin__InfluenzaA__AHG96320

SEQ ID NO: 133010 - RNA, 1701 nt, Artificial Sequence; identical to SEQ ID NO: 132056
  derived and/or modified sequence opt3 from hemagglutinin__InfluenzaA__AHG96321

SEQ ID NO: 133011 - RNA, 1701 nt, Artificial Sequence; identical to SEQ ID NO: 132056
  derived and/or modified sequence opt3 from hemagglutinin__InfluenzaA__AHG96322

SEQ ID NO: 133012 - RNA, 1701 nt, Artificial Sequence; identical to SEQ ID NO: 132056
  derived and/or modified sequence opt3 from hemagglutinin__InfluenzaA__AHG96324

SEQ ID NO: 133013 - RNA, 1701 nt, Artificial Sequence; identical to SEQ ID NO: 132056
  derived and/or modified sequence opt3 from hemagglutinin__InfluenzaA__AHG96325

SEQ ID NO: 133014 - RNA, 1701 nt, Artificial Sequence
  derived and/or modified sequence opt3 from hemagglutinin__InfluenzaA__AHG96326
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaacucggacaauggaacuugcuauccaggcgauuuuaucaacuacgaagaacucagggagcagcugucaagcgugaguuccuucgaacgguuugagauuuucccgaagacaucuagcuggcccaaucacgacuccaacaagggugucaccgccgcuuguccucaugcaggggccaaaucauuuuauaagaaucugaucuggcucgugaaaaagggaaacaguuacccaaaauuaagccaaucuuauauaaaugauaagggcaaggaaguacugguucuuuggggcauccaccaccccuccacgacugcugaccagcagucauuguaccagaacgccgaugcguacguguucgucgggaccagccgcuauaguaaaaaguuuaaaccugagauugcaauccgaccaaaggugcgugaccaagagggaagaaugaacuacuauuggacacugguggaacccggugauaaaauuacuuucgaggccaccggcaaucuagucguuccuagguacgcuuuuacaauggaacggaacgccgggucuggaaucauaauuuccgacaccccagugcaugauugcaauacgacuugucagacaccggagggcgcaaucaacaccagccuccccuuccagaauauucacccuaucacuaucgguaagugcccaaaauauguaaagucgacaaagcugcgccuugcuaccgggcugagaaacgugcccucuauucaguccaggggauuguuuggcgccauagcgggcuucaucgaagggggauggacggguauggucgacggcugguacggguaucaucaccaaaaugagcagggaucaggcuacgccgcagaccucaaaaguacccagaacgcuauugauaagaucacaaauaaagugaacagcguuauagagaagaugaauacucaguuuaccgccguggguaaagaguucaaccaccuggagaagcggauugaaaauuuaaacaagaaagucgacgauggguuccuggacaucuggacauacaaugcugagcuccuugugcuguuggaaaacgagcgcacucuagauuaucaugacuccaacguaaagaaucuguacgagaaaguucgaaaccaacucaagaauaacgccaaagaaaucggcaauggauguuuugaguucuaucacaagugcgauaacaccuguauggaaucugugaagaauggcacauacgacuauccuaaauacagcgaggaagcaaagcugaacagagagaaaauugauggggucaaacuugagucaaccaggaucuaucagauucuggccauauacaguacuguggcuuccagcuugguccucgugguuucucugggagcgaucucauuuuggaugugcaguaaugguagcuuacagugccggauuuguaucuga

SEQ ID NO: 133015 - RNA, 1701 nt, Artificial Sequence; identical to SEQ ID NO: 132056
  derived and/or modified sequence opt3 from hemagglutinin__InfluenzaA__AHG96327

SEQ ID NO: 133016 - RNA, 1701 nt, Artificial Sequence
  derived and/or modified sequence opt3 from hemagglutinin__InfluenzaA__AHG96329
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaagaacucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuaucucaauccuauauaaacgauaagggcaaggaaguacugguucuuuggggcauccaccaccccucaacuaccgccgaccagcagagcuuguaccagaaugcugaugccuacguguucgucgggacaagucgcuauucuaaaaaguuuaaaccugagauugcgauccgaccaaaggugcgugaccaagagggaagaaugaacuacuauuggacucugguggaacccggugauaaaauuaccuucgaggcaacaggcaaccuagucguuccuagguacgccuuuaccauggaacggaaugcuggguccggaaucauaauuagcgacacgccagugcaugauugcaacacuacaugucagaccccggagggcgccaucaauacuucgcuccccuuccagaacauucacccuaucacaaucgguaagugcccaaaauauguaaagucuaccaagcugcgccuugcaacggggcugagaaaugugcccuccauucagucaaggggauuguuuggcgcuauagccggcuucaucgaagggggauggaccgguauggucgacggcugguacggguaucaucaccaaaacgagcagggaaguggcuacgcggccgaccucaaaagcacacagaaugcaauugauaagaucacuaacaaaguuaauuccgugauagagaagaugaacacccaguuuacagcuguggguaaagaguucaaucaccuggagaagcggauugaaaacuuaaauaagaaagucgacgauggguuccuggacaucuggacuuacaacgccgagcuccuugugcuguuggaaaaugagcgcacccuagauuaucaugacucuaacguaaagaaccuguacgagaaaauccgaaaucaacucaagaacaaugcuaaagaaauuggcaacggauguuuugaguucuaucacaagugcgauaauacauguauggaaagcguuaagaacggcaccuacgaguauccuaaauacucagaagaggccaagcugaauagagagaaaaucgacggggugaaacuugaaaguacuaagauuuaucagauacuggcaaucuacuccacggucgccagcucuuuggugcucgucgugucacugggagcuauuaguuuuuggaugugcagcaacgguuccuuacagugcaggaucuguaucuga

SEQ ID NO: 133017 - RNA, 1701 nt, Artificial Sequence
  derived and/or modified sequence opt3 from hemagglutinin__InfluenzaA__AHG96330
augaaggccauccuggugguccuccuuuacaccuucgcuacagcaacugccgacacgcugugcauuggcuaucacgcgaacaauagcaccgauacaguugacacuguguuggagaagaacguaaccgugacacauuccgucaauuuacuggaagauaagcacaacgggaaacuauguaagcucagaggaguggcuccccugcaucuugguaaaugcaauauagccggcuggauccuggggaacccugagugugaaucuuugucaaccgcaaguagcugguccuacauuguugagacuucuucgucagacaauggaacaugcuauccaggcgauuuuaucaacuacgaagaacucagggagcagcugagcaguguguccucuuucgaacgguuugagauuuucccgaagaccagcuccuggcccaaucacgacucaaacaagggugucacggccgcuuguccucaugcaggggccaaaaguuuuuauaagaaucugaucuggcucgugaaaaagggaaacagcuacccaaaauuaucucaauccuauauaaaugauaagggcaaggaaguacugguucuuuggggcauccaccaccccucaacuaccgcugaccagcagagcuuguaccagaacgccgaugcguacguguucgucgggacaagucgcuauucuaaaaaguuuaaaccugagauugcaauccgaccaaaggugcgugaccaagagggaagaaugaauuacuauuggacucugguggaacccggugauaaaauuaccuucgaggccacaggcaaccuagucguuccuagguacgcuuuuaccauggaacggaacgccggguccggaaucauaauuagcgacacgccagugcaugauugcaauacuacaugucagaccccggagggcgcaaucaacacuucgcuccccuuccagaauauucacccuaucacaaucgguaagugcccaaaauauguaaagucuaccaagcugucccuugcuacggggcugcgcaacgugcccucaauucagaguagaggauuguuuggcgccauagcgggcuucaucgaagggggauggaccgguauggucgacggcugguacggguaucaucaccaaaaugagcagggaagcggcuacgccgcagaccucaaauccacacagaacgcuauugauaagaucacuaauaaagugaacucuguuauagagaagaugaauacccaguuuacagccguggguaaagaguucaaccaccuggagaagaggauugaaaauuuaaacaagaaagucgacgauggguuccuggacaucuggacuuacaaugcugagcuccuugugcuguuggaaaacgagcggacccuagauuaucaugacagcaauguaaagaaccuguacgagaaaauccgcaaccaacucaagaauaacgccaaagaaauuggcaauggauguuuugaguucuaucacaagugcgauaacacauguauggaaucaguuaagaauggcaccuacgacuauccuaaauacagugaggaagcaaagcugaaccgagagaaaaucgauggggugaaacuugaguccacuagaauuuaucagauacuggccaucuacagcacggucgcuucuucauuggugcucgucgugagucugggagcgauuagcuuuuggaugugcuccaaugguucuuuacagugcaggaucuguaucuga

SEQ ID NO: 133018 - RNA, 1701 nt, Artificial Sequence; identical to SEQ ID NO: 132056
  derived and/or modified sequence opt3 from hemagglutinin__InfluenzaA__AHG96332

SEQ ID NO: 133019 - RNA, 1701 nt, Artificial Sequence
  derived and/or modified sequence opt3 from hemagglutinin__InfluenzaA__AHG96334
augaaggccauccuggugguccuccuuuacacccuggcuacagcaaacgccgacacuuugugcauuggcuaucacgcgaauaacagcacggauaccguugacacaguguuagagaaaaauguaacugugacccauuccgucaaccugcuagaagauaagcacaaugggaaacucuguaagcugagaggaguggcuccccuucaucuggguaaaugcaacauagccggcuggaucuuggggaauccugagugugaaucucucucaacagcaaguagcugguccuacauuguugagaccucuucgucagacaacggaacuugcuauccaggcgauuucaucaauuacgaggaacugagggagcagcugagcaguguguccucuuuugaacgguucgagauuuuuccgaagacaagcuccuggcccaaccacgacucaaauaagggugucaccgccgcuuguccucaugcaggggccaaaaguuucuauaagaaccucaucugguuagugaaaaagggaaauagcuacccaaaacugucucaauccuauauaaacgauaagggcaaggaaguacuuguuuuguggggcauccaccaccccucaacgacugcugaccagcagagccuguaccagaaugccgaugcguacguguuugucgggaccagucgcuauucuaaaaaguucaaaccugagauugcaauccgaccaaaggugcgugaccaagagggaagaaugaacuacuauuggacacuuguggaacccggugauaaaauuacuuuugaggccaccggcaaccucgucguuccuagguacgcuuucacaauggaacggaaugccggguccggaaucauaauuagcgacaccccagugcaugauugcaacacgacuugucagacaccggagggcgcaaucaauaccucgcugcccuuucagaacauucacccuaucacuaucgguaagugcccaaaauauguaaagucuacaaagcuacgccuggcuaccggguugagaaaugugcccuccauucagucaaggggacucuucggcgccauagcgggcuuuaucgaagggggauggacggguauggucgacggcugguacggguaucaucaccaaaacgagcagggaaguggcuacgccgcagaccugaaaagcacccagaaugcuauugauaagaucacaaacaaaguuaauuccgugauagagaagaugaacacucaguucaccgccguggguaaagaauuuaaucacuuagagaagcggauugaaaaccugaauaagaaagucgacgauggguuccucgacaucuggacauacaacgcugagcuucugguguugcuagaaaaugagcgcacucuggauuaucaugacucuaacguaaagaaccucuacgagaaaguucgaaaucaacugaagaacaaugccaaagaaaucggcaacggauguuucgaguuuuaucacaagugcgauaauaccuguauggaaagcgugaagaacggcacauacgacuauccuaaauacucagaggaagcaaaacuuaauagagagaagauugauggggucaagcuggagaguaccaggaucuaucagauuuuggccauauacuccacuguggcuagcucucucguccuggugguuucauuaggagcgaucaguuucuggaugugcagcaacgguucccugcagugccggauuuguaucuga

SEQ ID NO: 133020 - RNA, 1701 nt, Artificial Sequence
  derived and/or modified sequence opt3 from hemagglutinin__InfluenzaA__AHG96335
augaaggccauccuggugguccuccuuuacaccuucgagacagcuaacgcagacacucugugcauuggcuaucacgccaauaacagcacggauaccguugacacaguguuggaaaagaauguaacugugacccauuccgucaacuuacuggaggauaaacacaaugggaaacuauguaagcucaaaggaguggcgccccugcaucuugguaagugcaacauagcuggcuggauccuggggaauccugaaugugagucuuugucaacagccaguagcugguccuacauuguugaaaccucuucgucagacaacggaacuugcuauccaggcgauuuuaucaauuacgaggagcucagagaacagcugagcaguguguccucuuucgagagguuugaaauuuucccgaagacaagcuccuggcccaaccacgacucaaauaaaggugucaccgcagccuguccucaugcuggggcaaagaguuuuuauaaaaaccugaucuggcucgugaagaaaggaaauagcuacccaaaguuaucucaauccuauauaaacgauaagggcaaagagguacugguucuuuggggcauccaccaccccucaacgacugccgaccagcagagcuuguaccagaaugcugaugccuacguguucgucgggaccagucgguauucuaagaaauuuaagccugagauugcgauccgcccaaaagugcgagaccaagaaggacguaugaacuacuauuggacacugguggagcccggugauaagauuacuuucgaagcaaccggcaaccuagucguuccuagauacgccuuuacaauggagaggaaugcuggguccggaaucauaauuagcgacaccccagugcaugauugcaacacgacuugucagacaccggaaggcgccaucaauaccucgcuccccuuccagaacauucacccuaucacuaucgguaaaugcccaaaguauguaaagucuacaaaacugcggcuugcaaccgggcugcgcaaugugcccuccauucagucaagaggauuguuuggcgcuauagccggcuucaucgaagggggauggacggguauggucgacggcugguacggguaucaucaccaaaacgagcagggaaguggcuacgcggccgaccucaagagcacccagaaugcaauugauaaaaucacaaacaagguaaauuccguuauagagaaaaugaacacucaguuuaccgcuguggguaaggaguucaaucaccuggaaaagaggauugagaacuuaaauaaaaaggucgacgauggguuccuggacaucuggacauacaacgccgaacuccuugugcuguuggagaaugagcggacucuagauuaucaugacucuaacgugaaaaaccuguacgaaaagguucgcaaucaacucaaaaacaaugcuaaggagaucggcaacggauguuuugaguucuaucacaagugcgauaauaccuguauggaaagcgugaaaaacggcacauacgacuauccuaaguacucagaagaggccaaacugaaucgagagaagauugauggggucaaacuugaaaguaccagaaucuaucagauucuggcaauauacuccacuguggccagcucuuugguccucgugguuucacugggagcuaucaguuuuuggaugugcagcaacgguuccuuacagugcaggauuuguaucuga

SEQ ID NO: 133021 - RNA, 1701 nt, Artificial Sequence
  derived and/or modified sequence opt3 from hemagglutinin__InfluenzaA__AHG96336
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcgcgauugcaacacgacuugucagacaccggagggcgcaaucaauaccucgcuccccuuccagaacauucauccuaucacuaucgguaagugcccaaaauauguaaagucuacaaagcugagacuugcuaccgggcugaggaaugugcccuccauucagucacggggauuguuuggcgccauagcgggcuucaucgaagggggauggacggguauggucgacggcugguacggguaucaccaucaaaacgagcagggaaguggcuacgccgcagaccucaaaagcacccagaaugcuauugauaagaucacaaacaaaguuaauuccgugauagagaagaugaacacucaguuuaccgccguggguaaagaguucaaucaccuggagaagcgcauugaaaacuuaaauaagaaagucgacgauggguuccuggacaucuggacauacaacgcugagcuccuugugcuguuggaaaaugagcgaacucuagauuaucacgacucuaacguaaagaaccuguacgagaaaguuagaaaucaacucaagaacaaugccaaagaaaucggcaacggauguuuugaguucuaucauaagugcgauaauaccuguauggaaagcgugaagaacggcacauacgacuauccuaaauacucagaggaagcaaagcugaauagggagaaaauugauggggucaaacuugagaguacccggaucuaucagauucuggccauauacuccacuguggcuagcucuuugguccucgugguuucacugggagcgaucaguuuuuggaugugcagcaacgguuccuuacagugccguauuuguaucuga

SEQ ID NO: 133022 - RNA, 1701 nt, Artificial Sequence
  derived and/or modified sequence opt3 from hemagglutinin__InfluenzaA__AHG96338
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguagucaugcaggggccaagagcuuuuauaagaaccugaucuggcucgugaaaaagggaaauucuuacccuaaauuaucccaaucauauauaaacgauaagggcaaggaaguacugguucuuuggggcauccaccacccaagcacgacugcugaccagcagaguuuguaccagaaugccgaugcguacguguucgucgggaccucucgcuauuccaaaaaguuuaaacccgagauugcaauccgaccuaaggugcgugaccaagagggaagaaugaacuacuauuggacacugguggaaccaggugauaaaauuacuuucgaggccaccggcaaccuagucguucccagguacgcuuuuacaauggaacggaaugccgggagcggaaucauaauuucggacaccccugugcaugauugcaacacgacuugucagacaccagagggcgcaaucaauaccucucucccguuccagaacauucaccccaucacuaucgguaagugcccuaaauauguaaaguccacaaagcugcgccuugcuaccgggcugagaaaugugccaucaauucagaguaggggauuguuuggcgccauagcgggcuucaucgaagggggauggacggguauggucgacggcugguacggguaucaucaccaaaacgagcagggaagcggcuacgccgcagaccucaaauccacccagaaugcuauugauaagaucacaaacaaaguuaauucugugauagagaagaugaacacucaguuuaccgccguggguaaagaguucaaucaccuggagaagcggauugaaaacuuaaauaagaaagucgacgauggguuccuggacaucuggacauacaacgcugagcuccuugugcuguuggaaaaugagcgcacucuagauuaucaugacagcaacguaaagaaccuguacgagaaaguucgaaaucaacucaagaacaaugccaaagaaaucggcaacggauguuuugaguucuaucacaagugcgauaauaccuguauggaaucagugaagaacggcacauacgacuaucccaaauacagugaggaagcaaagcugaauagagagaaaauugauggggucaaacuugaguccaccaggaucuaucagauucuggccauauacagcacuguggcuucuucauugguccucgugguuagucugggagcgaucagcuuuuggaugugcuccaacgguucuuuacagugccggauuuguaucuga

SEQ ID NO: 133023 - RNA, 1701 nt, Artificial Sequence
  derived and/or modified sequence opt3 from hemagglutinin__InfluenzaA__AHG96339
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaauccugguacuuuggggcauucaccaccccucaacgacugcugaccagcagagcuuguaccagaaugccgaugcguacguuuucguggggaccagucgcuauucuaaaaaguuuaaaccugagaucgcaauucgaccaaagguccgugaccaagagggaagaaugaacuacuauuggacacugguggaacccggugauaaaaucacuuucgaggccaccggcaaccuaguggucccuagguacgcuuuuacaauggaacggaaugccggguccggaauaauuaucagcgacaccccaguucaugauugcaacacgacuugucagacaccggagggcgcaauuaauaccucgcuccccuuccagaacauccacccuaucacuauugguaagugcccaaaauaugugaagucuacaaagcugcgccuugcuaccgggcugagaaauguacccuccauacagucaaggggauuguuuggcgccaucgcgggcuucauugaagggggauggacggguaugguggacggcugguacggguaucaucaccaaaacgagcagggaaguggcuacgccgcagaccucaaaagcacccagaaugcuaucgauaagauaacaaacaaagucaauuccgugauugagaagaugaacacucaguuuaccgccguugguaaagaguucaaucaccuggagaagcggaucgaaaacuuaaauaagaaaguggacgauggguuccuggacaucuggacauacaacgcugagcuccuuguccuguuggaaaaugagcgcacucuagauuaucaugacucuaacgugaagaaccuguacgagaaaguacgaaaucaacucaagaacaaugccaaagaaauuggcaacggauguuuugaguucuaucacaagugcgauaauaccuguauggaaagcguuaagaacggcacauacgacuauccuaaauacucagaggaagcaaagcugaauagagagaaaaucgauggggugaaacuugagaguaccaggauuuaucagauacuggccaucuacuccacugucgcuagcucuuuggugcucgucgugucacugggagcgauuaguuuuuggaugugcagcaacgguuccuuacagugccggaucuguaucuga

SEQ ID NO: 133024 - RNA, 1701 nt, Artificial Sequence; identical to SEQ ID NO: 132056
  derived and/or modified sequence opt3 from hemagglutinin__InfluenzaA__AHG96340

SEQ ID NO: 133025 - RNA, 1701 nt, Artificial Sequence
  derived and/or modified sequence opt3 from hemagglutinin__InfluenzaA__AHG96341
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccaguaaauauucuaagaaauuuaagccugagauugcaauccgcccaaaagugcgagaccaagagggacguaugaacuacuauuggacacugguggaacccggugauaagauuacuuucgaggccaccggcaaccuagucguuccuagauacgcuuuuacaauggaaaggaaugccggguccggaaucauaauuagcgacaccccagugcaugauugcaacacgacuugucagacaccggagggcgcaaucaauaccucgcuccccuuccagaacauucacccuaucacuaucgguaaaugcccaaaguauguaaagucuacaaaacugcggcuugcuaccgggcugcgcaauauucccuccauacagucaagaggauuguuuggcgccaucgcgggcuucauugaagggggauggacggguaugguggacggcugguacggguaucaucaccaaaacgagcagggaaguggcuacgccgcagaccucaagagcacccagaaugcuaucgauaaaauaacaaacaaggucaauuccgugauugagaaaaugaacacucaguuuaccgccguugguaaggaguucaaucaccuggagaagaggaucgaaaacuuaaauaaaaagguggacgauggguuccuggacaucuggacauacaacgcugagcuccuuguccuguuggaaaaugagcggacucuagauuaucaugacucuaacgugaaaaaccuguacgagaagguacgcaaucaacucaaaaacaaugccaaggaaauuggcaacggauguuuugaguucuaucacaagugcgauaauaccuguauggaaagcguuaaaaacggcacauacgacuauccuaaguacucagaggaagcaaaacugaaucgagagaagaucgauggggugaaacuugagaguaccagaauuuaucagauacuggccaucuacuccacugucgcuagcucuuuggugcucgucgugucacugggagcgauuaguuuuuggaugugcagcaacgguuccuuacagugcaggaucuguaucuga

SEQ ID NO: 133026 - RNA, 1701 nt, Artificial Sequence
  derived and/or modified sequence opt3 from hemagglutinin__InfluenzaA__AHG96342
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaauauucccuccauacagucaaggggauuguuuggcgccaucgcgggcuucauugaagggggauggacggguaugguggacggcugguacggguaucaucaccaaaacgagcagggaaguggcuacgccgcagaccucaaaagcacccagaaugcuaucgauaagauaacaaacaaagucaauuccgugauugagaagaugaacacucaguuuaccgccguugguaaagaguucaaucaccuggagaagcggaucgaaaacuuaaauaagaaaguggacgauggguuccuggacaucuggacauacaacgcugagcuccuuguccuguuggaaaaugagcgcacucuagauuaucaugacucuaacgugaagaaccuguacgagaaaguacgaaaucaacucaagaacaaugccaaagaaauuggcaacggauguuuugaguucuaucacaagugcgauaauauguguauggaaagcguuaagaacggcaccuacgacuauccuaaauacucagaggaagcaaagcugaauagagagaaaaucgauggggugaaacuugagaguacaaggauuuaucagauacuggccaucuacuccaccgucgcuagcucuuuggugcucgucgugucacugggagcgauuaguuuuuggaugugcagcaacgguuccuuacagugccggaucuguaucuga

SEQ ID NO: 133027 - RNA, 1701 nt, Artificial Sequence
  derived and/or modified sequence opt3 from hemagglutinin__InfluenzaA__AHG96343
augaaggccauccuggugguccuccuuuacaccuucgcuacagcaacugccgacacgcugugcauuggcuaucacgcgaacaauagcaccgauacaguugacacuguguuggagaagaacguaaccgugacacauuccgucaauuuacuggaagauaagcacaacgggaaacuauguaagcucagaggaguggcuccccugcaucuugguaaaugcaauauagccggcuggauccuggggaacccugagugugaaucuuugucaaccgcaaguagcugguccuacauuguugagacuucuaauucggacaacggaacaugcuauccaggcgauuuuaucaauuacgaagaacucagggagcagcugucaagcgugaguuccuucgaacgguuugagauuuucccgaagaccucuagcuggcccaaccacgacuccaauaagggugucacggccgcuuguccucaugcaggggccaaaucauuuuauaagaaccugaucuggcucgugaaaaagggaaauaguuacccaaaauuaagccaaucuuauauaaacgauaagggcaaggaaguacugguucuuuggggcauccaccaccccuccacuaccgcugaccagcagucauuguaccagaaugccgaugcguacguguucgucgggacaagccgcuauaguaaaaaguuuaaaccugagauugcaauccgaccaaaggugcgugaccaagagggaagaaugaacuacuauuggacucugguggaacccggugauaaaauuaccuucgaggccacaggcaaccuagucguuccuagguacgcuuuuaccauggaacggaaugccgggucuggaaucauaauuuccgacacgccagugcaugauugcaacacuacaugucagaccccggagggcgcaaucaauacuagccuccccuuccagaacauucacccuaucacaaucgguaagugcccaaaauauguaaagucgaccaagcugcgccuugcuacggggcugagaaaugugcccucuauucaguccaggggauuguuuggcgccauagcgggcuucaucgaagggggauggaccgguauggucgacggcugguacggguaucaucaccaaaacgagcagggaucaggcuacgccgcagaccucaaaaguacacagaaugcuauugauaagaucacuaacaaagugaauagcguuauagagaagaugaacacccaguuuacagccguggguaaagaguucaaucaccuggagaagcggauugaaaacuuaaauaagaaagucgacgauggguuccuggacaucuggacuuacaacgcugagcuccuugugcuguuggaaaaugagcgcacccuagauuaucaugacuccaacguaaagaaccuguacgagaaaguucgaaaucaacucaagaacaaugccaaagaaaucggcaacggauguuuugaguucuaucacaagugcgauaauacauguauggaaucugugaagaacggcaccuacgacuauccuaaauacagcgaggaagcaaagcugaauagagagaaaauugauggggucaaacuugagucaacuaggaucuaucagauucuggccauauacaguacgguggcuuccagcuugguccucgugguuucucugggagcgaucucauuuuggaugugcaguaacgguagcuuacagugccggauuuguaucuga

SEQ ID NO: 133028 - RNA, 1701 nt, Artificial Sequence; identical to SEQ ID NO: 132056
  derived and/or modified sequence opt3 from hemagglutinin__InfluenzaA__AHG96344

SEQ ID NO: 133029 - RNA, 1701 nt, Artificial Sequence; identical to SEQ ID NO: 133019
  derived and/or modified sequence opt3 from hemagglutinin__InfluenzaA__AHG96345

SEQ ID NO: 133030 - RNA, 1701 nt, Artificial Sequence; identical to SEQ ID NO: 132056
  derived and/or modified sequence opt3 from hemagglutinin__InfluenzaA__AHG96346

SEQ ID NO: 133031 - RNA, 1701 nt, Artificial Sequence; identical to SEQ ID NO: 132056
  derived and/or modified sequence opt3 from hemagglutinin__InfluenzaA__AHG96347

SEQ ID NO: 133032 - RNA, 1701 nt, Artificial Sequence; identical to SEQ ID NO: 132056
  derived and/or modified sequence opt3 from hemagglutinin__InfluenzaA__AHG96348

SEQ ID NO: 133033 - RNA, 1701 nt, Artificial Sequence; identical to SEQ ID NO: 132056
  derived and/or modified sequence opt3 from hemagglutinin__InfluenzaA__AHG96349

SEQ ID NO: 133034 - RNA, 1701 nt, Artificial Sequence; identical to SEQ ID NO: 132056
  derived and/or modified sequence opt3 from hemagglutinin__InfluenzaA__AHG96350

SEQ ID NO: 133035 - RNA, 1701 nt, Artificial Sequence; identical to SEQ ID NO: 132056
  derived and/or modified sequence opt3 from hemagglutinin__InfluenzaA__AHG96351

SEQ ID NO: 133036 - RNA, 1701 nt, Artificial Sequence; identical to SEQ ID NO: 132056
  derived and/or modified sequence opt3 from hemagglutinin__InfluenzaA__AHG96352

SEQ ID NO: 133037 - RNA, 1701 nt, Artificial Sequence
  derived and/or modified sequence opt3 from hemagglutinin__InfluenzaA__AHG96353
augaaggccauccuggugguccuccuuuacaccuucgcuacaacuaacgcagacacgcugugcauuggcuaucacgccaauaacagcaccgauacaguugacacuguguuggagaagaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaagaacucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuaucucaauccuauauaaacgauaagggcaaggaaguacugguucuuuggggcauccaccaccccucaacuaccgccgaccagcagagcuuguaccagaaugcugaugccuacguguucgucgggacaagucgcuauucuaaaaaguuuaaaccugagauugcgauccgaccaaaggugcgugaccaagagggaagaaugaacuacuauuggacucugguggaacccggugauaaaauuaccuucgaggcaacaggcaaccuagucguuccuagguacgccuuuaccauggaacggaaugcuggguccggaaucauaauuagcgacacgccagugcaugauugcaacacuacaugucagaccccggagggcgccaucaauacuucgcuccccuuccagaacauucacccuaucacaaucgguaagugcccaaaauauguaaagucuaccaagcugcgccuugcaacggggcugagaaaugugcccuccauucagucaaggggauuguuuggcgcuauagccggcuucaucgaagggggauggaccgguauggucgacggcugguacggguaucaucaccaaaacgagcagggaaguggcuacgcggccgaccucaaaagcacacagaaugcaauugauaagaucacuaacaaaguuaauuccgugauagagaagaugaacacccaguuuacagcuguggguaaagaguucaaucaccuggagaagcggauugaaaacuuaaauaagaaagucgacgauggguuccuggacaucuggacuuacaacgccgagcuccuugugcuguuggaaaaugagcgcacccuagauuaucaugacucuaacguaaagaaccuguacgagaaaguucgaaaucaacucaagaacaaugcuaaagaaaucggcaacggauguuuugaguucuaucacaagugcgauaauacauguauggaaagcgugaagaacggcaccuacgacuauccuaaauacucagaggaagccaagcugaauagagagaaaauugauggggucaaacuugagaguacuaggaucuaucagauucuggcaauauacuccacgguggccagcucuuugguccucgugguuucacugggagcuaucaguuuuuggaugugcagcaacgguuccuuacagugccggauuuguaucuga

SEQ ID NO: 133038 - RNA, 1701 nt, Artificial Sequence; identical to SEQ ID NO: 132056
  derived and/or modified sequence opt3 from hemagglutinin__InfluenzaA__AHG96354

SEQ ID NO: 133039 - RNA, 1701 nt, Artificial Sequence
  derived and/or modified sequence opt3 from hemagglutinin__InfluenzaA__AHG96355
augaaggccauccuggugguccuccuuuacacccuggcuacagcaaacgccgacacuuugugcauuggcuaucacgcgaauaacagcacggauaccguugacacaguguuagagaaaaauguaacugugacccauuccgucaaccugcuagaagauaagcacaaugggaaacucuguaagcugagaggaguggcuccccuucaucuggguaaaugcaacauagccggcuggaucuuggggaauccugagugugaaucucucucaacagcaaguagcugguccuacauuguugagaccucuucgucagacaacggaacuugcuauccaggcgauuucaucaauuacgaggaacugagggagcagcugagcaguguguccucuuuugaacgguucgagauuuuuccgaagacaagcuccuggcccaaccacgacucaaauaagggugucaccgccgcuuguccucaugcaggggccaaaaguuucuauaagaaccucaucugguuagugaaaaagggaaauagcuacccaaaacugucucaauccuauauaaacgauaagggcaaggaaguacuuguuuuguggggcauccaccaccccucaacgacugcugaccagcagagccuguaccagaaugccgaugcguacguguuugucgggaccagucgcuauucuaaaaaguucaaaccugagauugcaauccgaccaaaggugcgugaccaagagggaagaaugaacuacuauuggacacuuguggaacccggugauaaaauuacuuuugaggccaccggcaaccucgucguuccuagguacgcuuucacaauggaacggaaugccggguccggaaucauaauuagcgacaccccagugcaugauugcaacacgacuugucagacaccggagggcgcaaucaauaccucgcugcccuuucagaacauucacccuaucacuaucgguaagugcccaaaauauguaaagucuacaaagcuacgccuggcuaccggguugagaaaugugcccuccauucagucaaggggacucuucggcgccauagcgggcuuuaucgaagggggauggacggguauggucgacggcugguacggguaucaucaccaaaacgagcagggaaguggcuacgccgcagaccugaaaagcacccagaaugcuauugauaagaucacaaacaaaguuaauuccgugauagagaagaugaacacucaguucaccgccguggguaaagaauuuaaucaauuagagaagcggauugaaaaccugaauaagaaagucgacgauggguuccucgacaucuggacauacaacgcugagcuucugguguugcuagaaaaugagcgcacucuggauuaucacgacucuaacguaaagaaccucuacgagaaaguucgaaaucagcugaagaacaaugccaaagaaaucggcaacggauguuucgaguuuuaucauaagugcgauaauaccuguauggaaagcgugaagaacggcacauacgacuauccuaaauacucagaggaagcaaaacuuaauagagagaagauugauggggucaagcuggagaguaccaggaucuaucagauuuuggccauauacuccacuguggcuagcucucucguccuggugguuucauuaggagcgaucaguuucuggaugugcagcaacgguucccugcaaugccggauuuguaucuga

SEQ ID NO: 133040 - RNA, 1701 nt, Artificial Sequence; identical to SEQ ID NO: 131874
  derived and/or modified sequence opt3 from hemagglutinin__InfluenzaA__AHG96356

SEQ ID NO: 133041 - RNA, 1701 nt, Artificial Sequence
  derived and/or modified sequence opt3 from hemagglutinin__InfluenzaA__AHG96359
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacgacgaauccuucaauuggacagggguuacccagaacggaacgucuagcuccugcaagcggcgcucaaauaacagcuuuuucagccgacugaauuggcucacucauuuaaaguuuaaauauccagcucugaacgugaccaugcccaauaacgagaaguucgauaaacuuuacaucuggggcguccaccauccugugacagacaacgaucagauuuuucuuuaugcacaggccucuggccguaucacuguauccaccaagagaucacaacagacaguuauuccaaauaucgggagcaggccccggauacgcaacauuccuaguagaaucucuauuuacuggaccaucgugaaaccaggagacauccugcuaauuaauuccacggguaaccucauagcuccgaggggcuacuucaagauccggagcgggaagucgucuauuaugcgcuccgacgcccccaucggaaaauguaauucagagugcauaacuccuaacggcaguauuccaaaugauaagcccuuucagaacgucaaucgaaucacauauggugcguguccuagauacgugaaacagaacacccugaaguuggcaacugggaugaggaaugugccagaaaaacaaacacggggaaucuucggcgccauugcuggcuuuaucgagaacgggugggaaggaauggucgacgguugguauggcuuccgucaccagaauagcgaggggauuggacaggccgcagaucugaaguccacccaagcugccauaaaccagaucaauggcaaauugaaccgccucauugguaagacgaacgagaaguuccaccagaucgaaaaagaguuuucugaaguugaggggagaauccaggaccuggaaaaguacguggaggauaccaaaauugacuuauggagcuauaaugcggagcugcucguagcccuugaaaaccaacauacaauagaucugacugacucagagaugaauaaguuguucgaaaggaccaaaaagcagcuacgggagaacgcagaagauaugggcaauggaugcuuuaagaucuaccacaaaugugacaacgcuugcauuggcaguauccgaaaugggacauaugaucaugacguguaccgcgacgaggcccugaacaauagauuccagauuaagggagucgagcucaaauccgguuacaaggauuggauccuguggauaaguuuugcuaucucuugcuuccuucuguguguggccuugcucggcuuuauuaugugggcaugccagaaagggaacaucagguguaauauuugcaucuga

SEQ ID NO: 133042 - RNA, 1701 nt, Artificial Sequence; identical to SEQ ID NO: 133041
  derived and/or modified sequence opt3 from hemagglutinin__InfluenzaA__AHG96371

SEQ ID NO: 133043 - RNA, 1701 nt, Artificial Sequence; identical to SEQ ID NO: 133041
  derived and/or modified sequence opt3 from hemagglutinin__InfluenzaA__AHG96383

SEQ ID NO: 133044 - RNA, 1698 nt, Artificial Sequence; identical to SEQ ID NO: 129809
  derived and/or modified sequence opt3 from hemagglutinin__InfluenzaA__AHG96395

SEQ ID NO: 133045 - RNA, 1701 nt, Artificial Sequence; identical to SEQ ID NO: 133041
  derived and/or modified sequence opt3 from hemagglutinin__InfluenzaA__AHG96407

SEQ ID NO: 133046 - RNA, 1701 nt, Artificial Sequence; identical to SEQ ID NO: 133041
  derived and/or modified sequence opt3 from hemagglutinin__InfluenzaA__AHG96419

SEQ ID NO: 133047 - RNA, 1701 nt, Artificial Sequence; identical to SEQ ID NO: 133041
  derived and/or modified sequence opt3 from hemagglutinin__InfluenzaA__AHG96431

SEQ ID NO: 133048 - RNA, 1701 nt, Artificial Sequence; identical to SEQ ID NO: 133041
  derived and/or modified sequence opt3 from hemagglutinin__InfluenzaA__AHG96443

SEQ ID NO: 133049 - RNA, 1701 nt, Artificial Sequence; identical to SEQ ID NO: 133041
  derived and/or modified sequence opt3 from hemagglutinin__InfluenzaA__AHG96455

SEQ ID NO: 133050 - RNA, 1701 nt, Artificial Sequence; identical to SEQ ID NO: 133041
  derived and/or modified sequence opt3 from hemagglutinin__InfluenzaA__AHG96467

SEQ ID NO: 133051 - RNA, 1701 nt, Artificial Sequence; identical to SEQ ID NO: 133041
  derived and/or modified sequence opt3 from hemagglutinin__InfluenzaA__AHG96479

SEQ ID NO: 133052 - RNA, 1701 nt, Artificial Sequence; identical to SEQ ID NO: 133041
  derived and/or modified sequence opt3 from hemagglutinin__InfluenzaA__AHG96491

SEQ ID NO: 133053 - RNA, 1701 nt, Artificial Sequence; identical to SEQ ID NO: 124372
  derived and/or modified sequence opt3 from hemagglutinin__InfluenzaA__AHG96503

SEQ ID NO: 133054 - RNA, 1698 nt, Artificial Sequence; identical to SEQ ID NO: 129809
  derived and/or modified sequence opt3 from hemagglutinin__InfluenzaA__AHG96515

SEQ ID NO: 133055 - RNA, 1698 nt, Artificial Sequence; identical to SEQ ID NO: 129809
  derived and/or modified sequence opt3 from hemagglutinin__InfluenzaA__AHG96527

SEQ ID NO: 133056 - RNA, 1698 nt, Artificial Sequence; identical to SEQ ID NO: 129809
  derived and/or modified sequence opt3 from hemagglutinin__InfluenzaA__AHG96539

SEQ ID NO: 133057 - RNA, 1698 nt, Artificial Sequence; identical to SEQ ID NO: 129809
  derived and/or modified sequence opt3 from hemagglutinin__InfluenzaA__AHG96551

SEQ ID NO: 133058 - RNA, 1698 nt, Artificial Sequence; identical to SEQ ID NO: 132989
  derived and/or modified sequence opt3 from hemagglutinin__InfluenzaA__AHG96563

SEQ ID NO: 133059 - RNA, 1698 nt, Artificial Sequence; identical to SEQ ID NO: 129809
  derived and/or modified sequence opt3 from hemagglutinin__InfluenzaA__AHG96575

SEQ ID NO: 133060 - RNA, 1698 nt, Artificial Sequence; identical to SEQ ID NO: 129809
  derived and/or modified sequence opt3 from hemagglutinin__InfluenzaA__AHG96587

SEQ ID NO: 133061 - RNA, 1698 nt, Artificial Sequence; identical to SEQ ID NO: 129809
  derived and/or modified sequence opt3 from hemagglutinin__InfluenzaA__AHG96599

SEQ ID NO: 133062 - RNA, 1698 nt, Artificial Sequence; identical to SEQ ID NO: 129809
  derived and/or modified sequence opt3 from hemagglutinin__InfluenzaA__AHG96611

SEQ ID NO: 133063 - RNA, 1698 nt, Artificial Sequence; identical to SEQ ID NO: 129809
  derived and/or modified sequence opt3 from hemagglutinin__InfluenzaA__AHG96623

SEQ ID NO: 133064 - RNA, 1698 nt, Artificial Sequence; identical to SEQ ID NO: 129809
  derived and/or modified sequence opt3 from hemagglutinin__InfluenzaA__AHG96635

SEQ ID NO: 133065 - RNA, 1698 nt, Artificial Sequence; identical to SEQ ID NO: 129809
  derived and/or modified sequence opt3 from hemagglutinin__InfluenzaA__AHG96647

SEQ ID NO: 133066 - RNA, 1698 nt, Artificial Sequence; identical to SEQ ID NO: 129809
  derived and/or modified sequence opt3 from hemagglutinin__InfluenzaA__AHG96659

SEQ ID NO: 133067 - RNA, 1698 nt, Artificial Sequence; identical to SEQ ID NO: 129809
  derived and/or modified sequence opt3 from hemagglutinin__InfluenzaA__AHG96671

SEQ ID NO: 133068 - RNA, 1698 nt, Artificial Sequence; identical to SEQ ID NO: 129809
  derived and/or modified sequence opt3 from hemagglutinin__InfluenzaA__AHG96683

SEQ ID NO: 133069 - RNA, 1701 nt, Artificial Sequence; identical to SEQ ID NO: 133041
  derived and/or modified sequence opt3 from hemagglutinin__InfluenzaA__AHG96695

SEQ ID NO: 133070 - RNA, 1701 nt, Artificial Sequence; identical to SEQ ID NO: 133041
  derived and/or modified sequence opt3 from hemagglutinin__InfluenzaA__AHG96707

SEQ ID NO: 133071 - RNA, 1701 nt, Artificial Sequence; identical to SEQ ID NO: 133041
  derived and/or modified sequence opt3 from hemagglutinin__InfluenzaA__AHG96719

SEQ ID NO: 133072 - RNA, 1701 nt, Artificial Sequence; identical to SEQ ID NO: 133041
  derived and/or modified sequence opt3 from hemagglutinin__InfluenzaA__AHG96731

SEQ ID NO: 133073 - RNA, 1701 nt, Artificial Sequence; identical to SEQ ID NO: 133041
  derived and/or modified sequence opt3 from hemagglutinin__InfluenzaA__AHG96743

SEQ ID NO: 133074 - RNA, 1701 nt, Artificial Sequence; identical to SEQ ID NO: 133041
  derived and/or modified sequence opt3 from hemagglutinin__InfluenzaA__AHG96755

SEQ ID NO: 133075 - RNA, 1701 nt, Artificial Sequence; identical to SEQ ID NO: 133041
  derived and/or modified sequence opt3 from hemagglutinin__InfluenzaA__AHG96767

SEQ ID NO: 133076 - RNA, 1701 nt, Artificial Sequence; identical to SEQ ID NO: 133041
  derived and/or modified sequence opt3 from hemagglutinin__InfluenzaA__AHG96779

SEQ ID NO: 133077 - RNA, 1701 nt, Artificial Sequence
  derived and/or modified sequence opt3 from hemagglutinin__InfluenzaA__AHG96791
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacgacgaauccuucaauuggacagggguuacccagaacggaacgucuagcuccugcaagcggcgcucaaauaacagcuuuuucagccgacugaauuggcucacucaguuaaaguuuaaauauccagcucugaacgugaccaugcccaauaacgagaaguucgauaaacuuuacaucuggggcguccaucacccugugacagacaacgaucagauuuuucuuuaugcacaagccucuggccguaucacuguauccaccaagagaucacagcagacaguuauuccaaauaucgggagcaggccccggauacgcaacauuccuaguagaaucucuauuuacuggaccaucgugaaaccaggagacauccugcuaauuaauuccacggguaaccucauagcuccgaggggcuacuucaagauccggagcgggaagucgucuauuaugcgcuccgacgcccccaucggaaaauguaauucagagugcauaacuccuaacggcaguauuccaaaugauaagcccuuucagaacgucaaucgaaucacauauggugcguguccuagauacgugaaacaaaacacccugaaguuggcaacugggaugaggaaugugccagaaaaacagacacggggaaucuucggcgccauugcuggcuuuaucgagaacgggugggaaggaauggucgacgguugguauggcuuccgucaucagaauagcgaggggauuggacaagccgcagaucugaaguccacccaggcugccauaaaccagaucaauggcaaauugaaccgccucauugguaagacgaacgagaaguuccaccagaucgaaaaagaguuuucugaaguugagagaaggauccaagaccuggaaaaguacguggaggauaccaaaauugacuuauggagcuauaaugcggagcugcucguagcccuugaaaaccagcacacaauagaucugacugacucagagaugaauaaguuguucgaacggaccaaaaagcagcuacgagagaacgcagaagauauggggaauggcugcuuuaagaucuaccauaaaugugacaacgcuugcauuggaaguauccgcaauggcacauaugaucacgacguguacagagacgaggcccugaacaauagguuccagauuaagggggucgagcucaaauccggauacaaggauuggauccuguggauaaguuuugcuaucucuugcuuccuucuguguguggccuugcucgguuuuauuaugugggcaugccaaaaaggcaacauccgguguaauauuugcaucuga

SEQ ID NO: 133078 - RNA, 1701 nt, Artificial Sequence; identical to SEQ ID NO: 133041
  derived and/or modified sequence opt3 from hemagglutinin__InfluenzaA__AHG96803

SEQ ID NO: 133079 - RNA, 1701 nt, Artificial Sequence; identical to SEQ ID NO: 133041
  derived and/or modified sequence opt3 from hemagglutinin__InfluenzaA__AHG96815

SEQ ID NO: 133080 - RNA, 1701 nt, Artificial Sequence; identical to SEQ ID NO: 133041
  derived and/or modified sequence opt3 from hemagglutinin__InfluenzaA__AHG96827

SEQ ID NO: 133081 - RNA, 1701 nt, Artificial Sequence; identical to SEQ ID NO: 133041
  derived and/or modified sequence opt3 from hemagglutinin__InfluenzaA__AHG96839

SEQ ID NO: 133082 - RNA, 1701 nt, Artificial Sequence; identical to SEQ ID NO: 133041
  derived and/or modified sequence opt3 from hemagglutinin__InfluenzaA__AHG96851

SEQ ID NO: 133083 - RNA, 1701 nt, Artificial Sequence; identical to SEQ ID NO: 133041
  derived and/or modified sequence opt3 from hemagglutinin__InfluenzaA__AHG96863

SEQ ID NO: 133084 - RNA, 1701 nt, Artificial Sequence; identical to SEQ ID NO: 133041
  derived and/or modified sequence opt3 from hemagglutinin__InfluenzaA__AHG96875

SEQ ID NO: 133085 - RNA, 1701 nt, Artificial Sequence; identical to SEQ ID NO: 133041
  derived and/or modified sequence opt3 from hemagglutinin__InfluenzaA__AHG96887

SEQ ID NO: 133086 - RNA, 1701 nt, Artificial Sequence; identical to SEQ ID NO: 133041
  derived and/or modified sequence opt3 from hemagglutinin__InfluenzaA__AHG96899

SEQ ID NO: 133087 - RNA, 1701 nt, Artificial Sequence; identical to SEQ ID NO: 133041
  derived and/or modified sequence opt3 from hemagglutinin__InfluenzaA__AHG96911

SEQ ID NO: 133088 - RNA, 1701 nt, Artificial Sequence; identical to SEQ ID NO: 133041
  derived and/or modified sequence opt3 from hemagglutinin__InfluenzaA__AHG96923

SEQ ID NO: 133089 - RNA, 1701 nt, Artificial Sequence; identical to SEQ ID NO: 133041
  derived and/or modified sequence opt3 from hemagglutinin__InfluenzaA__AHG96935

SEQ ID NO: 133090 - RNA, 1701 nt, Artificial Sequence; identical to SEQ ID NO: 133041
  derived and/or modified sequence opt3 from hemagglutinin__InfluenzaA__AHG96947

SEQ ID NO: 133091 - RNA, 1701 nt, Artificial Sequence; identical to SEQ ID NO: 133041
  derived and/or modified sequence opt3 from hemagglutinin__InfluenzaA__AHG96959

SEQ ID NO: 133092 - RNA, 1701 nt, Artificial Sequence; identical to SEQ ID NO: 133041
  derived and/or modified sequence opt3 from hemagglutinin__InfluenzaA__AHG96971

SEQ ID NO: 133093 - RNA, 1701 nt, Artificial Sequence; identical to SEQ ID NO: 133041
  derived and/or modified sequence opt3 from hemagglutinin__InfluenzaA__AHG96983

SEQ ID NO: 133094 - RNA, 1701 nt, Artificial Sequence; identical to SEQ ID NO: 133041
  derived and/or modified sequence opt3 from hemagglutinin__InfluenzaA__AHG96995

SEQ ID NO: 133095 - RNA, 1701 nt, Artificial Sequence; identical to SEQ ID NO: 133041
  derived and/or modified sequence opt3 from hemagglutinin__InfluenzaA__AHG97007

SEQ ID NO: 133096 - RNA, 1701 nt, Artificial Sequence; identical to SEQ ID NO: 133041
  derived and/or modified sequence opt3 from hemagglutinin__InfluenzaA__AHG97019

SEQ ID NO: 133097 - RNA, 1701 nt, Artificial Sequence; identical to SEQ ID NO: 133041
  derived and/or modified sequence opt3 from hemagglutinin__InfluenzaA__AHG97031

SEQ ID NO: 133098 - RNA, 1701 nt, Artificial Sequence; identical to SEQ ID NO: 133041
  derived and/or modified sequence opt3 from hemagglutinin__InfluenzaA__AHG97043

SEQ ID NO: 133099 - RNA, 1701 nt, Artificial Sequence
  derived and/or modified sequence opt3 from hemagglutinin__InfluenzaA__AHH00866
augaagaccaucauugcccugagcuacauacucugccuugcuuucgcacagaaacugcccggcaacgacaauuccacagccacuuuguguuuagggcaccaugcggugccuaacggaacgcuggucaagaccaucacaaaugaucaaauugagguuacuaacgcuaccgagcuagugcagucuucaaguacagguagaaucugcgacagcccacaccagauucucgauggcgaaaauuguacccugaucgacgcccuucugggggauccgcauugcgacggauuucagaacaaagaaugggauuuguucguagagagguccaaggcauauucuaauuguuaccccuaugacgugccugauuacgccucgcuccggucacuggucgcuagcaguggcacucuggaauuuaacaaugaguccuucaacuggacagguguggcacaaaaugggaccucuagcgccugcaaacgccgauccauaaagucauuuuucagucgucucaacugguuacaccagcuggagaauagauauccagcucuuaacguuacgaugcccaauaacgacaaguuugauaaauuguacaucuggggagugcaucacccuagcacugacucugaucagauuuccgucuaugcccaggcgucaggcagggugaccguaagcacaaagcggagucaacagacuguuaucccaaacauuggcucucgccccugggugagagggaucuccagcaggauaucgauuuacuggaccaucgucaauccuggagacauucugcuaaucaacucuacagguaaucucaucgcaccacggggcuacuucaaaauucgcuccgggaagucaaguauaaugcgaagcgacgccccgaucggaaaauguaacuccgaaugcauuacccccaauggcucuaucccuaacgauaagccauuucagaaugugaacagaauaacguauggugcuugucccagguacgugaagcagaauacucugaaacuugccacagggaugcggaacgucccugagaagcaaacccguggaauuuucggcgcaaucgcuggcuuuaucgaaaaugggugggagggaaugauggacgguugguauggcuuccgccaccagaacagcgaggggacuggacaggccgcggaucugaaaucaacacaagccgcaauuaaucagaucaacggcaaguugaauaaacucauugaaaagaccaacgagaaauuucaucagauagaaaaggaguucagugaaguugaggguagaauccaggaccuggagaaguacguggaagauacgaaaauugacuuaugguccuauaacgcugagcugcucguagcccuugaaaaucaacacaccaucgaucugacagacagcgagaugaacaaguuguucgaaaggacucggaaacagcuacgagagaaugcugaggauauggggaacggcugcuuuaagaucuaccauaaaugugacaaugccugcauuggaucuauacgcaacggcaccuaugaucacgacguguacagagacgaagcacugaauaacagguuccagaucaagggggucgagcucaagucaggauacaaagauuggauucuguggaucaguuuugccauuagcugcuuccuucugugugugguuuugcucgguuuuaucaugugggcuugccagaagggcaauauacgguguaacaucugcauuuga

SEQ ID NO: 133100 - RNA, 1701 nt, Artificial Sequence
  derived and/or modified sequence opt3 from hemagglutinin__InfluenzaA__AHH00870
augaagaccaucauugcccugagcuacauacucugccuugcuuucgcacagaaacugcccggcaacgacaauuccacagccacuuuguguuuagggcaccaugcggugccuaacggaacgcuggucaagaccaucacaaaugaucaaauugagguuacuaacgcuaccgagcuagugcagucuucaaguacagguagaaucugcgacagcccacaccagauucucgauggcgaaaauuguacccugaucgacgcccuucugggggauccgcauugcgacggauuucagaacaaagaaugggauuuguucguagagagguccaaggcauauucuaauuguuaccccuaugacgugccugauuacgccucgcuccggucacuggucgcuagcaguggcacucuggaauuuaacaaugaguccuucaacuggacagguguggcacaaaaugggaccucuagcgccugcaaacgccgauccauaaagucauuuuucagucgucucaacugguuacaccagcuggagaauagauauccagcucuuaacguuacgaugcccaauaacgacaaguuugauaaauuguacaucuggggagugcaucacccuagcacugacucugaucagauuuccgucuaugcccaggcgucaggcagggugaccguaagcacaaagcggagucaacagacuguuaucccaaacauuggcucucgccccugggugagagggaucuccagcaggauaucgauuuacuggaccaucgucaaaccuggagacauucugcuaaucaauucuacagguaaccucaucgcaccacggggcuacuucaagauucgcuccgggaaaucaaguauaaugcgaagcgacgccccgaucggaaaguguaauuccgaaugcauuacccccaacggcucuaucccuaaugauaagccauuucagaacgugaauagaauaacguauggugcuugucccagguacgugaaacagaacacucugaaacuugccacagggaugcggaaugucccugagaaacaaacccguggaauuuucggcgcaaucgcuggcuuuaucgaaaacgggugggagggaaugauggacgguugguauggcuuccgccaccagaauagcgaggggacuggacaggccgcggaucugaagucaacacaagccgcaauuaaccagaucaauggcaaauugaacaagcucauugaaaagaccaaugagaaguuucaucagauagaaaaggaguucagugaaguugaggguagaauccaggaccuggagaaauacguggaagauacgaagauugacuuaugguccuauaacgcugagcugcucguagcccuugaaaaccaacacaccaucgaucugacagacagcgagaugaauaaauuguucgaaaggacucggaagcagcuacgagagaacgcugaggauauggggaauggcugcuuuaaaaucuaccauaagugugacaacgccugcauuggaucuauacgcaauggcaccuaugaucacgacguguacagagacgaagcacugaacaauagguuccagaucaagggggucgagcucaaaucaggauacaaggauuggauucuguggaucaguuuugccauuagcugcuuccuucugugugugguuuugcucgguuuuaucaugugggcuugccagaaaggcaacauacgguguaauaucugcauuuga

SEQ ID NO: 133101 - RNA, 1701 nt, Artificial Sequence
  derived and/or modified sequence opt3 from hemagglutinin__InfluenzaA__AHJ57430
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguagacucaggggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucaauuacgaggagcuccgggagcagcugagcaguguguccucuuucgaacgcuuugagauuagcccgaaaacauccucauggcccaaccacgacaguaauaaggguguccgagccgcuuguccucaugcaggggccaagagcuucuauaaaaaccugaucuggcucgugaagaaaggaaauucuuacccaaaguuauccaaaucauauauaaacgauaagggcaaggaaguacugguucuuuggggcauccaccaccccagcaccagugcugaccaacagucuuuguaccagaaugccgaugcguacguguuugucgggacgucccguuauagcaaaaaguucaaaccugagauugcaaucagaccaaaggugaggggacaggagggucggaugaacuacuauuggacucugguggaacccggcgacaaaauuaccuuugaggccacagggaaccuagucguuccucgcuacgcuuucgccauggaaagaaaugcagcuucgggaaucauaauuucugauacuccagugcaugacugcaacaccacaugucaaaccccgaagggcgccguaaauacgucccuccccuuucagaacauccacccuauuacuaucgguaaaugcccaaaguaugugaagucaacaaaacugaggcuugcgaccgggcugcggaauauccccaguauucagagccgcggauuguucggcgccauagcaggcuuuaucgaagggggauggacugguauggucgauggcugguacggguaucaucaccagaacgaacaaggauccggcuacgcugccgaccucaagucuacacagaaugcuauugacgagaucaccaacaaagugaauagcguuauagagaagaugaacacgcaguucaccgccguggguaaagaauuuaaucaccuggagaagcgaauugaaaacuuaaauaagaaagucgaugacggguuccuggauaucuggacauacaacgcagagcuccuugugcuguuggaaaaugagagaacucuagacuaucaugauucaaacguaaagaaccuguacgagaaaguuaggagucagcucaagaauaacgccaaagaaaucggcaauggauguuucgaguuuuaucacaagugcaacaauaccuguauggaauccgugaagaacggcacauacgacuauccuaaauacagcgaggaagcuaagcugaaucgggagaaaauugauggggucaaacuugagucuacucguaucuaucaaauucuggcgauauacucaaccguggcaaguagcuugguccucgugguuucccugggagccaucucuuucuggaugugcucgaacgguagcuuacagugccgcauuuguaucuga

SEQ ID NO: 133102 - RNA, 1701 nt, Artificial Sequence
  derived and/or modified sequence opt3 from hemagglutinin__InfluenzaA__AHJ57431
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaaggguguccgcgccgcuuguccucaugcaggggccaaaaguuuuuauaagaaucugaucuggcucgugaaaaagggaaacagcuacccaaaauuaucucaauccuauauaaaugacaagggcaaggaaguacugguucuuuggggcauccaccaccccucaaccagcgcugaucagcagaguuuguaccagaacgccgacgcguacguguucgucgggacgucucgauauuccaaaaaguuuaaaccugagauugcaauccguccaaaggugagagaucaagagggaaggaugaauuacuauuggacucugguggaacccggugacaaaauuaccuucgaggccacaggcaaccuagucguuccucgguacgcuuuugccauggaacgcaacgcagggagcggaaucauaauuucggauacuccagugcaugacugcaauaccacaugucagaccccgaagggcgcuaucaacacgucucuccccuuccagaauauucacccuaucacuaucgguaaaugcccaaaguauguaaaguccacaaaacugagacuugccaccgggcugaggaacauucccucaauacagagucggggauuguuuggcgcgaucgccggcuucauugaagggggauggacugguaugguggacggcugguacggguaucaucaccaaaaugaacagggaagcggcuacgcagcugaucucaaguccacacagaacgccaucgacaaaauaaccaauaaggucaacucugugauugagaaaaugaauacgcaguuuaccgcuguugguaaggaguucaaccaccuggaaaagcgcaucgagaauuuaaacaaaaagguggaugacggguuccuggauaucuggacauacaaugccgaacuccuuguccuguuggagaacgaacgaacucuagacuaucaugauagcaaugugaaaaaccuguacgagaagguaagaaaccaacucaaaaauaacgcaaaggagauuggcaauggauguuuugaguucuaucacaagugcgacaacaccuguauggaaucaguuaaaaauggcacauacgauuauccuaaguacagugaagaggccaaacugaacagggaaaagaucgacggggugaaacuugaguccacucggauuuaucagauacuggcuaucuacagcaccgucgcgucuucauuggugcucgucgugagucugggagcaauuagcuuuuggaugugcuccaaugguucuuuacagugccguaucuguaucuga

SEQ ID NO: 133103 - RNA, 1701 nt, Artificial Sequence
  derived and/or modified sequence opt3 from hemagglutinin__InfluenzaA__AHJ57432
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagagcuuguaccagaacgccgacgcguacguguucgucgggaccagucgcuauucuaagaaauuuaagccucagauugcaauccgaccaaaagugcgugaucaagagggaagaaugaauuacuauuggacacugguggagcccggugacaagauuacuuucgaagccaccggcaaccuagucguuccuagguacgcuuuugcccucgagcggaacgcaggguccggaaucauaauuagcgauacaccagugcaugacugcaauaccacgugucagacuccgaaaggcgcuaucaacacaucgcugcccuuccagaauauucacccuaucaccaucgguaagugcccaaaguauguaaaaucuacuaaacuucgccuggccacaggguugagaaacgugcccuccauucagucaaggggacucuuuggcgcgauagccggcuucaucgaagggggauggaccgguauggucgagggcugguacggguaucaucaccaaaaugaacagggaaguggcuacgcagcugaccugaaaagcacgcagaacgccauugauaagaucaccaauaaagugaacuccguuauagagaagaugaauacacaguuuacugcuguggguaaggaguucaaccacuuagaaaaacggauugagaaucugaacaagaaagucgacgauggguuccucgacaucuggaccuacaaugccgaacuucugguguugcuagagaacgaacgcacacuggauuaucaugacucuaauguaaagaaccucuacgagaaaguucgaaaccaacugaagaauaacgcaaaggagaucggcaauggauguuuugaguucuaucacaaaugcgauaacacuuguauggagagcgugaagaauggcaccuacgacuauccuaaauacucagaagaggccaaacuuaacagagaaaagauugauggggucaagcuggagaguacaaggaucuaucagauuuuggcuauauacuccaccguggcgagcucucucguccuggugguuucauuaggagcaaucaguuuuuggaugugcagcaaugguucccugcagugccggauuuguaucuga

SEQ ID NO: 133104 - RNA, 1701 nt, Artificial Sequence
  derived and/or modified sequence opt3 from hemagglutinin__InfluenzaA__AHJ57433
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaagaaggaaauagcuacccaaaguuaucuaaauccuauauaaacgauaagggcaaggagguacugguucuuuggggcauccaccaccccucaacgacugcugaccaacagagcuuguaccagaaugccgaugcguacguguucgucgggaccagucgcuauucuaaaaaguuuaaaccugagauugcaauccgaccaaaggugcgugaccaggaaggaagaaugaacuacuauuggacacugauugagcccggugauaaaaucacuuucgaagccaccggcaaccuaguggucccuagguacgcuuuugccauggagcggaaugcaggguccggaauaauuaucagcgacacaccaguucaugauugcaacaccacgugucaaacuccggaaggcgcuauuaauacaucgcuccccuuccagaacauccacccuaucaccauugguaagugcccaaaauaugugaagucuacuaagcugcgccuugccacagggcugagaaauguacccuccauacagucaaggggauuguuuggcgcgaucgccggcuucauugaagggggauggaccgguaugguggacggcugguacggguaucaucaccagaacgagcaaggaaguggcuacgcagcugaccucaaaagcacgcagaaugccaucgauaagauaaccaacaaagucaauuccgugauugaaaagaugaacacacaguuuacugcuguugguaaagaguucaaucaccuggaaaagcggaucgagaacuuaaauaagaaaguggacgauggguuccuggacaucuggaccuacaacgccgaacuccuuguccuguuggagaaugagcgcacacuagauuaucaugacucuaacgugaagaaccuguacgaaaaaguacgaaaucagcucaagaacaaugcaaaagagauuggcaacggauguuuugaguucuaucacaagugcgauaauacuuguauggaaagcguuaagaacggcaccuacgacuauccuaaauacucagaagaggccaagcugaauagagagaaaaucgauggggugaaacuugaaaguacaaggauuuaucaaauacuggcuaucuacuccaccgucgcgagcucuuuggugcucgucgugucacugggagcaauuaguuuuuggaugugcagcaacgguuccuuacagugccggaucuguaucuga

SEQ ID NO: 133105 - RNA, 1701 nt, Artificial Sequence
  derived and/or modified sequence opt3 from hemagglutinin__InfluenzaA__AHJ57434
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaaccccuuagaagauaagcacaaugggaaacuguguaagcuaagaggaguggcuccucuccaucuggguaaaugcaacauagccggcuggauccuugggaauccagagugugaaucucugucaacagcaaguagcugguccuacauuguugagaccucuucgucagacaacggaacuugcuauccgggcgauuuuaucgacuacgaagaguugagggagcagcucagcaguguguccucuuucgaacgguuugagauuuuccccaagacaagcuccuggccuaaucacgauucaaacaagggugucaccgccgcuuguccacaugcaggggccaaaaguuuuuauaagaaucugaucuggcuggugaaagaaggaaacagcuaccccaagcucucuaaauccuauauaaaugacaagggcaaggagguauuaguucuguggggcauccaccacccuucaacgacugcugaucaacagagccuuuaccagaacgccgacgcguacguguucgucgggaccagucgcuauucuaaaaaguuuaaaccagagauugcaauccgacccaaggugcgugaucaggaaggaagaaugaauuacuauuggacauugguggagccuggugacaaaauuacuuucgaagccaccggcaaccuggucguuccaagguacgcuuuugccauggagcggaacgcaggguccggaaucauaauuagcgauacaccggugcaugacugcaauaccacgugucaaacucccgaaggcgcuaucaacacaucgcuaccuuuccagaauauucacccaaucaccaucgguaagugccccaaauauguaaagucuacuaagcuccgccuggccacagggcuuagaaacgugccuuccauucagucaaggggacuguuuggcgcgauagccggcuucaucgaagggggauggaccgguauggucgacggcugguacggguaucaucaccagaaugagcaaggaaguggcuacgcagcugauuugaaaagcacgcagaacgccauugacaagaucaccaauaaagugaacuccguuauagaaaagaugaauacacaguuuacugcuguggguaaagaguucaaccaccucgaaaagcggauugagaaucugaacaagaaagucgaugacggguucuuagauaucuggaccuacaaugccgaacugcucgugcuucuggagaacgagcgcacauuggacuaucaugauucuaauguaaagaaccuauacgaaaaaguucgaaaccagcugaagaauaacgcaaaagagaucggcaauggauguuuugaguucuaucacaagugcgacaacacuuguauggagagcgugaagaauggcaccuacgauuauccaaaauacucagaagaggccaagcucaacagagagaaaauugacggggucaagcuggaaaguacaaggaucuaucaaauucuugcuauauacuccaccguggcgagcucucuggucuuggugguuucacucggagcaaucaguuuuuggaugugcagcaaugguucccugcagugccggauuuguaucuga

SEQ ID NO: 133106 - RNA, 1701 nt, Artificial Sequence
  derived and/or modified sequence opt3 from hemagglutinin__InfluenzaA__AHJ57435
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaaucgcggugucaccgccgcuuguccucaugcaggggccaagaguuuuuauaaaaaccugaucuggcucgugaagaaaggaaauagcuacccaaaguuaucucaauccuauauaaacgauaaaggcaaggaaguacugguucuuuggggcauccaccaccccucaacgacugcugaccagcagagcuuguaccagaaugccgaugcguacguguucgucgggaccagucgauauucuaagaaauuuaagccugagauugcaauccguccaaaagugagagaccaagagggaaggaugaacuacuauuggacacugguggaacccggugauaagauuacuuucgaggccaccggcaaccuagucguuccucgguacgcuuuugccauggaacgcaaugcaggguccggaaucauaauuagcgacacaccagugcaugauugcaacaccacgugucagacuccggagggcgcuaucaauacaucgcuccccuuccagaacauucacccuaucaccaucgguaaaugcccaaaguauguaaaaucuacuaagcugagacuugccacagggcugaggaaugugcccuccauucagucacggggauuguuuggcgcgauagccggcuucaucgaagggggauggaccgguauggucgacggcugguacggguaucaucaccaaaacgagcagggaaguggcuacgcagcugaccucaagagcacgcagaaugccauugauaaaaucaccaacaagguaaauuccguuauagagaaaaugaacacacaguuuacugcuguggguaaggaguucaaucaccuggagaaacgcauugaaaacuuaaauaagaaggucgacgauggguuccuggacaucuggaccuacaacgccgagcuccuugugcuguuggaaaaugagcgaacacuagauuaucaugacucuaacgugaaaaaccuguacgagaagguuagaaaucaacucaaaaacaaugcaaaggaaaucggcaacggauguuuugaguucuaucacaaaugcgauaauacuuguauggaaagcgugaagaacggcaccuacgacuauccuaaguacucagaggaagccaaacugaauagggagaagauugauggggucaaacuugagaguacacggaucuaucagauucuggcuauauacuccaccguggcgagcucuuugguccucgugguuucacugggagcaaucaguuuuuggaugugcagcaacgguuccuuacagugccguauuuguaucuga

SEQ ID NO: 133107 - RNA, 1701 nt, Artificial Sequence
  derived and/or modified sequence opt3 from hemagglutinin__InfluenzaA__AHJ57436
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacucaaguuucuuuagccgacugaauuggcucacucauuuaaacuuuaaguauccagcacugaaugugaccauucccaacaacgagcaguucgacaaguuguacaucuggggaguccaccauccuggcacagauaaagaccagauuuuucuuuaugcccaagcuagcggccguaucacuguguccaccaagagaucacagcagacaguaauaccaaauauugggagcaggccccggguucgcaacaucccuaguagaauuucuaucuacuggaccaucgugaaaccaggagauauucugcuaauaaauuccacggguaaccucaucgccccgaggggcuacuucaagauucggagcgggaaaucgucuaucaugcgcuccgacgcgcccauaggaaaguguaauucagaaugcauuacuccuaacggcaguaucccaaaugacaagcccuuucagaacgucaaucgaaucacauauggugcauguccuagauacgugaaacaaaacacccugaaacuugccacugggaugaggaaugugccagagaagcagacacggggaauuuucggcgcuaucgccggcuuuauugaaaacgggugggagggaauggucgaugguugguauggcuuccgucaccagaauagcgaggggcgcggacaagcagcugaccugaaguccacccaggccgcgauagaucagaucaacggcaaauugaauagacucauugguaagacgaacgaaaaauuccaccagaucgagaaggaauuuucugagguugaagggaggauccaagaccuggagaaguacguggaggauaccaaaauugacuuauggagcuauaacgccgaacugcucguagcacuugagaaucagcauacaauagaucugacugacucagaauugaacaagcuauucgagaaaaccaagaaacagcugcgggaaaaugcugaggauaugggcaacggaugcuuuaagaucuaccacaagugugacaaugccugcauuggcaguauccgaaacgggacauaugaucaugacguguaccgcgacgaggcucucaauaacagauuccagauuaaaggagucgaacugaaguccgguuacaaagauuggauccuuuggauaucuuuugccaucucuugcuuccuguuguguguggcacuccugggcuuuauuaugugggccugccaaaaggggaauaucagguguaacauuugcaucuga

SEQ ID NO: 133108 - RNA, 1701 nt, Artificial Sequence
  derived and/or modified sequence opt3 from hemagglutinin__InfluenzaA__AHJ57437
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcgaaaacuguacccucauagacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcauccggcgcagcaauuccucauuuuucagucgacugaacuggcucacucauuuaaauuuuaaguauccagcacugaacgugaccaugcccaacaaugagcaguucgacaaacuuuacauuuggggaguccaccauccuggcacagauaaggaccagaucuuuuuguaugcccaaagcucuggccguauuacuguguccaccaagagaucacagcagacaguaaucccaaacauagggagcaggccccggguucgcaauauuccuaguagaaucucuauuuacuggaccaucgugaaaccaggagauauccugcuaauuaacuccacggguaaucucauagcuccgaggggcuacuucaagauccggagcgggaaaucgucuauuaugcgcuccgacgcccccaucggaaaguguaacucagaaugcauaacuccuaauggcaguauuccaaacgacaagcccuuucagaaugucaaccgaaucacauauggugcguguccuagauacgugaaacaaagcacccugaaacuugcaacugggaugaggaaugugccagagaagcagacacggggaaucuucggcgccauugcuggcuuuaucgaaaacgggugggagggaauggucgaugguugguauggcuuccgucaccaaaauuccgaggggcgcggacaggccgcagaccugaagucuacccaggcugccauugaucagauaaacggcaaauugaauagacucaucgguaagacgaacgaaaaauuccaccagauugagaaggaauuuagcgagguugaagggaggauccaagaccuggagaaguacguggaggauaccaaaaucgacuuauggucauauaacgcggaacugcucguagcccuugagaaucagcauacaauugaucugacugacagugaaaugaacaaguuguucgagaaaaccaagaaacagcuaaaggaaaaugcagaggauaugggcaacggaugcuuuaagauauaccacaaaugugacaaugcuugcaucggcuccauucggaacgggacauaugaucaugacguguaccgagacgaggcccugaauaaccgcuuccagaucaagggagucgaacucaaaagcgguuacaaggauuggauucuguggaucucuuuugcuauaucaugcuuccuucuguguguggccuugcucggcuuuaucaugugggcaugccaaaaagggaauauuagauguaacaucugcauuuga

SEQ ID NO: 133109 - RNA, 1701 nt, Artificial Sequence
  derived and/or modified sequence opt3 from hemagglutinin__InfluenzaA__AHJ57438
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagaauagcucaacaggugagauuugcgacaguccacaccagauccuagauggcgaaaacuguacccucauagacgcucugcuuggggauccgcagugcgacggauuucaaaauaaaaagugggaucuguucguggagagaagcaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcauccggcgcagcaauuccucauuuuucagucgacugaaguggcucacucauuuaaacuuuaaguauccagcacugaaugugaccaugcccaacaacgagcaguucgacaaacuuuacauuuggggaguccaccauccuggcacagauaaggaccagaucuuuuuguaugcccaagcuagcggccguauuacugugucuaccaaaagaucccagcaggccguaaucccaaauauagggucaaggccccggauucgcaacaucccuagcagaauuaguaucuacuggacaaucguuaagccaggagauauucugcuaauaaauucuaccgguaaccucaucgcgccgaggggcuacuucaaaauucgguccgggaagucuucgaucaugcgcucugacgcacccauaggaaaguguaauuccgaaugcauuacgccuaacggcucaaucccaaaugacaaacccuuucagaacgugaaucgaaucacuuauggugauuguccuagauacgucaagcaaaguacacugaaacuugccaccgggaugaggaacgugccagagaagcagacucggggaauuuucggcgcuaucgccggcuuuauugaaaaugggugggagggaaugguggacgguugguauggcuuccgucaccagaacagcgaggggcgcggacaagcagcugaucugaaauccacacaggccgcgauagaccagaucaauggcaaguugaacagacucauugguaaaaccaaugaaaaguuccaccagaucgagaaggaauuuucugaggucgaagggaggauccaagaucuggagaaauacguugaggacacgaagauugauuuauggagcuauaacgccgaacugcucguggcacuugagaaccagcauaccauagaccugacagauucagaaaugaauaaauuguucgagaagacuaaaaagcagcuacgggaaaacgcugaggacaugggcaauggaugcuuuaagaucuaccacaaaugugauaacgccugcaccggcaguauucgaaaugggacauaugaccaugacguauaccgcgaugaggcucugaacaauagauuccagaucaagggaguggaagucaaauccgguuacaaggacuggauucucuggaucagcuuugccauaucuugcuuccugcuuuguguggcacuguugggcuuuaucaugugggccugccaaaaagggaacauuagguguaauaucugcauuuga

SEQ ID NO: 133110 - RNA, 1701 nt, Artificial Sequence
  derived and/or modified sequence opt3 from hemagglutinin__InfluenzaA__AHJ57651
augaucgccuucauugugauagcuauccuggcagccaccggcaagagcgacaaaauuugcaucggguaccacgcgaacaauuccacaacuaaggucgauacgauucucgagaaaaacguuaccgugacacauucuguagaacuucuggagaaucagaaggaagagagauuuuguaaaaucucaaacaaggcucccuuggacuuaagggauugcacucuggaaggauggauacuagguaauccucgguguggcauccuccuggccgaccaaaguuggagcuauauuguggagcgcccaaacgcacgaaaugggaucugcuacccgggaacccuuaacgaggucgaggaacugaaggccuugauuggcuccggugaacguguggagagauucgagauguuucccaaaucuacaugggcugggguugauaccgacucgggagugucaagcgcauguccucucggcaauggcccaaguuucuauaggaaccugcuguggaucauaaagcucaaauccucugaauaccccgucauucgggggacuuuuaauaacacaggagauaagagcaucuuauauuucuggggugugcaccauccuccaguaaccacggagcaggaagcccuguacggcuccggggaccgcuauguuagaaugggaacugagucaaugaauuuugcuaggagucccgaaauugccgcgcggccugcagugaacggccagcgcggucgaaucgauuacuucuggagcauccuuaaaccaggggagaccuugaaugucgagucuaacggaaaccugauugccccgugguacgcuuauagauuugugaauaaggacuccaagggcgccauauucaggucaacacuacccaucgaaaacugcgaugcaacuugucagaccacagagggcgugauucggaccaauaaaacguuucaaaacgucagcccucucuggaucggggaaugcccaaaguacguuaaaaguaagucucugcgucuugcuacuggacugcgcaaugugccccagauagagacaagagguuuguucggcgccauugcgggguuuaucgaaggaggcuggaccgguaugaucgacgggugguauggcuaccaccaugagaacucccagggaagcggcuaugccgcagauagggagucgacucagaaagcuauugacgggaucacaaauaagguaaacucuauuauagacaaaaugaauacccaauucgaagccgugggacacgaguucuccaaccucgaacggcgaaucgauaaucugaacaagcgcauggaggacgguuuucuugaugucuggacguacaaugcugaacugcucgugcuucuggagaacgagagaaccuuggacaugcacgaugccaauguuaagauucuauaugaaaaagugaggucacagcugcgggacaacgcaaaggaucucggcaacggguguuucgaguuuuggcauaaaugcgacaaugaauguaucgagagugucaagaacggaacauacaauuacccuaaauaucagagcgagucccgccugaacagacagacuaucgaaucugugaaguuagagaaucugggcguauaccaaauuuuggccauauauagcaccguuucaaguucccucgugcuggucgguuuaauccuggcuauggggcuauggaugugcagcaacggcucuaugcagugcaggauuuguaucuga

SEQ ID NO: 133111 - RNA, 1701 nt, Artificial Sequence
  derived and/or modified sequence opt3 from hemagglutinin__InfluenzaA__AHJ57663
augaucgccuucauugugauagcuacccuggucgcaacaggcaagagcgacaaaaucugcauuggguaccacgccaacaauuccacuacgaagguugauaccauccucgagaaaaacgugacaguaacucauucuguggaacuucuggagaaucagaaggaagagagauuuuguaaaauuucaaacaaggcgcccuuggacuuaagggauugcacccuggaaggauggauccuagguaauccucgguguggcauacuccuggcugaccaaaguuggagcuauaucgucgagcgcccaaacgcccgaaaugggauuugcuacccgggaacacuuaacgaggcagaggaacugaaggccuugaucggcuccggugaacguguggagagauucgagauguuucccaaaucuaccuggacugggguugauacagaaucgggagugucaagcgcuuguccucucggcaauggcccaaguuucuauaggaaccugcuguggauuaucaagcucaaauccucugaguaccccgucauacgggggaccuuuaauaacacgggagacaagagcauuuuauauuucuggggugugcaccauccuccaguaacuaccgaacagaaugcacuguacggcuccggggaucgcuauguuagaaugggaacagagucaaugaacuuugccaggagucccgaaaucgcugcccggccugcggugaauggccagcgcggucgaauugacuacuucuggagcauccuuaaaccaggggagacuuugaacgucgagucuaacggaaaucugaucgcaccgugguacgccuauagauuugugaacaaggauuccaagggcgcuauuuucaggucaaaucuacccauagaaaacugcgacgccaccugucagacaaccgagggcgugauccggacgaauaaaacuuuucaaaacgucagcccucucuggauuggggaaugcccaaaguacguuaaaaguaagucucugcgucuugcaacaggacugcgcaaugugccccagaucgagaccagagguuuguucggcgcuauagccggguuuauugaaggaggcuggacugguaugaucgaugggugguauggcuaccaccaugagaacucccagggaagcggcuaugcggccgacaaagagucgacacagaaggcaaucgaugggauuaccaauaaaguaaacucuaucauugacaagaugaauacgcaauucgaagcugugggacacgaguucuccaaccucgaaaggcggauagacaaucugaacaagcgaauggaggaugguuucuuagacgucuggaccuacaaugccgaacugcucgugcuucuggagaacgagcgcacauuggaucuacacgacgcuaacguuaaaaaucugcaugaaagagugaagucacagcucagggauaacgccaaugaccugggcaacggguguuucgaguuuuggcacaaaugcgauaaugaauguauggagagugucaagaacggaacuuauaauuacccuaaauaccaggcagagagccggcuuaacaagcagaagaucgaauccgugaaacuggaggaauuuggcguauaucaaauuuuggccaucuacucuaccguuagcucaagucucgugcuggucgguuuaaucauggcuauggggcuguggaugugcccaaauggcuccaugcagugccgcauuuguauauga

SEQ ID NO: 133112 - RNA, 1701 nt, Artificial Sequence
  derived and/or modified sequence opt3 from hemagglutinin__InfluenzaA__AHJ57674
augaucgccuucauugugauagcuauccuggucaccacaggcaagagcgacaaaauuugcaucggguaccacgcaaacaauuccacuacgaagguugauaccauucucgagaaaaacgugacaguaacucauucuguggaacuucuggagaaucagaaggaagagagauuuuguaaaaucucaaacaaggcccccuuggacuuaagggauugcacccuggaaggauggauacuagguaauccucgguguggcauccuccuggcggaccaaaguuggagcuauauugucgagcgcccaaacgcucgaaaugggaucugcuacccgggaacacuuaacgagguggaagaacugaaggccuugauuggcuccggugaacguguugagagauucgagauguuucccaaaucuaccugggcagggguggauacuaauucgggagucucaagcgccuguccucucggcgaaggcccaaguuucuauaggaaccugcuguggaucauaaagcacacaaccuccggguaccccgugauuaaaggaacguaucggaauacuggugacaagucuguacucuacuuuuggggcguucaucacccuccagauaccacagagcagaacguguuauaugggagcggaaaucgcuacgucagaaugggcacugaauccaugaacuucgcuaggucacccgagaucgcagcccggccugcugugaauggucagcgcgggcgaauugacuacuuuuggaguauccugaaaccaggagaaacccuuaacguggagagcaacggcaauuugaucgccccgugguaugcguacagauucgucaacaaggauucuaagggcgcaauuuuuagguccaaucugcccauagagaacugcgacgccacaugucagaccacggaagggguuauccggacuaauaaaacauuccaaaacgugucaccucuauggauuggagagugcccaaaguauguaaaaagcaagagucuccgucuggcuaccggucuucgcaaugugccccagaucgaaacuagaggccuguuuggggccauagcaggauucauugagggcgguuggacagggaugaucgauggcugguacggauaucaucacgaaaacucucagggcuccggguacgcugccgacagggagagcacccagaaagcgaucgauggaauuacgaauaaggucaacucgaucauugacaaaaugaauacccaauuugaggccgugggucacgaguucucuaacuuggagcggcgaauagacaaucucaacaagcgcauggaagauggcuuccuggacguuuggacauauaaugcagaguuacuggugcuccuugaaaacgagagaacucuggauuugcaugacgcuaacgucaagaaucuacacgagagggugcggucccagcugcgcgauaacgccaaugaccucgggaacggauguuuugaguucuggcauaaaugcgauaaugaauguauggaaucaguaaagaacggcaccuacaauuacccuaaauaucaggcugagaguagacugaacaggcagaagaucgagagcguuaaacuugaagaguuugguguguaccaaauucuggccaucuauuccacagucucuagcucauuggugcucgucgggcugaucauggcaaugggcuuauggaugugcaguaauggauccaugcagugccguauuuguauauga

SEQ ID NO: 133113 - RNA, 1701 nt, Artificial Sequence
  derived and/or modified sequence opt3 from hemagglutinin__InfluenzaA__AHJ57686
augaucgccuucauugugauagcuauccuggcagccaccggcaagagcgacaaaauuugcaucggguaccacgcgaacaauuccacaacuaaggucgauacgauucucgagaaaaacguuaccgugacacauucuguagaacuucuggagaaucagaaggaaggaagauuuuguaaaaucucaaacaaggcucccuuggacuuaagggauugcacucuggaggguuggauacuaggcaauccucggugugggauccuccuggccgaccaaaguuggagcuauauuguggaacgcccaaacgcacgaaauggaaucugcuacccgggcauucuuaacgaggccgaggaacugaaggcuuugaucgguuccggggagcgugucgaaagauucgagauguuucccaaaucuaccugggcaggaguggauacaaauucgggcguuucaagcgccuguccucucggcaacgggccaaguuucuauaggaaucugcuguggauaauuaagcucaaauccucugcuuaccccgugauccggggaaccuuuaacaauacuggugacaagagcauuuuauauuucuggggcguccaccauccuccaguggccacagagcaggaagcgcuguacggguccggaaaccgcuauguaagaaugggcaccgagucaaugaauuuugcaaggaaccccgaaaucgccgcucggccugccguuaacggucagcgcgggcgaaucgauuacuucuggaguauucuuaaaccaggagagacguugaauguggaaagcaacggcaaucugauagcaccgugguacgcuuauagauuugucaacaaggacucuaagggcgccaucuucagguccaaucuacccauugagaacugcgaggcgacuugucagaccacagaaggggugauccggacuaauaaaaccuuucaaaacgugucaccucucuggauaggagagugcccaaaguacgucaaaagcaagagucugcgucuugccacaggucugcgcaauguuccccagauugaaaccagaggcuuguucggggcaaucgcuggauuuaucgagggcgguuggacggggaugauugauggcugguauggauaccaccaugaaaacucucagggcuccggguaugccgcugacagggagagcacucagaaagccaucgauggaauuacaaauaaggugaacucgauaaucgacaaaaugaauacccaauucgaggcaguaggucacgaguucucuaaccucgaacggcgaauugauaaucugaacaagcgcauggaagacggcuuuuuagacguguggacuuacaacgccgagcugcucguccuucuggaaaaugagagaacauuggaucuacacgacgcuaacgugaagaaucugcaugagaaaguuaggucccagcuccgggauaacgcgaaugaccuggggaacggauguuucgaauuuuggcacaagugcgauaaugaguguauggaaucagugaaaaacggcaccuaugacuacccuaaguaccaggcagagagucgccuuaauagacagaaaaucgagagcgucaagcuggaaaacuucgauguguaucaaaucuuggccauuuacuccacgguaucuagcucacucguucugguggguuuaauaauggcuauggggcuguggaugugcaguaauggcuccaugcagugcaggaucuguauuuga

SEQ ID NO: 133114 - RNA, 1701 nt, Artificial Sequence
  derived and/or modified sequence opt3 from hemagglutinin__InfluenzaA__AHJ57697
augaucgccuucauugugauagcuauccuggcagccaccggcaagagcgacaaaauuugcaucggguaccacgcgaacaauuccacaacuaaggucgauacgauucucgagaaaaacguuaccgugacacauucuguagaacuucuggagaaucagaaggaagagagauuuuguaaaaucucaaacaaggcucccuuggacuuaagggauugcacucuggaaggauggauacuagguaauccucgguguggcauccuccuggccgaccaaaguuggagcuauauuguggagcgcccaaacgcacgaaaugggaucugcuacccgggaacccuuaacgaggucgaagaguuaaaggccuugauuggcuccggugaacguguggagagauucgagauguuucccaaaucuacaugggcugggguugauaccaauucgggagugucaagcgcauguccucucggcaacggcccaaguuucuauaggaaucugcuguggaucauaaagcucaaauccucugaauaccccgucauucgggggacuuuuaacaauacaggagacaagagcaucuuauauuucuggggugugcaccauccuccaguaaccacggagcaggaagcccuguacggcuccggggaucgcuauguuagaaugggaacugagucaaugaacuuugcuaggagucccgaaauugccgcgcggccugcagugaauggccagcgcggucgaaucgacuacuucuggagcauccuuaaaccaggggagaccuugaacgucgagucuaacggaaaucugauugccccgugguacgcuuauagauuugugaacaaggauuccaagggcgccauauucaggucaaaucuacccaucgaaaacugcgacgcaacaugucagacuaccgagggcgugauucggacaaauaaaaccuuucaaaacgucagcccucucuggaucggggaaugcccaaaguacguuaaaaguaagucucugcgucuugcuacgggacugcgcaaugugccccagauagagacuagagguuuguucggcgccauugcgggguuuaucgaaggaggcuggacagguaugaucgaugggugguauggcuaccaccaugagaacucccagggaagcggcuaugccgcagacagggagucgacccagaaagcuauugaugggaucacuaauaagguaaacucuauuauagacaaaaugaauacacaauucgaagccgugggacacgaguucuccaaccucgaacggcgaaucgacaaucugaacaagcgcauggaggaugguuuucuggacgucuggaccuacaaugcugaacugcucgugcuucuggagaacgagagaacguuggaucuacacgacgccaacguuaagaaucugcaugaaaaagugaagucacagcucagggauaacgcaaaugaccugggcaacggguguuucgaguuuuggcacaaaugcgauaaugaauguauggagagugucaagaacggaaccuaugacuacccuaaauaccaggccgagagccggcuuaaucgccagaagauugaauccgugaagcuggagaacuucgauguauaucaaaucuuggcuaucuacucuacaguuagcucaagucucgugcuggucggcuuaauuauggcgaugggucuguggaugugcuccaaugggagcaugcagugcagaauauguaucuga

SEQ ID NO: 133115 - RNA, 1701 nt, Artificial Sequence
  derived and/or modified sequence opt3 from hemagglutinin__InfluenzaA__AHJ57707
augaucgccuucauugugauagcuauccuggucaccacaggcaagagcgacaagauuugcguuggguaccacgcaaacaauuccacuacgaagguggauaccauccucgagaaaaacguaacagugacucauucugucgaacuucuggagaaucagaaggaagagagauuuuguaaaauuucaaacaaggcccccuuggacuuaagggauugcacccuggaaggauggauccuagguaauccucgguguggcauacuccuggcggaccaaaguuggagcuauaucguggagcgcccaaacgcucgaaaugggauuugcuacccgggaacacuuaacgagguugaagaacugaaggccuugaucggcuccggugaacguguggagagauucgagauguuucccaaaucuaccuggacuggggucgauacaaauucgggagugucaagcgcauguccucucggcgaaggcccaaguuucuauaggaaccugcuguggauuaucaagcacaccacguccggguaccccguaauaaaaggaacuuaucggaauaccggugacaagucuguucucuacuuuuggggcgugcaucacccuccagauacaacugagcagaacgucuuauaugggagcggaaaucgcuacgugagaaugggcaccgaauccaugaacuucgccaggucacccgagauugcugcacggccugccgugaauggucagcgcgggcgaaucgacuacuuuuggaguauucugaaaccaggagaaacacuuaacgucgagagcaacggcaauuugaucgcuccgugguaugccuacagauucguuaacaaggauucuaagggcgcgaucuuuagguccaaucugcccauugagaacugcgacgcaaccugucagacgacugaaggggugauacggacaaauaaaaccuuccaaaacguaucaccucuauggaucggagagugcccaaaguaugugaaaagcaagagucuccgucuggccacuggucuucgcaaugucccccagauugaaacaagaggccuguuuggggcuaucgccggauucauagagggcgguuggaccgggaugauugauggcugguacggauaucaucacgaaaacucucagggcuccggguacgcagcugacagggagagcacgcagaaagccaucgauggaaucaccaauaaggugaacucgauuaucgacaaaaugaauacacaauuugaggcgguuggucacgaguucucuaacuuggagcggcgaauugacaaucucaacaagcgcauggaagauggcuuccuggacguguggacuuauaaugccgaguuacugguccuccuugaaaacgagagaacccuggauuugcaugacgcaaacgugaagaaucuacacgagaggguacggucccagcugcgcgauaacgcuaaugaccucgggaacggauguuuugaguucuggcauaaaugcgauaaugaauguauggaaucaguuaagaacggcacauacaauuacccuaaauaucaggccgagaguagacugaacaagcagaaaauagagagcgugaaacuugaagaguuuggugucuaccaaauccuggcuauuuauuccacugugucuagcucauugguccucguggggcugaucauggccaugggcuuauggaugugcaguaauggauccaugcagugcaggaucuguauuuga

SEQ ID NO: 133116 - RNA, 1701 nt, Artificial Sequence
  derived and/or modified sequence opt3 from hemagglutinin__InfluenzaA__AHJ57719
augaucgccuucauugugauagcuauccuggcagccaccggcaagagcgacaaaauuugcaucggguaccacgcgaacaauuccacaacuaaggucgauacgauucucgagaaaaacguuaccgugacacauucuguagaacuucuggagaaucagaaggaagagagauuuuguaaaaucucaaacaaggcucccuuggacuuaagggauugcacucuggaaggauggauacuagguaauccucgguguggcauccuccugagugaccaaagcugguccuauauuguggagcgcccaaacgcccgaaaugggaucugcuacccgggcauucuuaacgaggcagaagaacugaaggccuugaucggaucuggugaacgugucgagagauucgagauguuucccaaaucgaccugggcugggguggauacaaauucaggaguuagcagugcauguccucucggcaacggcccauccuucuuuaggaaucugcuguggauaauuaagcucaaaucuagcaccuaucccgugauccgggggacuuucaacaauacaggagacaaguccauuuuauacuuuugggguguccaccauccuucagugaccacggaacaggaggcccuguauggcagugggaaccgcuacguaagaaugggaacugaaagcaugaauuucgcuaggucuccagagaucgccgcgcggcccgcaguuaacggccagcgcggucgaaucgauuauuuuugguccauucuuaaaccuggggaaaccuugaacguggagucaaauggaaaccugauagccccaugguacgcuuacagauucgucaauaaggacagcaagggcgccaucuuuaggaguaaccuaccgauugagaauugcgaugcaacaugucagacuaucgaaggcgugauacggaccaacaaaacauuccaaaaugugucuccccucuggauuggggagugcccuaaguaugucaaauccaagagccugcgucuugcuaccggacugcgcaacguuccacagaucgaaacgagagguuuguuuggcgccaucgcgggguucauugagggaggcuggacugguaugaucgacgggugguacggcuaucaccaugaaaauucgcagggaucuggcuacgccgaugacaaagaguccacacagaaggcaauugaugggauaaccaacaaaguaaauucaaucauugacaagaugaacacucaauucgaggcugugggacacgaauuuaguaaucucgagaggcggaucgacaaccugaauaagcgaauggaagaugguuucuuagacguguggacauauaacgccgagcugcucguccuucuggaaaacgagcgcaccuuggaucuacacgacgcuaaugugaaaaaccugcaugagaagguuagaagccagcucagggauaaugccaacgaccugggcaauggguguuuugaguucuggcacaaaugcgauaacgaguguauggaauccgugaagaauggaacguacgacuaucccaaauaccaggcagagucucggcuuaaccgccagaagaucgagagcgucaagcuggaaaauuuugauguguaccaaauuuuggccauauauucaaccguaaguuccagccucguucuggugggcuuaaucauggcuaugggucuguggaugugcucuaacgggucaaugcagugcagaauuuguaucuga

SEQ ID NO: 133117 - RNA, 1701 nt, Artificial Sequence
  derived and/or modified sequence opt3 from hemagglutinin__InfluenzaA__AHJ57731
augaucgccuucauugugauagcuauccuggcagccaccggcaagagcgacaaaauuugcaucggguaccacgcgaacaauuccacaacuaaggucgauacgauucucgagaaaaacguuaccgugacacauucuguagaacuucuggagaaucagaaggaagagagauuuuguaaaaucucaaacaaggcucccuuggacuuaagggauugcacucuggaaggauggauacuagguaauccucgguguggcauccuccuggccgaccaaaguuggagcuauauuguggagcgcccaaacgcacgaaaugggaucugcuacccggguauucuuaacgaggccgaggaacugaaggcuuugaucggcuccggugaacgugucgagagauucgagauguuucccaaaucuaccugggcagggguggauacagacucgggaguuucaagcgccuguccucucggcaauggcccaaguuucuauaggaaccugcuguggauaauuaagcucaaauccucugaauaccccgugauccgggggaccuuuaauaacacuggagauaagagcauuuuauauuucugggguguccaccauccuccagugacaaccgagcaggaagcucuguacggcuccgggaaucgcuauguaagaaugggaacggagucaaugaacuuugccaggagucccgaaaucgcggcacggccugccguuaauggccagcgcggucgaaucgacuacuucuggagcauucuuaaaccaggggagacuuugaacguggagucuaacggaaaucugauagcuccgugguacgccuauagauuugucaacaaggauuccaagggcgcaaucuucaggucaaaucuacccauugaaaacugcgacgcuaccugucagacaacugagggcgugauccggaccaauaaaacauuucaaaacgugagcccucucuggauaggggaaugcccaaaguacgucaaaaguaagucucugcgucuugccaccggacugcgcaauguuccccagauugagacgagagguuuguucggcgcgaucgccggguuuaucgaaggaggcuggacugguaugauugaugggugguauggcuaccaccaugagaacucccagggaagcggcuaugcagcugacagggagucgacacagaaagccaucgaugggauuaccaauaaggugaacucuauaaucgacaaaaugaauacucaauucgaagcuguaggacacgaguucuccaaccucgaacggcgaauugacaaucugaacaagcgcauggaggauggauuuuuagacguguggacauacaaugccgaacugcucguccuucuggagaacgagagaaccuuggaucuacacgacgcaaacgugaagaaucugcaugaaaaaguuaggucacagcuccgggauaacgccaaugaccugggcaacggguguuucgaguuuuggcacaagugcgauaaugaauguauggagagugugaaaaacggaacguaugacuacccuaaguaccagaccgagagccgccuuaauagacagaaaaucgaauccgucaagcuggagaacuucgauguguaucaaaucuuggcuauuuacucuacaguaagcucaagucucguucuggugggcuuaauaauggcgaugggucuguggaugugcuccaaugggagcaugcagugcaggaucuguauuuga

SEQ ID NO: 133118 - RNA, 1701 nt, Artificial Sequence
  derived and/or modified sequence opt3 from hemagglutinin__InfluenzaA__AHJ57743
augaucgccuucauugugauagcuauccuggucgcaaccggcaagagcgacaagauuugcaucggguaccacgccaacaauuccacaacuaagguugauacgauucucgagaaaaacgugaccguaacacauucuguggaacuucuggagaaucagaaggaagagagauuuuguaaaaucucaaacaaggcgcccuuggacuuaagggauugcacuauagaaggauggauccuggguaauccucgguguggcauucuacucgcugaccaaaguuggagcuauaucgucgagcgcccagaugcccgaaacgggauuugcuacccgggaacccugaaugaggcagaagaacuuaaggcccugaucggcuccggugaaaaaguggagcguuucgagauguuucccaagucuacaugggcugggguugacaccucgucaggagugagcagugcauguccuuugggcaacggcccauccuucuauagaaaucuccuguggauaauuaaacugaagucuagcgaauaccccgucaucagggggacuuuuaacaauacaggagauaaauccgugcucuauuucugggguguacaccauccuccaguuaccacggagcagaacgccuuauacggcucagggaaucgguaugugcgcaugggaacugaaaguaugaacuuugcuagaagccccgagauugccgcgaggccugcagucaauggccagcggggucgcaucgacuacuucuggucuauccugaagccaggggaaacccuuaacguggaguccaacggaaauuugauugccccgugguacgcuuaucgauuugugaacaaggauucaaaaggcgccauauucagaagcaaucugcccaucgagaacugcgacgcaacaugucagacuauugaaggcgucaucaggaccaauaagacauuucaaaacguuaguccucuauggauaggggagugcccaaaauacgugaagucuaaaucccuccggcuggcuaccggacuucguaauguaccccagauugaaacgcgcggucuguucggcgccaucgcgggguuuaucgagggaggcuggacugguaugauugaugggugguauggcuaccaccaugaaaacagccagggaucgggcuaugccgcagacagagagucuacacagaaggcuaucgaugggauuaccaauaaagugaacuccauaaucgacaagaugaauacucaauucgaggccgcuggacacgaguucucaaacuuggagaggcggauugacaaucucaacaagcgaauggaagaugguuuucuggacgucuggacauacaaugccgaguuacuggugcuccuugaaaacgagcgcacccuggauuugcacgacgcaaacguuaaaaaucuacaugagaaggugaaaagucagcugagagauaacgccaaugaccucggcaacggguguuucgaauuuuggcacaagugcgauaaugaguguauggaaagcgucaaaaacggaacguaugacuacccuaaguaccagaaggaguccaggcugaaucggcagaaaaucgagucugugaaacuugaaaacuucgauguauaucaaauccuggcuauuuacagcaccguuucaaguuccuuggugcucgucggccugauaauggcgauggguuuauggaugugcagcaaugggucuaugcagugccgcaucuguauuuga

SEQ ID NO: 133119 - RNA, 1701 nt, Artificial Sequence
  derived and/or modified sequence opt3 from hemagglutinin__InfluenzaA__AHJ57755
augaucgccuucauugugauagcuauccuggucgcaaccggcaagagcgacaaaauuugcaucggguaccacgccaacaauuccacaacuaagguugauacgauucucgagaaaaacgugaccguaacacauucuguggaacuucuggagaaucagaaggaagagagauuuuguaaaaucucaaacaaggcgcccuuggacuuaagggauugcacuauagaaggauggauccuggguaauccucggugugacauucuacucgcugaucaaaguuggagcuauaucgucgagcgcccaaacgcccgaaauggcauuugcuacccggggacccugaacgaggcagaagaacuuaaggcccugaucggauccggcgaagguguggagcguuucgagauguuucccaaaucuacauggguugggguggacaccucgucaggagucagcagugcuuguccuuugggcaauggcccauccuucuauagaaaccuccuguggauaauuaagcugaaaucuagcgaauaccccgugaucagggggacuuuuaauaacacaggagauaaguccguacucuauuucugggguguucaccauccuccagugaccacggagcagaaugcauuauacggcucagggaaccgguauguccgcaugggaacugaaaguaugaauuuugccagaagccccgagauugcugccaggccugcggugaacggccagcggggucgcaucgacuacuucuggucuauccugaaaccaggggaaacccuuaacguggaguccaauggaaacuugauugcaccgugguacgccuaucgauuugucaauaaggauaacaagggcgcuauauucagaucaaaucugcccaucgagaacugcgacgccacaugucagacuaccgaaggcguuauuaggacaaauaaaaccuuucaaaacgugagcccucuauggaucggggagugcccaaaguacguaaaaaguaagucucuccggcuggcaacgggacuucguaaugugccccagauagaaacucgcggucuguucggcgcuauugccggguuuaucgagggaggcuggacagguaugaucgaugggugguauggcuaccaccaugaaaacucccagggaagcggcuaugcggccgacagagagucgacccagaaagcaauugaugggaucacuaauaaggucaacucuauuauagacaaaaugaauacacaauucgaggcugccggacacgaguucuccaacuuggagaggcggaucgacaaucucaacaagcgaauggaagaugguuuucuggacguguggaccuacaacgcugaguuacugguucuccuugaaaaugagcgcacgcuggauuugcacgacgccaacgugaagaaucuacaugagaaagucaagucacagcugagagauaacgcaaaugaccucggcaacggguguuucgaauuuuggcacaaaugcgauaaugaguguauggaaagugugaagaacggaaccuaugacuacccuaaauaccagaaggagagcaggcugaaucggcagaagauugaguccguaaaacuugaaaacuucgauguuuaucaaauccuggccaucuacucuacagugagcucaaguuuggucguggucggccucauuauggcuaugggucuguggaugugcuccaaugggagcaugcagugccgcauauguaucuga

SEQ ID NO: 133120 - RNA, 1701 nt, Artificial Sequence
  derived and/or modified sequence opt3 from hemagglutinin__InfluenzaA__AHJ57767
augaucgccuucauugugauagcuauccuggcagccaccggcaagagcgacaaaauuugcaucggguaccacgcgaacaauuccacaacuaaggucgauacgauucucgagaaaaacguuaccgugacacauucuguagaacuucuggagaaucagaaggaagagagauuuuguaaaaucucaaacaaggcucccuuggacuuaagggauugcacucuggaaggauggauacuagguaauccucgguguggcauccuccuggccgaccaaaguuggagcuauauuguggagcgcccaaacgcacgaaaugggaucugcuacccgggaacccuuaacgaggucgaagaguuaaaggccuugauuggcuccggugaacguguggagagauucgagauguuucccaaaucuacaugggcugggguugauaccaauucgggagugucaagcgcauguccucucggcaacggcccaaguuucuauaggaaucugcuguggaucauaaagcucaaauccucugaauaccccgucauucgggggacuuuuaacaauacaggagacaagagcaucuuauauuucuggggugugcaccauccuccaguaaccacggagcaggaagcccuguacggcuccggggaucgcuauguuagaaugggaacugagucaaugaacuuugcuaggagucccgaaauugccgcgcggccugcagugaauggccagcgcggucgaaucgacuacuucuggagcauccuuaaaccaggggagaccuugaacgucgagucuaacggaaaucugauugccccgugguacgcuuauagauuugugaacaaggauuccaagggcgccauauucaggucaaaucuacccaucgaaaacugcgacgcaacaugucagacuaccgagggcgugauucggacaaauaaaaccuuucaaaacgucagcccucucuggaucggggaaugcccaaaguacguuaaaaguaagucucugcgucuugcuacgggacugcgcaaugugccccagauagagacuagagguuuguucggcgccauugcgggguuuaucgaaggaggcuggacagguaugaucgaugggugguauggcuaccaccaugaguccagccagggaucgggcuaugccgcagacaaagagucuacccagaaggcuauugaugggaucacuaacaaaguaaauuccauuauagacaagaugaacacacaauucgaagccgugggacacgaguucucaaaucucgaaaggcggaucgacaaccugaauaagcgaauggaggaugguuuucuggacgucuggaccuacaacgcugaacugcucgugcuucuggagaaugagcgcacguuggaucuacacgacgccaacguuaaaaaccugcaugaaaaggugagaagucagcucagggauaaugcaaacgaccugggcaauggguguuucgaguuuuggcacaaaugcaacaaugaauguauggagagcgucaagaacggaaccuaugauuacccuaaauaccagaaggagucccggcuuaaucgccagaagauugaaucugugaaacuggagaacuucgacguauaucaaaucuuggccaucuacagcacaguuucaaguucccucgugcuggucggcuuaauucuggcuaugggucuauggaugugcagcaaugggucuaugcagugcagaauauguaucuga

SEQ ID NO: 133121 - RNA, 1701 nt, Artificial Sequence
  derived and/or modified sequence opt3 from hemagglutinin__InfluenzaA__AHJ57779
augaucgccauuauaaucauugcuauccugguggcaaccggcaagagcgacaaaauuugcaucggguaccacgccaacaauuccacaacuaaggucgauacgauacucgagaaaaacguuaccgugacacauucuguagaacuucuggaggaccagaaggaagagagauucuguaaaaucucaaauaaggcgcccuuggauuuaagggacugcacuauugaaggauggauccuggguaacccucgguguggcauucuacucgcugaucaaaguuggagcuauaucguggagcgcccaaaugcccgaaacgggauaugcuacccgggaacccugaaugaggcagaagaacuuaaggcccugauuggcuccggugaaggggucgagcguuuugagauguuccccaaaucuacaugggcuggaguggacaccaacucgggcguuucaagcgcauguccuuugggcaaugggccaaguuuuuauagaaaccuccuguggaucauuaagcugaaauccucugaauaccccgugaucaggggaacuuucaauaacacaggugauaagagcguccucuauuuuuggggcgugcaccauccuccaguaaccacggagcagaaugccuuauacggguccggaaaccgguauguucgcaugggcacugaaucaaugaauuucgcuagaagucccgagaucgccgcgaggccugcagugaacggucagcgggggcgcauugacuacuuuuggagcauacugaaaccaggagaaacccuuaacgucgagucuaauggcaacuugaucgccccgugguacgcuuaucgauucgugaauaaggauuccaagggcgccauuuuuagaucaaaccugcccaucgagaauugcgacgcaacaugucagacuaccgaaggggugauaaggacaaacaaaaccuuccaaaaugucagcccucuauggauuggagagugcccaaaguacguuaaaaguaagucucuccggcuggcuacgggucuucguaacgugccccagaucgaaacucgcggccuguuuggggccaucgcgggauucauugagggcgguuggacagggaugaucgauggcugguauggauaccaccaugaaaauucccagggcagcggguaugccgcagacagagagucgacccagaaagcuauugauggaauaacuaacaagguaaauucuaucauugacaaaaugaacacacaauuugaggccgcuggucacgaguucuccaauuuggagaggcggaucgacaaccucaauaagcgaauggaagauggcuuccuggacguguggaccuacaacgccgaguuacugguccuccuugaaaacgagcgcacgcuggauuugcacgacgcaaaugugaagaaccuacaugagaaaguuaagucacagcugagagauaaugccaacgaccucgggaauggauguuuugaguucuggcacaaaugcgauaacgaauguauggaaagugugaagaauggcaccuaugacuacccuaaauaccagaaggagagcaggcugaaccggcagaagaucgaguccgucaaacuugaaaauuuugauguguaucaaauucuggcuauauacucuacaguaagcucaaguuugguucucgugggucugaucauggcgaugggguuauggaugugcuccaacggcagcaugcagugcaugauuuguaucuga

SEQ ID NO: 133122 - RNA, 1701 nt, Artificial Sequence
  derived and/or modified sequence opt3 from hemagglutinin__InfluenzaA__AHJ57791
augaucgccauuauaaucauugcuauccuggugaccacaggcaagagcgacaaaauuugcaucggguaccacgcaaacaauuccacuacgaaggucgauaccauacucgagaaaaacguuacagugacucauucuguagaacuucuggagaauaagaaagaagagagauucuguaagaucucaaacaaggcccccuuggacuuaagggauugcacccuggaaggauggauucuagguaauccucgguguggcauccuccuggcggaccagaguuggagcuauauuguggagcgcccaaacgcucgaaaugggaucugcuacccgggaacacuuaacgaggucaaagaacugaaggccuugauaggcuccggugagcgugugaaaagauuugaaauguuccccaagucuaccugggcagggguugauacuaauucgggagugucaagcaguuguccucucggcaacggcccauccuuuuauaggaaucugcuguggauuaucaaacacacaaccucuggguaccccgucauuaagggaacguauacuaacaccggugacaagagcgugcucuacuucuggggcauccaucacccuccagauacaacugagcaaaauguauuauauggguccggaaaccgguacguucgcaugggcaccgagucaaugaauuuugccagaagucccgaaaucgcugcaaggccugccgugaacggucagcgggggcgcauugacuacuucuggagcauacugaaaccaggagagacacuuaacgucgaaucuaauggcaacuugaucgcuccgugguaugccuaccgauuugugaauaaggauuccaaaggcgcgauuuucagaucaaaccugcccaucgaggacugcgaugcaaccugucagacgacugaaggggugauaaggacaaauaagaccuuucagaacgucagcccucuauggauuggagagugcccaaaauauguuaagaguaaaucucuccggcuggccacuggucuucguaaugugccccaaaucgagacacgcggccuguucggggcuaucgccggauuuauugaaggcgguuggaccgggaugaucgacggcugguacggauaucaucacgagaacucccagggcagcggguacgcagcugauagagaaucgacgcagaaggccauugacggaauaaccaauaagguaaacucuaucauugacaaaaugaauacacaguucgaggcggugggucacgaauuuuccaacuuggagaggcggaucgauacucucaauaagcgaauggaggacggcuuccuggaugucuggaccuauaacgccgaauuacuggugcuccuugagaaugaacgcacacuggacuugcaugaugcaaacguuaaaaaccuacacgagagagugaagucacaacugagggacaaugcuaacgaucucgggaauggauguuucgaauuuuggcauaaaugcgacaacgaguguauggagagugucaagaauggcacuuacaacuacccuaaguaucaggccgaaagccggcugaauaaacagaagaucgaguccgugaaacuugaagaguucgguguauaccagauucuggcuauauauucuaccguuagcucaaguuuggugcucgucgggcugaucauggccaugguguuauggaugugcuccaacggcagcaugcaaugccgcgucuguauuuga

SEQ ID NO: 133123 - RNA, 1701 nt, Artificial Sequence
  derived and/or modified sequence opt3 from hemagglutinin__InfluenzaA__AHJ57815
augaucgccuucauuauaaucaccauucuggugacaacuggcaagagcgacaaaaucugcauuggguaccacgcuaacaauuccacgaccaaggucgauacaauccucgagaaaaacguuacugugacccauucuguagaacuucuggagaaucagaaggaagagagauuuuguaggauaucaaacaaagcacccuuggacuuaaaggaaugcacacuggagggauggauccuagguaauccucaaugugaucuccugcuuggcgaccagaguuggagcuauauuguggagcggccaaacgcccgcaaugggaucugcuacccgggaacccugaacgaagucgaggaauugcgagcgcucauuggcuccggugaggggguggagcguuucgaaauguuucccaagucuacuugggcuggaguugauacaaauagaggcgugaccucgucauguccuuucggcagcgggaguuccuuuuauaggaaccugcuguggaucgucaaacacacgacuucuagcuacccagugauaaagggaaccuuccggaauacaggugacaaauccguacucuauuuuuggggcguucaucaccccuucgauacuaacgagcagaauguguuauacgggucaggaaaccgcuaugucagaaugggcaccgaaaguaugaauuuugccagggguccugagguggcagcccggccaguggucaacgggcagcgcggacgaauugacuacuucuggagcauccugaagcccggcgaaacacuuaacauugagucuaauggcaacuugaucgcuccuugguacgcauauagauuuguuaauaaagauuccaagggggccaucuucaggucaaaccugccaauugaggacugcgaugcuaccugucaaacgauagaaggagugauccggacuaauaagacauuucagaacguaagcccgcuauggauuggugagugccccaaauacgugaagagugaaucucuccgucuggccaccggccuucgcaaugucccucagaucgagacuagagggcuguucggagcgauagcaggcuucauugaagguggguggacaggcaugaucgacggaugguauggcuaccaucacgagaacucccaggggagcggauaugccgcugauagggagucgacccaaaaagccaucgacgguauuacgaccaagguuaauucuaucauugacaaaaugaacacacaguuugaagcagugggccacgaguucuccaauuuggaacggcgaauagauaaccucaauaagcgccuggaggacggguuuuuagauguguggacuuacaacgcugaacugcucguccuucuggagaaugagagaaccuuggaccuacaugaugccaacgugaaaaaccugcacgaaaggguacggucacagcuccgcgacaaugcgaacgaucugggaaauggcuguuucgaguuuuggcauaagugcgacaacgaauguauggagaguguuaagaaugguacauauaacuacccaaaauaccaggccgagagcagacuuaauaagcaaaggaucgaauccgugaaacuggagaacuucgaugucuaucagauuuuggcaaucuacucuacugugagcucaagucucguccuggugggguuaauccuggcuaugggccuauggaugugcuccaauggaagcaugcagugccguauuuguauauga

SEQ ID NO: 133124 - RNA, 1701 nt, Artificial Sequence
  derived and/or modified sequence opt3 from hemagglutinin__InfluenzaA__AHJ57827
augaucgccuucauugugauagcuauccuggucgcaaccggcaagagcgacaaaauuugcaucggguaccacgccaacaauuccacaacuaagguugauacgauucucgagaaaaacgugaccguaacacauucuguggaacuucuggagaaucagaaggaagagagauuuuguaaaaucucaaacaaggcgcccuuggacuuaagggauugcacuauagaaggauggauccuggguaauccucgguguggcauucuacucgcugaccaaaguuggagcuauaucgucgagcgcccaaacgcccgaaaugggauuugcuacccgggaacccugaacgagguggaagaacuuaaggcacugaucggcuccggugaacguguugagagauucgagauguuucccaaaucuacaugggccgggguggauaccaauucgggagucucaagcgcuuguccuuugggcaacggcccaaguuucuauaggaaucuccuguggauaauuaagacuaaauccucugaauaccccgugaucaaggggacauuuaacaauaccggagacaaaagcguacuguauuucugggguguucaccauccuccaucccggaacgagcagaaugugcucuacggcucaggggaucgcuaugucagaaugggaacggaaaguaugaacuuugcaaggagccccgagauugccgcucggccugccgugaacggccagcgcggucgaaucgacuacuucuggucuaucuuaaagccaggggaaacucugaauguggaguccaacggaaaucuuauugcgccgugguacgcauauagauuugucaacaaggauucaaggggcgccauauuccggagcaauuugcccaucgagaacugcgacgcuaccugucagacagccgaaggcguuauucguacuaauaaaaccuuucaaaacgugaguccucuguggaucggggagugcccaaaguacguaaaaucuaagucccuacgccucgcaacaggacugagaaaugugccccagauagaaaccaggggucuuuucggcgcuauugccggguuuaucgagggaggcuggacggguaugaucgaugggugguauggcuaccaccaugaaaacagccagggaucgggcuaugcggccgaccgggagucuacucagaaagcaauugaugggaucacaaauaaggucaacuccauuauagacaaaaugaauacccaauucgaggcugugggacacgaguucucaaaccuggagcgacgcaucgacaauuugaacaagagaauggaagaugguuuucucgacguuuggacuuacaacgccgagcuguuagugcugcucgaaaaugagaggacacuugaucugcacgacgcuaacgucaagaauuugcaugagcgggugaaaagucagcuacgcgauaacgccaaugaccugggcaacggguguuucgaauuuuggcacaagugcgauaaugaguguauggaaagcguuaaaaacggaaccuaugacuacccuaaguaccagaaagaguccagacucaauaggcagaagauugagucuguaaagcuggaaaacuucgauguguaucaaauccuugcaaucuacagcacggucucaaguucccugguguuggucggccucauuauggccaugggucuguggaugugcagcaaugggucuaugcagugccguauauguaucuga

SEQ ID NO: 133125 - RNA, 1701 nt, Artificial Sequence
  derived and/or modified sequence opt3 from hemagglutinin__InfluenzaA__AHJ57850
augaucgccuucauugugauagcuauccuggcaaccacaggcaagagcgacaaaauuugcaucggguaccacgccaacaauuccacuacgaaggucgauaccauucucgagaaaaacguuacagugacucauucuguagaacuucuggagaaucagaaggaagagagauuuuguaaaaucucaaacaaggcgcccuuggacuuaagggauugcacccuggaaggauggauacuagguaauccucgguguggcauccuccuggcugaccaaaguuggagcuauauuguggagcgcccaaacgcccgaaaugggaucugcuacccggguauucuuaacgaggcagaggaacugaaggccuugaucggcuccggugaacgugucgagagauucgagauguuucccaaaucuacaugggcugggguggauaccgacucgggaguuucaagcgcauguccucucggcaauggcccaaguuucuauaggaaccugcuguggauaauuaagcucaaauccucugaauaccccgugauccgggggacuuuuaauaacacaggagauaagagcauuuuauauuucugggguguccaccauccuccagugaccacggagcaggaagcccuguacggcuccgggaaucgcuauguaagaaugggaacugagucaaugaacuuugcuaggacccccgaaaucgccgcgcggccugcaguuaauggccagcgcggucgaaucgacuacuucuggaguauucuuaaaccaggggagacauugaacguggagagcaacggaaaucugauagccccgugguacgcuuauagauuugucaacaaggauucuaagggcgccaucuucagguccaaucuacccauugaaaacugcgacgcaacuugucagaccacagagggcgugauccggaccaauaaaacguuucaaaacgugucaccucucuggauaggggaaugcccaaaguacgucaaaagcaagagucugcgucuugcuacuggacugcgcaauguuccccagauugagacaagagguuuguucggcgccaucgcgggguuuaucgaaggaggcuggaccgguaugauugaugggugguauggcuaccaccaugagaacucucagggauccggcuaugccgcagacagggagagcacucagaaagcuaucgaugggauuacaaauaaggugaacucgauaaucgacaaaaugaauacccaauucgaagccguaggacacgaguucucuaaccucgaacggcgaauugacaaucugaacaagcgcauggaggauggauuuuuagacguguggacguacaaugcugaacugcucguccuucuggagaacgagagaaccuuggaucuacacgacgccaacgugaagaaucugcaugaaaaaguuaggucccagcuccgggauaacgcaaaugaccugggcaacggguguuucgaguuuuggcacaagugcgauaaugaauguauggagucagugaaaaacggaacauaugacuacccuaaguaccaggccgagagucgccuuaauagacagaaaaucgaaagcgucaagcuggagaacuucgauguguaucaaaucuuggcuauuuacuccacuguaucuagcucacucguucuggugggcuuaauaauggcgaugggucuguggaugugcaguaauggguccaugcagugcaggaucuguauuuga

SEQ ID NO: 133126 - RNA, 1701 nt, Artificial Sequence
  derived and/or modified sequence opt3 from hemagglutinin__InfluenzaA__AHJ57862
augaucgccuucauugugauagcuauccuggcagccaccggcaagagcgacaaaauuugcaucggguaccacgcgaacaauuccacaacuaaggucgauacgauucucgagaaaaacguuaccgugacacauucuguagaacuucuggagaaucagaaggaagagagauuuuguaaaaucucaaacaaggcucccuuggacuuaagggauugcacucuggaaggauggauacuagguaauccucgguguggcauccuccuggccgaccaaaguuggagcuauauuguggagcgcccaaacgcacgaaaugggaucugcuacccggguauucuuaacgaggccgaggagcugaaggcuuugaucggcuccggugaacgugucgagagauucgagauguuucccaaaucuaccugggcagggguggauacaaauucgggaguuucaagcgccuguccucucggcaacggcccaaguuucuauaggaaucugcuguggauaauuaagcucaaauccucugaauaccccgugauccgggggaccuuuaacaauacuggagacaagagcauuuuauauuucugggguguccaccauccuccagugacaaccgagcaggaagcucuguacggcuccgggaaccgcuauguaagaaugggaacggagucaaugaauuuugccaggagucccgaaaucgcggcacggccugccguuaacggccagcgcggucgaaucgauuacuucuggagcauucuuaaaccaggggagacuuugaacguggagucuaauggaaaccugauagcuccgugguacgccuauagauuugucaauaaggacuccaagggcgcaaucuucaggucaaaccuacccauugaaaauugcgaugcuaccugucagacaacugagggcgugauccggaccaacaaaacauuucaaaaugugagcccucucuggauaggggaaugcccaaaguacgucaaaaguaagucucugcgucuugccaccggacugcgcaacguuccccagauugagacgagagguuuguucggcgcgaucgccggguuuaucgaaggaggcuggacugguaugauugacgggugguauggcuaccaccaugaaaauucccagggaagcggcuaugcagcugauagggagucgacacagaaagccaucgacgggauuaccaacaagguaaauucuauaaucgauaaaaugaacacucaauucgaagcugugggacacgaguucuccaaucucgaacggcgaauugacaaccugaauaagcgcauggaggacggauuuuuagauguguggacauacaacgccgaacugcucguccuucuggagaacgagagaaccuuggaccuacacgaugcaaaugugaagaaccugcaugaaaaaguuaggucacagcuccgggacaaugccaacgaucugggcaauggguguuucgaguuuuggcacaagugcgacaacgaauguauggagagugugaaaaauggaacguaugauuacccuaaguaccaggcugagagccgccuuaacagacagaaaaucgaauccgucaagcuggagaauuucgacguguaucaaaucuuggcgauuuacucuaccguaagcucaagucucguucuggugggcuuaauaauggcaaugggucuguggaugugcuccaacgggagcaugcagugcaggaucuguauuuga

SEQ ID NO: 133127 - RNA, 1701 nt, Artificial Sequence
  derived and/or modified sequence opt3 from hemagglutinin__InfluenzaA__AHJ57873
augaucgccuucauugugauagcuacccuggucgcaacaggcaagagcgacaaaaucugcaugggguaccacgccaacaauuccacuacgaagguugauaccauucucgagaaaaacgugacaguaacucauucuguggaacuucuggagaaucagaaggaagagagauuuuguaaaaucucaaacaaggcgcccuuggacuuaagggauugcacccuggaaggauggauucuagguaauccucgguguggcauccuccuggcugaccaaaguuggagcuauauagucgagcgcccaaacgcccgaaaugggaucugcuacccgggaacacuuaacgaggcagaagaguuaaaggccuugauuggcuccggugaacguguggagagauucgagauguuucccaaaucuaccuggacugggguugauacagaaucgggagugucaagcgcuuguccucucggcaauggcccaaguuucuauaggaaccugcuguggaucauuaagcucaaauccucugaguaccccgucauccgggggaccuuuaauaacacgggagacaagagcauauuauauuucuggggugugcaccauccuccaguaacuaccgaacagaaugcacuguacggcuccggggaucgcuauguuagaaugggaacagagucaaugaacuuugccaggagucccgaaauugcugcccggccugcggugaauggccagcgcggucgaaucgacuacuucuggagcauucuuacuccaggggagaccuugaacgucgagucuaacggaaaucugaucgcaccgugguacgccuauagauuugugaacaaagauuccaagggcgcuaucuucaggucaaaucuacccauugaaaacugcgacgccacaugucagaccacggagggcgugauacggacuaauaagacauuucaaaacgucagcccucucuggaucggggaaugcccaaaauacguuaagaguaaaucucugcgucuugcaaccggacugcgcaaugugccccagauugagacuagagguuuguucggcgcuaucgccggguuuauagaaggaggcuggacagguaugauugaugggugguauggcuaccaccaugagaacucccagggaagcggcuaugcggccgacaaggagucgacccagaaagcaaucgaugggaucacgaauaagguaaacucuauuaucgacaaaaugaauacccaauucgaagcugugggacacgaguucuccaaccucgaaaggcggauugacaaucugaacaagcgaauggaggaugguuuucuggacgucuggacauacaaugccgaacugcucgugcuucuggagaacgagcgcacuuuggaucuacacgacgcuaacguuaagaaucugcaugaaaaagugagaucacagcucagggauaacgccaaugaccugggcaacggguguuucgaguuuuggcacaagugcgauaaugaauguauggagagugucaaaaacggaaccuaugacuacccuaaguaccagaaagagagccggcuuaaucgccagaagauagaauccgugaagcuggagaacuucgauguauaucaaaucuuggcaauuuacucuacaguuagcucaagucucgugcuggucggcuuaauccuggccaugggucuauggaugugcuccaaugggagcaugcauugcagaaucuguauuuga

SEQ ID NO: 133128 - RNA, 1701 nt, Artificial Sequence
  derived and/or modified sequence opt3 from hemagglutinin__InfluenzaA__AHJ57885
augaucgccuucauugugauggcuauacuggcagccaccggcaagagcgacaagaucugcauuggguaccacgcgaacaauuccacaacuaaggucgauacgauccucgagaaaaacguuaccgugacacauucuguagaacuucuggagaaucagaaggaagagagauuuuguaaaauuucaaacaaggcucccuuggacuuaagggauugcacucuggaaggauggauccuagguaauccucgguguggcauacuccuggccgaccaaaguuggagcuauaucguggagcgcccaaacgcacgaaaugggauuugcuacccgggaauccuuaacgaggccgaagaacugaaggcuuugauuggcuccggugaacgugucgagagauucgagauguuucccaaaucuaccugggcagggguggauacagacucgggaguuucaagcgccuguccucucggcaauggcccaaguuucuauaggaaccugcuguggaucauaaagcggaaauccucugcuuaccccgugauucgcgggaccuuuaauaacacuggagauaagagcauccucuauuucugggguguccaccauccuccagugacaaccgaacaggaggccuuauacggcuccgggaauagauauguaaggaugggaacggaaucaaugaacuuugcgcggaaucccgagauugcagcccgcccugcuguuaacggccagcgagguagaaucgacuacuucuggaguauccugaaaccaggggaaacucuuaacauugagagcaauggaaacuugauagccccgugguacgcauauagguuugugaauaaggauucuaagggcgcuaucuuccgguccaaccugcccauugaggacugcgaugccucaugucagaccacagaaggcgucauccguacuaauaaaaccuuucaaaacgugagcccucuauggauaggggagugcccaaaguacgugaaaaguaagucucuccgccuggcgacaggacuuagaaaugucccccagauugaaaccaggggucuguucggcgccaucgcaggguuuaucgagggaggcuggacggguaugauugacgggugguauggcuaccaccaugaaaacucccagggaagcggcuaugcugccgaucgggagucgacucagaaagcuaucgacgggauuacaaauaagguuaacucuauaaucgacaaaaugaauacccaauucgaggccgugggacacgaguucuccaacuuggagcgacgcauugauaaucucgacaagagaauggaagaugguuuucuggacguauggacuuacaacgcagaguuacuggugcuccuugaaaaugagaggacacuggauuugcacgacgccaacgucaagaaccuacaugagaaagugcggucacagcugcgcgauaaugcuaacgaccucggcaauggguguuucgaauuuuggcacaagugcgauaacgaguguauggaaaguguuaaaaauggaaccuaugacuacccuaaguaccaggcggagagcagacugaacaggcagaaaaucgaguccgugaaacuugaaaauuucgaugucuaucaaauccuggcaauuuacucuacggugagcucaaguuugguacucguuggccugauaauggccauggguuuauggaugugcuccaacgggagcaugcagugccguaucuguauuuga

SEQ ID NO: 133129 - RNA, 1701 nt, Artificial Sequence
  derived and/or modified sequence opt3 from hemagglutinin__InfluenzaA__AHJ57897
augaucgccuucauugugauagcuauccuggcagccaccggcaagagcgacaagauuugcaucggguaccacgcgaacaauuccacaacuaaggucgauacgauucucgagaaaaacguuaccgugacacauucuguagaacuucuggagaaucagaaggaagagagauuuuguaaaaucucaaacaaggcucccuuggacuuaagggauugcacucuggaaggauggauacuagguaauccucgguguggcauccuccuggccgaccaaaguuggagcuauauuguggagcgcccaaacgcacgaaaugggaucugcuacccgggcauucuuaacgaggccgaagaacugaaggcuuugaucggauccggugaacgugucgagagauucgagauguuucccaaaucuaccugggcagggguggauacagacucgggaguuucaagcgccuguccucucggcaauggcccaaguuucuauaggaaccugcuguggauaauuaagcggaaauccucugcuuaccccgugauccgcgggaccuuuaauaacacuggagauaagagcauucucuauuucugggguguccaccauccuccagugacaaccgaacaggaggccuuauacggcuccgggaauagauauguaaggaugggaacggaaucaaugaacuuugcgcggaaucccgagaucgcagcccgcccugcuguuaacggccagcgagguagaaucgacuacuucuggaguauucugaaaccaggggaaacucuuaacauagagagcaauggaaacuugaucgccccgugguacgcauauagguuugugaauaaggauucuaagggcgcuauuuuccgguccaaccugcccaucgaggacugcgaugccucaugucagaccacagaaggcgucauacguacuaauaaaaccuuucaaaacgugagcccucuauggauuggggagugcccaaaguacgugaaaaguaagucucuccgccuggcgacaggacuuagaaaugucccccagaucgaaaccaggggucuguucggcgccaucgcaggguuuauugagggaggcuggacggguaugaucgacgggugguauggcuaccaccaugaaaacucccagggaagcggcuaugcugccgaucgggagucgacucagaaagcuauugacgggauaacaaauaagguuaacucuaucauugacaaaaugaauacccaauucgaggccgugggacacgaguucuccaacuuggagcgacgcaucgauaaucucaacaagagaauggaagacgguuuucuggauguauggacuuacaaugcagaguuacuggugcuccuugaaaacgagaggacacuggacuugcacgaugccaacgucaagaaucuacaugagaaagugcggucacagcugcgcgacaacgcuaaugaucucggcaacggguguuucgaauuuuggcacaagugcgacaaugaguguauggaaaguguuaaaaacggaaccuaugauuacccuaaguaccaggcggagagcagacugaauaggcagaaaaucgaguccgugaaacuugaaaacuucgacgucuaucaaauucuggcaauauacucuacggugagcucaaguuugguacucguuggccugaucauggccauggguuuauggaugugcuccaaugggagcaugcagugccguauuuguaucuga

SEQ ID NO: 133130 - RNA, 1701 nt, Artificial Sequence
  derived and/or modified sequence opt3 from hemagglutinin__InfluenzaA__AHJ57908
augaucgccuucauugugauagcuauccuggucgcaaccggcaagagcgacaaaauuugcaucggguaccacgccaacaauuccacaacuaagguugauacgauucucgagaaaaacgugaccguaacacauucuguggaacuucuggagaaucagaaggaagagagauuuuguaaaaucucaaacaaggcgcccuuggacuuaagggauugcacugucgaaggauggauacuggguaauccucgguguggcauccuaauugcugaccaaaguuggagcuauaucguggagcgcccaaacgcccgaaaugggauuugcuacccgggaacccucaacgaggcagaagaacugaaggcccuuaucggcuccggugaagggguugagcguuucgagauguuucccaaaucuacaugggcuggaguggauaccucgucaggcgucagcagugcauguccucugggcaaugggccauccuucuauagaaacuugcucuggauaauuaagcugaaaucuagcgaauaccccgugaucaggggaacuuuuaauaacacaggugacaaguccguacuguauuucuggggcguucaccauccuccagugaccacggagcaggaugcccucuacgggucaggaaaucgguauguccgcaugggcacugaaaguaugaacuuugcuagaagccccgagauugccgcgaggccugcagugaauggucagcgggggcgcaucgacuacuucuggucuguguuaaaaccaggagaaacccugaacgucgaguccaacggcaaucuuaucgccccgugguacgcuuaucgauuuguuaacaaggauaauaagggcgccauuuucagaucaaacuugcccauagagaauugcgacgcaacaugucagacuaccgaaggggugaucaggacaaacaaaaccuuucaaaauguaagcccucuguggauuggagagugcccaaaguacgugaaaaguaagucucuacggcucgcuacgggucugcguaacgucccccagaucgaaacucgcggccuuuucggggccauagcgggauuuauugagggcgguuggacagggaugaucgauggcugguauggauaccaccaugaaaauucccagggcagcggguaugccgcagacagagagucgacccagaaagcuaucgauggaauuacuaacaagguuaauucuaucauugacaaaaugaacacacaauucgaggccgcuggucacgaguucuccaaucuggagaggcggauagacaacuugaauaagcgaauggaagauggcuuucucgacguguggaccuacaacgccgagcuguuagugcugcucgaaaacgagcgcacgcuugaucugcacgacgcaaaugucaagaacuugcaugagaaagugaagucacagcuaagagauaaugccaacgaccuggggaauggauguuucgaauuuuggcacaaaugcgauaacgaguguauggaaaguguaaagaauggcaccuaugacuacccuaaauaccagaaggagagcaggcucaaccggcagcgcaucgaguccguuaagcuggaaaauuucgauguguaucaaauucuugcuaucuacucuacagucagcucaagucugguggucguggguuugaucauggcgauggggcucuggaugugcuccaacggcagcaugcagugcaugauuuguauauga

SEQ ID NO: 133131 - RNA, 1701 nt, Artificial Sequence
  derived and/or modified sequence opt3 from hemagglutinin__InfluenzaA__AHJ57920
augaucgccauuauaaucauugcuauccugguggcaaccggcaagagcgacaaaauuugcaucggguaccacgccaacaauuccacaacuaaggucgauacgauacucgagaaaaacguuaccgugacacauucuguagaacuucuggagaaucagaaggaagagagauucuguaaaaucucaaacaaggcgcccuuggacuuaagggauugcacuauugaaggauggauccuggguaauccuugguguggcauucuacucgcugaccaaaguuggagcuauaucguggagcggccaaacgcccgcaaugggauaugcuacccgggaacccugaacgaggucgaagaacuuaaggcacugauuggcuccggugaacgaguggagcguuuugagauguuccccaaaucuacaugggccgggguugauaccaauucgggagugucaagcgcuuguccuuugggcaacggcccaaguuuuuauagaaaucuccuguggaucauuaagacuaaauccucugaauaccccgucaucaaggggacauucaacaauaccggagacaaaagcgugcuguauuuuugggguguacaccauccuccauccaggaacgagcagaauguucucuacggcucaggggaucgguaugugcgcaugggaacggaaaguaugaacuucgcaagaagccccgagaucgccgcuaggccugccgucaacggccagcggggucgcauugacuacuuuuggucuauauuaaagccaggggaaacucugaauguggaguccaacggaaaucuuaucgcgccgugguacgcauaucgauucgugaacaaggauucaagaggcgccauuuuuaggagcaauuugcccaucgagaacugcgacgcuaccugucagacagccgaaggcgucauacggacuaauaaaaccuuccaaaacguuaguccucuguggauuggggagugcccaaaguacgugaaaucuaagucccuacgucucgcaacaggacugcgcaauguaccccagaucgaaaccagaggucuuuuuggcgcuaucgccggguucauugagggaggcuggacggguaugaucgaugggugguauggcuaccaccaugaaaacagccagggaucgggcuaugcggccgacagggagucuacucagaaagcaacagaugggauuaccaauaaggugaacuccauaaucgacaaaaugaauacucaauuugaggcugucggacacgaguucucaaaccuggagcggcgaauugacaauuugaacaagcgcauggaagaugguuuccucgacguguggacauacaacgccgagcuguuaguucugcucgaaaaugagagaacccuugaucugcacgacgcuaacgugaagaauuugcaugagagggucaaaagucagcuacgggauaacgccaaugaccugggcaacggguguuuugaguucuggcacaagugcgauaaugaauguauggaaagcgugaaaaacgacacguaugauuacccuaaguaccagaaagagucccgccucaauagacagaagaucgagucuguaaggcuggaaaacuuugacguuuaucaaauccuugcaauuuacagcaccgugucaaguucccuggucuuggugggacucauaauggccaugggccuguggaugugcagcaaugguucuaugcagugccguaucuguauuuga

SEQ ID NO: 133132 - RNA, 1701 nt, Artificial Sequence
  derived and/or modified sequence opt3 from hemagglutinin__InfluenzaA__AHJ57932
augaucgcccugauuauaaucaccauucucgugacaacuggcaagagcgacaaaaucugcauuggguaccacgcuaacaauuccacgaccaaggucgauacaauccuugagaaaaacguuacugugacccauucuguagaacuguuggagaaucagaaggaagagagauucuguaggauaucaaacaaagcacccuuagaccugaaggaaugcacacuagagggauggauccucgguaauccucaaugugaucugcuucugggcgaccagaguuggagcuauauuguggagcggccaaacgcccgcaaugggaucugcuacccgggaaccuugaacgaagucgaggaacuccgagcgcugauuggcuccggugaggggguggagcguuuugaaauguuccccaagucuacuugggcuggaguugauacaaauagaggcgugaccucgucauguccuuuuggcagcgggaguuccuucuauaggaaccugcucuggaucgucaaacacacgacuucuagcuacccagugauaaagggaaccuuucggaauacaggugacaaauccguauuauauuucuggggcguucaucaccccuuugauacuaacgagcagaaugugcuguacgggucaggaaaccgcuaugucagaaugggcaccgaaaguaugaauuucgccagggguccugagguggcagcccggccaguggucaacgggcagcgcggacgaauugacuacuuuuggagcauccuuaagcccggcgaaacauugaacauugagucuaauggcaaccugaucgcuccuugguacgcauauagauucguuaauaaagauuccaagggggccaucuuuaggucaaaccuaccaauugaggacugcgaugcuaccugucaaacgauagaaggagugauccggacuaauaagacauuccagaacguaagcccgcucuggauuggugagugccccaaauacgugaagagugaaucucugcgucuugccaccggccugcgcaaugucccucagaucgagacuagaggguuguuuggagcgauagcaggcuucauugaagguggguggacaggcaugaucgacggaugguauggcuaccaucacgagaacucccaggggagcggauaugccgcugauagggagucgacccaaaaagccaucgacgguauuacgaccaagguuaauucuaucauugacaaaaugaacacacaguucgaagcagugggccacgaguuuuccaaucucgaacggcgaauagauaaccugaauaagcgcuuagaggacggguuccuggauguguggacuuacaacgcugaacuccuuguccuguuggagaaugagagaacccuagaccugcaugaugccaacgugaaaaaccuccacgaaaggguacggucacagcugcgcgacaaugcgaacgaucuuggaaauggcuguuuugaguucuggcauaagugcgacaacgaauguauggagaguguuagaaaugguacauauaacuacccaaaguaccaggccgagagcaggcugaauaaacaacguaucgaauccgugaaguuggagaacuuugaugucuaucagauucucgcaaucuacucuacugugagcucaagucuggucuuaguggggcugauccuagcuaugggccucuggaugugcuccaauggaagcaugcagugccggauuuguauauga

SEQ ID NO: 133133 - RNA, 1701 nt, Artificial Sequence
  derived and/or modified sequence opt3 from hemagglutinin__InfluenzaA__AHJ57943
augaucgccuucauugugauagcuacccuggucgcaacaggcaagagcgacaaaaucugcauuggguaccacgccaacaauuccacuacgaagguugauaccauccucgagaaaaacgugacaguaacucauucuguggaacuucuggagaaucagaaggaagagagauuuuguaaaauuucaaacaaggcgcccuuggacuuaagggauugcacccuggaaggauggauccuagguaauccucgguguggcauacuccuggcugaccaaaguuggagcuauaucgucgagcgcccaaacgcccgaaaugggauuugcuacccgggaacacuuaacgaggcagaagaguuaaaggccuugaucggcuccggugaacguguggagagauucgagauguuucccaaaucuaccuggacugggguugauacagaaucgggagugucaagcgcuuguccucucggcaauggcccaaguuucuauaggaaccugcuguggauuaucaagcucaaauccucugaguaccccgucauacgggggaccuuuaauaacacgggagacaagagcauuuuauauuucuggggugugcaccauccuccaguaacuaccgaacagaaugcacuguacggcuccggggaucgcuauguuagaaugggaacagagucaaugaacuuugccaggagucccgaaaucgcugcccggccugcggugaauggccagcgcggucgaauugacuacuucuggagcauccuuaaaccaggggagacuuugaacgucgagucuaacggaaaucugaucgcaccgugguacgccuauagauuugugaacaaggauuccaagggcgcuauuuucaggucaaaucuacccauagaaaacugcgacgccaccugucagacaaccgagggcgugauccggacgaauaaaacuuuucaaaacgucagcccucucuggauuggggaaugcccaaaguacguuaaaaguaagucucugcgucuugcaacaggacugcgcaaugugccccagaucgagaccagagguuuguucggcgcuauagccggguuuauugaaggaggcuggacugguaugaucgaugggugguauggcuaccaccaugagaacucccagggaagcggcuaugcggccgacaaagagucgacacagaaggcaaucgaugggauuaccaauaaaguaaacucuaucauugacaagaugaauacgcaauucgaaaccgugggacacgaguucuccaaccucgaaaggcggauagacaaucugaacaagcgaauggaggaugguuuucuggacgucuggacauacaaugcugaacugcucgugcuucuggagaacgagcgcacuuuggaucuacacgacgccaacguuaaaaaucugcaugaaaaggugagaucacagcucagggauaacgcuaaugaccugggcaacggguguuucgaguuuuggcacaaaugcaauaacgaauguauggagagugucaagaauggaaccuaugauuacccuaaauaccagaaggagagccggcuuaaccgccagaagaucgaauccgugaaacuggagaauuucgacguauaucaaauuuuggccaucuacucuacaguuagcucaagucucgugcuggucggcuuaauccuggcaaugggucuauggaugugcuccaacgggagcaugcagugcagaauuuguauauga

SEQ ID NO: 133134 - RNA, 1701 nt, Artificial Sequence
  derived and/or modified sequence opt3 from hemagglutinin__InfluenzaA__AHJ57954
augaucgccuucauugugauagcuauccuggcagccaccggcaagagcgacaaaauuugcaucggguaccacgcgaacaauuccacaacuaaggucgauacgauucucgagaaaaacguuaccgugacacauucuguagaacuucuggagaaucagaaggaagagagauuuuguaaaaucucaaacaaggcucccuuggacuuaagggauugcacucuggaaggauggauacuagguaauccucgguguggcauccuccuggccgaccaaaguuggagcuauauuguggagcgcccaaacgcacgaaaugggaucugcuacccgggcauucuuaacgaggccgaagaacugaaggcuuugaucggauccggugaacgugucgagagauucgagauguuucccaaaucuaccugggcagggguggauacaaauucgggaguuucaagcgccuguccucucggcaacggcccaaguuucuauaggaaucugcuguggauaauuaagcagaaauccucugcuuaccccgugauccgggggaccuuuaacaauacuggagacaagagcauucucuauuucugggguguccaccauccuccagugacaaccgaacaggaggccuuauacggcuccgggaaccgcuauguaagaaugggaacggaaucaaugaauuuugcgaggaaccccgagaucgcagcccggccugcuguuaacggccagcgcggucgaaucgauuacuucuggaguauucugaaaccaggggaaacucuuaauguggagagcaacggaaauuugauagccccgugguacgcauauagauuugucaacaaggacucuaagggcgcuaucuucagguccaaucugcccauugagaacugcgaugccaccugucaaacaacugaaggcgugauccggaccaauaaaacauuucagaacgugucaccucuauggauaggggagugcccaaaguacgucaaaagcaagagucuccgucuggcgaccggacuucgcaauguuccccagauugaaacgagaggucuguucggcgccaucgcaggguuuaucgagggaggcuggacugguaugauugacgggugguauggcuaccaccaugaaaacucucagggauccggcuaugcugccgauagggagagcacacaaaaagcuaucgacgggauuaccaauaaggugaacucgauaaucgauaaaaugaauacucaguucgaggccguaggacacgaguucucuaacuuggagcggcgaauugacaaucucaacaagcgcauggaagacgguuuucuggauguguggacauacaacgcagaguuacugguccuccuugaaaaugagagaacccuggacuugcacgaugccaacgugaagaaucuacaugagaaaguuaggucccagcugcgggacaacgcuaaugaucucggcaacggguguuucgaauuuuggcacaagugcgacaaugaguguauggaaucagugaaaaacggaacguaugauuacccuaaguaccaggcggagagucgccugaauagacaaaagaucgagagcgucaaacuugaaaacuucgacguguaucagauccuggcaauuuacuccaccguaucuagcucauugguucucgugggccugauaauggccauggguuuauggaugugcaguaauggguccaugcagugcaggaucuguauuuga

SEQ ID NO: 133135 - RNA, 1701 nt, Artificial Sequence
  derived and/or modified sequence opt3 from hemagglutinin__InfluenzaA__AHJ57965
augaucgccuucauuauaaucaccauucuggugacaacuggcaagagcgacaaaaucugcauuggguaccacgcuaacaauuccacgaccaaggucgauacaauccucgagaaaaacguuacugugacccauucuguagaacuucuggagaaucagaaggaagagagauuuuguaaaauaucaaacaaggcacccuuggacuuaaaggaaugcacacuggagggauggauccuagguaauccucaaugugaucuccugcuuggcgaccagaguuggagcuauauuguggagaggccaaacgcccggaaugggaucugcuacccgggaacccugaacgaagucgaggaauugaaagcgcucauuggcuccggugagcgcguggagcgauucgaaauguuucccaagucuacuugggcugggguugauacaaauucgggagugaccucaagcuguaguuucggcuccggcucuagcuuuuaucguaaccugcuguggaucauaaaacacacgacuuccucauacccugucauuaaggggaccuucagaaauacaggagacaaaagugugcucuauuuuugggguguacaucacccaaucgauacuaccgagcagaacguuuuauacggcagcgggaauagguaugugcggaugggaacagaaucuaugaacuucgcccgcucccccgagauugcagccagaccugucgugaauggccagaggggucggaucgacuacuuuuggucaauccugaagccaggggaaacccuuaacauugagagcaacggaaauuugauagcucccugguacgcauaucgcuucgugaacaaggauaguaaaggcgccaucuuucgaucuaaucugccuauugagaacugcgacgcuacgugucaaacuaucgaaggcgucauaagaacaaauaagaccuuccagaacguuuccccacuauggauuggggagugcccgaaauacgugaagucugaaucgcucaggcuggccacuggacuucggaauguaccccagaucgagacacguggucuguuuggcgcgaucgcaggguucauugaaggaggcuggaccgguaugaucgaugggugguauggcuaccaucacgagaacucucagggauccggcuaugccgcugaccgcgagucaacgcaaagagccauugaugggauaaccacaaaagugaauaguaucauugacaagaugaacacucaguucgaagcagucggacacgaguuuagcaauuuggaaaggcggaucgacaaccucaauaaacgaauggaggaugguuuccuggacguguggaccuacaacgcugaauuacugguucuccuugagaaugagcgcacacuggauuugcaugacgccaacgugaagaaccuacacgaaagagucaggucccagcugcgggauaaugcgaacgacggcgggaauggauguuuugaguucuggcauaagugcgauaacgaauguauggagucugugaaaaauggcacuuaugacuacccuaaguaccaggccgagagccgcucaaacagacaaaggaucgaaaguguaaaacucgagaauuuugauguuuaucagauucuggcaauauacuccaccgugagcagcucacuugucguggucuggcugaucuuggcuaugggucucuggaugugcgccaacgggaguaugcagugccguauuuguaucuga

SEQ ID NO: 133136 - RNA, 1701 nt, Artificial Sequence
  derived and/or modified sequence opt3 from hemagglutinin__InfluenzaA__AHJ57977
augaucgccuucauugugauagcuauccuggcagccaccggcaagagcgacaaaauuugcaucggguaccacgcgaacaauuccacaacuaaggucgauacgauucucgagaaaaacguuaccgugacacauucuguagaacuucuggagaaucagaaggaagagagauuuuguaaaaucucaaacaaggcucccuuggacuuaagggauugcacuauagaaggauggauccuggguaauccucgguguggcauucuacucgccgaccaaaguuggagcuauaucguggagcgcccaaacgcacgaaaugggauuugcuacccgggaacccugaacgaggucgaggaacuuaaggcccugaucggcuccggugaacguguggagagauucgagauguuucccaaaucuacaugggcugggguugauaccaauucgggagugucaagcgcauguccuuugggcaacggcccaaguuucuauaggaaucuccuguggauaauuaagcugaaauccucugaauaccccgucauccgggggacuuuuaacaauacaggagacaagagcauucucuauuucuggggugugcaccauccuccaguaaccacggagcaggaagccuuauacggcuccggggaucgcuauguuagaaugggaacugagucaaugaacuuugcuaggagucccgaaaucgccgcgcggccugcagugaauggccagcgcggucgaaucgacuacuucuggagcauucugaaaccaggggagacccuuaacgucgagucuaacggaaauuugauagccccgugguacgcuuauagauuugugaacaaggauuccaagggcgccaucuucaggucaaaucugcccauugaaaacugcgacgcaacaugucagacuaccgagggcgugauccggacaaauaaaaccuuucaaaacgucagcccucuauggauaggggaaugcccaaaguacguuaaaaguaagucucuccgucuggcuacgggacuucgcaaugugccccagauugagacuagaggucuguucggcgccaucgcgggguuuaucgaaggaggcuggacagguaugauugaugggugguauggcuaccaccaugagaacucccagggaagcggcuaugccgcagacaaagagucgacccagaaggcuaucgaugggauuacuaauaaaguaaacucuauaaucgacaagaugaauacacaauucgaagccgugggacacgaguucuccaacuuggaaaggcggauugacaaucucaacaagcgaauggaggaugguuuucuggacgucuggaccuacaaugcugaauuacuggugcuccuugagaacgagcgcacgcuggauuugcacgacgccaacguuaaaaaucuacaugaaaaggugagaucacagcugagggauaacgcaaaugaccucggcaacggguguuucgaguuuuggcacaaaugcaauaacgaauguauggagagugucaagaauggaaccuaugauuacccuaaauaccagaaggagagccggcugaaccgccagaagaucgaauccgugaaacuugagaauuucgacguauaucaaauccuggccauuuacucuacaguuagcucaaguuuggugcucgucggccugauauuagcuaugggucuguggaugugcuccaacgggagcaugcagugcagaaucuguauuuga

SEQ ID NO: 133137 - RNA, 1701 nt, Artificial Sequence
  derived and/or modified sequence opt3 from hemagglutinin__InfluenzaA__AHJ57989
augaucgccuucauugugauagcuauccuggucaccacaggcaagagcgacaaaauuugcaucggguaccacgcaaacaauuccacuacgaagguugauaccauucucgagaaaaacgugacaguaacucauucuguggaacuucuggagaaucagaaggaagagagauuuuguaaaaucucaaacaaggcccccuuggacuuaagggauugcacccuggaaggauggauacuagguaauccucgguguggcauccuccuggcggaccaaaguuggagcuauauugucgagcgcccaaacgcucgaaaugggaucugcuacccgggaacacuuaacgagguggaagaacugaaggccuugauuggcuccggugaacguguugagagauucgagauguuucccaaaucuaccugggcaaggguggauacugaccgcggggucucgucagccuguccucucggaaauggccccagcuucuaucggaaccugcuguggaucgugaagcacacaaccagugaauacccaguaauaaaaggcacguauacuaauaccggggauaaguccguucucuacuuuuggggagugcaucacccuccagacacaacugagcagaacgucuuauaugguucuggcaauagauacgugaggauggggaccgaaagcaugaacuucgcucggucccccgagauugcagcccgcccugcugugaauggacagcgaggcagaaucgauuacuuuuggucaauucugaaaccaggugaaacacuuaacgucgagaguaacgggaauuugaucgccccgugguaugcguacagguucguuaacaaggacagcaagggagcaaucuuucggucuaaucugcccauugagaacugcgaugccaccugucagacgacugaaggcgugauacguacaaauaaaaccuuccaaaacguauccccuauguggaucggcgagugcccaaaguaugugaaaucaaagagccuacgccucgcuacugggcugagaaaugucccccagauugaaacaaggggacuuuuuggugccaucgcaggcuucauagaagggggauggaccggcaugauugacgguugguacggguaucaucacgaaaacagucagggcucuggauacgcugccgaucgggaguccacgcagaaagcgaucgacggcaucaccaauaaggugaacagcauuaucgacaaaaugaauacacaauuugaggccguugggcacgaguucucgaaccuggagcgacgcauugauaauuugaacaagagaauggaagacggauuccucgauguguggacuuauaaugcagagcuguuaguccugcucgaaaacgagaggacccuugaccugcaugauucuaacgugaagaauuugcacgagcggguaaaaucccagcuacgcgacaacgcuaaugaucuggguaacggcuguuuugaguucuggcauaagugcgacaaugaguguauggaaucaguuaaaaacgggacauacaauuacccuaaguaucaggccgagaguagacucaacaggcagaaaauagagagcgugaagcuggaagaguuuggagucuaccaaauccuugcuauuuauuccacugugucuagcucacuggucuuggugggccucaucauggccaugggucuguggaugugcaguaauggguccaugcagugccguaucuguauuuga

SEQ ID NO: 133138 - RNA, 1701 nt, Artificial Sequence
  derived and/or modified sequence opt3 from hemagglutinin__InfluenzaA__AHJ58001
augaucgccuucauugugauagcuauccuggcagccaccggcaagagcgacaagauuugcaucggguaccacgcgaacaauuccacaacuaaggucgauacgauucucgagaaaaacguuaccgugacacauucuguagaacuucuggagaaucagaaggaagagagauuuuguaaaaucucaaacaaggcucccuuggacuuaagggauugcacucuggaaggauggauacuagguaauccucgguguggcauccuccuggccgaccaaaguuggagcuauauuguggagcgcccaaacgcacgaaaugggaucugcuacccgggcauucuuaacgaggccgaggaacugaaggcuuugaucggauccggugaacgugucgagagauucgagauguuucccaaaucuaccugggcagggguggauacagacucgggaguuucaagcgccuguccucucggcaauggcccaaguuucuauaggaaccugcuguggauaauuaagcucaaauccucugaauaccccgugauccgggggaccuuuaauaacacuggagauaagagcauuuuauauuucugggguguccaccauccuccagugacaaccgagcaggaagcucuguacggcuccgggaaucgcuauguaagaaugggaacggagucaaugaacuuugccaggagucccgaaaucgcggcacggccugccguuaauggccagcgcggucgaaucgacuacuucuggagcauucuuaaaccaggggagacuuugaacguggagucuaacggaaaucugauagcuccgugguacgccuauagauuugucaacaaggauuccaagggcgcaaucuucaggucaaaucuacccauugaaaacugcgacgcuaccugucagacaacugagggcgugauccggaccaauaaaacauuucaaaacgugagcccuauguggauaggggaaugcccaaaguacgucaaaaguaagucucuccgucuggccaccggacuucgcaauguuccccagauugagacgagaggucuguucggcgcgaucgccggguuuaucgaaggaggcuggacugguaugauugaugggugguauggcuaccaccaugagaacucccagggaagcggcuaugcagcugacagggagucgacacagaaagccaucgaugggauuaccaauaaggugaacucuauaaucgacaaaaugaauacucaauucgaagcuguaggacacgaguucuccaacuuggaacggcgaauugacaaucucaacaagcgcauggaggaugguuuucuggacguguggacauacaaugccgaauuacugguccuccuugagaacgagagaacccuggauuugcacgacgcaaacgugaagaaucuacaugaaaaaguuaggucacagcugcgggauaacgccaaugaccucggcaacggguguuucgaguuuuggcacaagugcgauaaugaauguauggagagugugaaaaacggaacguaugacuacccuaaguaccagaccgagagccgccugaauagacagaaaaucgaauccgucaaacuugagaacuucgauguguaucaaauccuggcuauuuacucuacaguaagcucaaguuugguucucgugggccugauaauggcgauggguuuauggaugugcuccaaugggagcaugcagugcaggaucuguauuuga

SEQ ID NO: 133139 - RNA, 1701 nt, Artificial Sequence
  derived and/or modified sequence opt3 from hemagglutinin__InfluenzaA__AHJ58013
augaucgccuucauugugauagcuauccuggucaccacaggcaagagcgacaaaauuugcaucggguaccacgcaaacaauuccacuacgaagguugauaccauucucgagaaaaacgugacaguaacucauucuguggaacuucuggagaaucagaaggaagagagauuuuguaaaaucucaaguaaggcccccuuggacuuaagggauugcagccuggaaggauggauacuagguaacccucgguguggcauccuccuggcggaccaauccuggucuuauauugucgagcgcccaaaugcucgaaacgggaucugcuacccgggaacccuuaaugagguggaagaacugaaggccuugauuggcucgggugaacguguugagagauucgagauguuucccaaaucaacaugggcagggguggauaccaacagcggagucaguuccgccuguccucucggcgaaggcccaucuuucuauaggaaucugcuguggaucauaaagcggacuacaagcgaguaccccgugauuaaagggaccuaucgcaacacgggagacaaguccguacucuacuuuugggguguucaccauccuccagauacuaccgaacagaauguguuauauggcucagggaacagauacgucaggaugggaacagagaguaugaauuucgcucggagccccgaaaucgcagcccgcccugcugugaacggccagcgagguagaauugacuacuuuuggucuauccugaaaccaggggagacucuugauguggaguccaauggaaacuugaucgccccgugguaugcguacagguucgucaacaaggaaucaaagggcgcaauuuuucggagcaaucugcccauagagaacugcgacgccaccugucagacaaccgaaggcguuauccguacgaauaaaacuuuccaaaacgugaguccucuauggauuggggagugcccaaaguauguaaaaucuaagucccuccgccuggcuacaggacuuagaaaugugccccagaucgaaaccaggggucuguuuggcgccauagcaggguucauugagggaggcuggacugguaugaucgaugggugguacggcuaucaccaugagaacagccagggaucgggcuacgcugccgacaaagaaucuacacagaaggcgaucgaugggauuaccaauaaagucaacuccaucauugacaagaugaauacgcaauuugaggccgugggacacgaguucucaaccuuggagcggcgaauagacaaccucaauaagcgcauggaagaugguuuccuggacguuuggacauauaacgcagaguuacuggugcuccuugagaaugaaagaacucuggauuugcacgacgcuaacgucaaaaaucuacaugagagggugcggagucagcugcgcgauaacgccaacgaccucggcaauggguguuuugaguucuggcacaagugcgauaacgaauguauggagagcguaaagaauggaaccuacaacuacccuaaguaucaggcugaauccagacugaauaaacagaagaucgagucuguuaaacuugaagaguuuggcguguaccaaauucuggccaucuauagcacagucucaaguuccuuggugcucgucggucugaucauggcaaugggguuauggaugugcagcaacggcucuaugcagugcaggauuuguauauga

SEQ ID NO: 133140 - RNA, 1701 nt, Artificial Sequence
  derived and/or modified sequence opt3 from hemagglutinin__InfluenzaA__AHJ58025
augaucgccuucauugugauagcuauccuggucaccacaggcgagagcgacaagauuugcaucggguaccacgcaaacaauuccacuacgaaaguugauaccauucucgaaaagaacgugacaguaacucauucuguggagcuucuggaaaaucagaaagaggaaagauuuuguaagaucucaaacaaagcccccuuggacuuaagggauugcaccauagagggauggauccuggguaauccucgguguggcauucuacucgcggaccaaaguuggagcuauaucgucgagcgcccaaacgcucgaaaugggauuugcuacccgggaacacugaacgaagccgaggaacuuaaggcacugaucggcuccggugaggggguggagcguuucgaaauguuucccaagucuaccugggccggaguugauacuaauucgggcgugucaagcgcuuguccuuugggcaacgggccaaguuucuauagaaaucuccuguggauaauuaaacugaaguccucugaguaccccgucaucaggggaacauuuaacaauaccggugacaaaagcgugcucuauuucuggggcguacaccauccuccaguuacgacugaacagaacgauuuauacggguccggaaaucgguaugugcgcaugggcaccgagucaaugaacuuugcaagaaaccccgaaauugcccugaggccugcugucaauggucagcgggggcgcaucgacuacuucuggaguauccuuaagccaggagagacauugaacguggagagcaauggcaaccugauugccccgugguacgcguaucgauuugugaauaaagauucuaagggcgcaauauucagauccucacuacccaucgaaaacugcgacgccacuugucagaccgcugagggggucauuaggacaaauaagaccuuucaaaacguuagcccucucuggaucggagaaugcccaaaauacgugaagaguaaaucucugcggcuugccacgggucugcguaauguaccccagauagagacucgcggcuuguucggggcaauugcuggauuuaucgaaggcgguuggacagggaugguggauggcugguauggauaccaccaugagaacucccagggcagcggguaugccgcggacagagagucgacccagaaggccaucgauggaauuacuaauaaagucaacucuaucauugacaagaugaauacacaauucgaagcaguggaccacgaguucuccaaccucgaaaggcggauagauaaucugaacaaacgaauggaggacggcuuuuuagauguuuggaccuacaacgcugaacugcucgugcuucuggagaaugagcgcacguuggaccuacacgaugccaacgucaagaaucugcaugaaaaggugaaaucacagcucagagacaacgcuaaugaucuggguaacggguguuucgaguuuuggcacaagugcgacaaugaauguauggagaguguuaaaaacggaaccuauaauuacccuaaguaccagaaagagagcaggcuuaaccggcagaagaucgaauccguaaagcuggagaauuucgauguguaucaaauuuuggccaucuacucuacagucagcucaagucucgugcuggucggcuuaaucauggcaaugggucuguggaugugcuccaacgggagcaugcagugccgcauuuguauauga

SEQ ID NO: 133141 - RNA, 1701 nt, Artificial Sequence
  derived and/or modified sequence opt3 from hemagglutinin__InfluenzaA__AHJ58037
augaucgccuucauuauaaucaccauucuggugacaacuggcgagagcgacaagaucugcauuggguaccacgcuaacaauuccacgaccaaggucgauacaauccucgaaaagaacguuacugugacccauucuguagagcuucuggaaaaucagaaagaggaaagauuuuguaagauaucaaacaaagcacccuuggacuuaaaggagugcacacuggagggauggauccuagguaauccucaaugugaucuccugcuuggcgaccagaguuggagcuauauuguggaaaggccaaacgcccggaaugggaucugcuacccgggaacccugaacgaggucgaagaguugaaggcgcucauuggcuccggugagcgcguggaacgauucgagauguuucccaaaucuacuugggcugggguugauacaaauucgggagugacccguucauguccuuucggcagcggcaguuccuuuuauagaaaccugcuguggaucauaaagcacacgacuucuagcuacccagucauuaaagggaccuucaggaauacaggagacaaguccgugcucuauuuuugggguguacaucaccccaucgauacuaccgaacagaacguuuuauacggcucagggaaucgguaugugcgcaugggaacagagaguaugaacuucgccagaagcccugaaauugcagccaggccagucgugaauggccagcggggucgcaucgacuacuuuuggucuauccugaaacccggggagacccuuaacauugaguccaacggaaauuugauagcuccuugguacgcauaucgauucgugaacaaggauucaaagggcgccaucuuuagaagcaaucugccaauugaaaacugcgacgcuacgugucaaacuaucgagggcgucauaaggacaaauaaaaccuuccagaacguuaguccgcuauggauuggggaaugccccaaguacgugaaaucugagucccuccggcuggccacuggacuucguaauguaccucagaucgaaacacgcggucuguuuggcgcgaucgcaggguucauugagggaggcuggaccgguaugaucgaugggugguauggcuaccaucacgagaacagccagggaucgggcuaugccgcugacagagaaucuacgcaaagggccauugaugggauaaccacaaaggucaauuccaucauugacaaaaugaacacucaguucgaggcagugggacacgaauuuucaaauuuggagcggcgaaucgacaaccucaauaagcgcauggaagaugguuuccuggacguguggaccuacaacgcugaguuacugguucuccuugagaaugaaagaacacuggauuugcaugacgccaacgugaaaaaccuacacgagagggucaagagucagcugcgggauaaugcgaacgaccucggcaauggguguuuugaguucuggcauaagugcgauaacgaauguauggagagcgugaaaaauggaacuuaugacuacccaaaguaccaggccgaaucccgccugaacaaacaaagaaucgagucuguaaaacuugaaaauuuugauguuuaucagauucuggcaauauacagcaccgugucaaguuccuugguccucgugggccugaucauggcuauugguuuauggaugugcagcaacgggucuaugcagugcaggaucuguauuuga

SEQ ID NO: 133142 - RNA, 1701 nt, Artificial Sequence
  derived and/or modified sequence opt3 from hemagglutinin__InfluenzaA__AHJ58049
augaucgccuucauugugauagcuauccuggcagccaccggcaagagcgacaaaauuugcaucggguaccacgcgaacaauuccacaacuaaggucgauacgauucucgagaaaaacguuaccgugacacauucuguagaacuucuggagaaucagaaggaagagagauuuuguaaaaucucaaacaaggcucccuuggacuuaagggauugcacucuggaaggauggauacuagguaauccucgguguggcauccuccuggccgaccaaaguuggagcuauauuguggagcgcccaaacgcacgaaaugggaucugcuacccggguauucuuaacgaggccgaggaacugaaggcuuugaucggcuccggugaacgugucgagagauucgagauguuucccaaaucuaccugggcagggguggauacagacucgggaguuucaagcgccuguccucucggcaauggcccaaguuucuauaggaaccugcuguggauaauuaagcucaaauccucugaauaccccgugauccgggggaccuuuaauaacacuggagauaagagcauuuuauauuucugggguguccaccauccuccagugacaaccgagcaggaagcucuguacggcuccgggaaucgcuauguaagaaugggaacggagucaaugaacuuugccaggacucccgaaaucgcggcacggccugccguuaauggccagcgcggucgaaucgacuacuucuggaguauucuuaaaccaggggagaccuugaacguggagagcaacggaaaucugauagcuccgugguacgccuauagauuugucaacaaggauucuaagggcgcaaucuucagguccaaucuacccauugaaaacugcgacgcuacaugucagacuaccgagggcgugauccggacaaauaaaaccuuucaaaacgugucaccucucuggauaggggaaugcccaaaguacgucaaaagcaagagucugcgucuugccacgggacugcgcaauguuccccagauugagacuagagguuuguucggcgcgaucgccggguuuaucgaaggaggcuggacagguaugauugaugggugguauggcuaccaccaugagaacucucagggauccggcuaugcagcugacagggagagcacccagaaagccaucgaugggauuacuaauaaggugaacucgauaaucgacaaaaugaauacacaauucgaagcuguaggacacgaguucucuaaccucgaacggcgaauugacaaucugaacaagcgcauggaggauggauuuuuagacguguggaccuacaaugccgaacugcucguccuucuggagaacgagagaacguuggaucuacacgacgcaaacgugaagaaucugcaugaaaaaguuaggucccagcuccgggauaacgccaaugaccugggcaacggguguuucgaguuuuggcacaagugcgauaaugaauguauggagucagugaaaaacggaaccuaugacuacccuaaguaccaggcugagagucgccuuaauagacagaaaaucgaaagcgucaagcuggagaacuucgauguguaucaaaucuuggcgauuuacuccacaguaucuagcucacucguucuggugggcuuaauaauggcaaugggucuguggaugugcaguaauggguccaugcagugcaggaucuguauuuga

SEQ ID NO: 133143 - RNA, 1701 nt, Artificial Sequence
  derived and/or modified sequence opt3 from hemagglutinin__InfluenzaA__AHJ58061
augaucgccuucauugugauagcuacccuggucgcaacaggcaagagcgacaaaaucugcauuggguaccacgccaacaauuccacuacgaagguugauaccauccucgagaaaaacgugacaguaacucauucuguggaacuucuggagaaucagaaggaagagagauuuuguaaaauuucaaacaaggcgcccuuggacuuaagggauugcacccuggaaggauggauccuagguaauccucgguguggcauacuccuggcugaccaaaguuggagcuauaucgucgagcgcccaaacgcccgaaaugggauuugcuacccgggaacacuuaacgaggcagaagaguuaaaggccuugaucggcuccggugaacguguggagagauucgagauguuucccaaaucuaccuggacugggguugauacagaaucgggagugucaagcgcuuguccucucggcaauggcccaaguuucuauaggaaccugcuguggauuaucaagcucaaauccucugaguaccccgucauacgggggaccuuuaauaacacgggagacaagagcauuuuauauuucuggggugugcaccauccuccaguaacuaccgaacagaaugcacuguacggcuccggggaucgcuauguuagaaugggaacagagucaaugaacuuugccaggagucccgaaaucgcugcccggccugcggugaauggccagcgcggucgaauugacuacuucuggagcauccuuaaaccaggggagacuuugaacgucgagucuaacggaaaucugaucgcaccgugguacgccuauagauuugugaacaaggauuccaagggcgcuauuuucaggucaaaucuacccauagaaaacugcgacgccaccugucagacaaccgagggcgugauccggacgaauaaaacuuuucaaaacgucagcccucucuggauuggggaaugcccaaaguacguuaaaaguaagucucugcgucuugcaacaggacugcgcaaugugccccagaucgagaccagagguuuguucggcgcuauagccggguuuauugaaggaggcuggacugguaugaucgaugggugguauggcuaccaccaugagaacucccagggaagcggcuaugcggccgacaaagagucgacacagaaggcaaucgaugggauuaccaauaaaguaaacucuaucauugacaagaugaauacgcaauucgaagcugugggacacgaguucuccaaccucgaaaggcggauagacaaucugaacaagcgaauggaggaugguuuucuggacgucuggaccuacaaugccgaacugcucgugcuucuggagaacgagcgcacauuggaucuacacgacgcuaacguuaaaaaucugcaugaaaaggugagaucacagcucagggauaacgccaaugaccugggcaacggguguuucgaguuuuggcacaaaugcaauaacgaauguauggagagugucaagaauggaacuuaugauuacccuaaauaccagaaggagagccggcuuaaccgccagaagaucgaauccgugaaacuggagaauuucgacguauaucaaauuuuggcaaucuacucuaccguuagcucaagucucgugcuggucggcuuaauccuggccaugggucuauggaugugcuccaacgggagcaugcagugcagaauuuguauauga

SEQ ID NO: 133144 - RNA, 1701 nt, Artificial Sequence
  derived and/or modified sequence opt3 from hemagglutinin__InfluenzaA__AHJ58084
augaucgccuucauugugauagcuacccuggucgcaacaggcaagagcgacaaaaucugcauuggguaccacgccaacaauuccacuacgaagguugauaccauccucgagaaaaacgugacaguaacucauucuguggaacuucuggagaaucagaaggaagagagauuuuguaaaauuucaaacaaggcgcccuuggacuuaagggauugcacccuggaaggauggauccuagguaauccucgguguggcauacuccuggcugaccaaaguuggagcuauaucgucgagcgcccaaacgcccgaaaugggauuugcuacccgggaacacuuaacgaggcagaggagcugaaggccuugaucggcuccggugaacguguggagagauucgagauguuucccaaaucuaccuggacugggguuaauacagaaucgggagugucaagcgcuuguccucucggcaacggcccaaguuucuauaggaaucugcuguggauuaucaagcucaaauccucugaguaccccgucauacgggggaccuuuaacaauacgggagauaagagcauuuuauauuucuggggugugcaccauccuccaguaacuaccgaacagaacgcacuguacggcuccggggaccgcuauguuagaaugggaacagagucaaugaauuuugccaggagucccgaaaucgcugcccggccugcggugaacggccagcgcggucgaauugauuacuucuggagcauccuuaaaccaggggagacuuugaacgucgagucuaauggaaaccugaucgcaccgugguacgccuauagauuugugaauaaggacuccaagggcgcuauuuucaggucaaaccuacccauagaaaauugcgaugccaccugucagacaaccgagggcgugauccggacgaacaaaacuuuucaaaaugucagcccucucuggauuggggaaugcccaaaguacguuaaaaguaagucucugcgucuugcaacaggacugcgcaacgugccccagaucgagaccagagguuuguucggcgcuauagccggguuuauugaaggaggcuggacugguaugaucgacgggugguauggcuaccaccaugaaaauucccagggaagcggcuaugcggccgauaaagagucgacacagaaggcaaucgacgggauuaccaacaaaguaaauucuaucauugauaagaugaacacgcaauucgaagcugugggacacgaguucuccaaucucgaaaggcggauagacaaccugaauaagcgaauggaggacggcuuuuuagaugucuggaccuacaacgccgaacugcucgugcuucuggagaacgagcgcacauuggaccuacacgaugcuaauguuaaaaaccugcaugaaaaggugagaucacagcucagggacaaugccaacgaucuggguaauggguguuucgaguuuuggcacaaaugcaacaaugaauguauggagagugucaagaacggaacuuaugacuacccuaaauaccagaaggagagccggcuuaaucgccagaagaucgaauccgugaaacuggagaacuucgauguauaucaaauuuuggcaaucuacucuaccguuagcucaagucucgugcuggucggcuuaauccuggccaugggucuauggaugugcuccaaugggagcaugcagugcagaauuuguauauga

SEQ ID NO: 133145 - RNA, 1701 nt, Artificial Sequence; identical to SEQ ID NO: 128871
  derived and/or modified sequence opt3 from hemagglutinin__InfluenzaA__AHL80708

SEQ ID NO: 133146 - RNA, 1701 nt, Artificial Sequence
  derived and/or modified sequence opt3 from hemagglutinin__InfluenzaA__AHL80718
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagaucagcuccuggcccaaccacgacucaaauaagggugucacagccgcuuguccucaugcaggggccaaaaguuuuuauaagaaccugauauggcucgugaaaaagggaaauagcuacccaaaauuaucuaaguccuauaucaacgauaagggcaaagaaguacugguucuuuggggcauucaccaccccucaaccacggcugaccaacagagcuuguaccagaaugccgaugcguacguguucgucgggacuucucgcuauucuaagaaauuuaagccugagaucgcaauucgaccaaaagugcgugaccaggagggaagaaugaacuacuauuggacccugguggaacccggugauaagaucacauucgaggccacuggcaaccuagucguuccuagguacgcuuuugccauggaacggaaugcaggguccggaauaauuaucagcgacaccucggugcaugauugcaacacaaccugucaaacgccaaaaggcgcuauuaauacuucucucccguuccagaacauccaccccaucacaauugguaagugcccuaaguauguaaaauccaccaagcugcgccuugccacugggcugagaaaugugccaucaauacagaguaggggauuguuuggcgcgaucgccggcuucauugaagggggauggacagguauggucgacggcugguacggguaucaucaccagaacgaacaaggaagcggcuacgcagcugaccucaaauccacccagaaugccaucgauaagauaacgaacaaagugaauaguguuauugagaagaugaacacccaguuuacagcuguggguaaggaguucaaucaccuggaaaaacggaucgagaacuuaaauaagaaagucgacgauggguuccuggacaucuggacuuacaacgccgaacuccuugugcuguuggagaaugaacgcacccuagauuaucaugacagcaacguaaagaaccuguacgagaaaguucgaucacagcucaagaauaacgcaaaggagauuggcaauggauguuuugaguucuaucacaaaugcgauaacacauguauggaaagugugaagaauggcacuuacgacuaucccaaauacuccgaagaggccaagcugaacagagaagagaucgauggggucaaacuugagagcaccaggauuuaucaaauacuggcuaucuacucuacaguggcgucaaguuugguccucgugguuagccugggagcaauuuccuuuuggaugugcucuaaugguucguuacagugccggaucuguaucuga

SEQ ID NO: 133147 - RNA, 1710 nt, Artificial Sequence
  derived and/or modified sequence opt3 from hemagglutinin__InfluenzaA__AHL80729
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuuggugagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggacuucucgcuauuccaaaaaguuuaaaccugagauugcaauccgaccaaaggugcgugaucaggaaggaagaaugaauuacuauuggacccugguggagcccggugacaaaauuacauucgaagccacuggcaaccuagucguuccuagguacgcuuuugccauggagcggaacgcagggagcggaaucauaauuucggauaccccagugcaugacugcaauacaaccugucaaacgccgaagggcgcuaucaacacuucucucacaucccugcccuuccagaauguacacccuauuaccaucgguaaaugcccaaaguaugugaagucaacuaaacuucgccuggccacaggguugagaaacguccccaguauccagagcaggggacucuuuggcgcgauugccggcuucauagaagggggauggaccgguaugguggacggcugguacggguaucaucaccagaaugagcaaggauccggcuacgcagcugaucugaagucuacgcagaacgccaucgacgagauuaccaauaaaguuaacagcgugaucgaaaagaugaauacacaguuuacugcugucgguaaagaguucaaccacuuagaaaagcggauagagaaucugaacaagaaaguggaugacggguuccucgauauuuggaccuacaaugccgaacuucugguauugcuagagaacgagcgcacacuggacuaucaugauucaaauguuaagaaccucuacgaaaaagugcgaagucagcugaagaacaaugcaaaagagaucggcaacggauguuuugaguucuaucacaagugcgacaauacuuguauggaauccgucaagaacggcaccuacgauuauccuaaauacagcgaagaggccaaacuuaauagagaggaaaucgacggggugaagcuggagucuacaaggauuuaucaaaucuuggcuauuuacucaaccgucgcgaguagccucgugcugguuguguccuuaggagcaauaucuuuuuggaugugcucgaacgguagccugcagugccggaucuguauuuga

SEQ ID NO: 133148 - RNA, 1701 nt, Artificial Sequence
  derived and/or modified sequence opt3 from hemagglutinin__InfluenzaA__AHL80740
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaauugcucucuacagcaucaaguuggagcuacauuguugagaccuccucuucggacaacggaacuugcuauccaggcgauuuuaucaauuacgaggagcugagggagcagcugucaagcgugaguuccuucgaacgguuugagauuuucccgaagacaucuagcuggcccaaccacgacuccaauaagggugucaccgccgcuuguccucaugcaggggccaaaucauuuuauaagaaccucaucugguuagugaaaaagggaaauaguuacccaaaacugagcaagucuuauauaaacgauaagggcaaagaaguacuuguuuuguggggcgugcaccaccccuccacgucagcugaccaacagagccuguaccagaaugccgaugcguacgucuucguggggacuagccgcuauucuaagaaauuuaagccugagaucgcaauucgaccaaaagugcgugaccaggagggaagaaugaacuacuauuggacccuagucgaacccggugauaagaucacauucgaggccacuggcaaccucguugugccuagguacgcuuuugccauggaacggaaugcaggguccggaauuaucauaagcgacaccccaguacaugauugcaacacaaccugucaaacgccgaaaggcgcuauuaauacuucgcugcccuuccagaacauccacccuauuacaaucgguaagugcccaaaguaugugaaaucuaccaaacuucgccuggccacuggguugagaaauguccccuccauccagucaaggggacucuuuggcgcgauugccggcuucauagaagggggauggacagguaugguggacggcugguacggguaucaucaccagaacgaacaaggaaguggcuacgcagcugaccugaaaagcacccagaaugccaucgauaagauuacgaacaaaguuaauuccgugaucgagaagaugaacacccaguuuacagcugucgguaaggaguucaaucacuuagaaaaacggauagagaaccugaauaagaaaguggacgauggguuccucgacauuuggacuuacaacgccgaacuucugguauugcuagagaaugaacgcacccuggauuaucaugacucuaacguuaagaaccucuacgagaaagugcgaagccagcugaagaauaacgcaaaggagaucggcaauggauguuuugaguucuaucacaaaugcgauaacacauguauggaaucagucaagaauggcacuuacgacuauccuaaauacagugaagaggccaaacuuaacagagaaaagaucgauggggugaagcuggaguccaccaggauuuaucaaaucuuggcuauuuacagcacagucgcgucuucacucgugcugguugugaguuuaggagcaauaaguuuuuggaugugcuccaaugguucucugcagugccggaucuguauuuga

SEQ ID NO: 133149 - RNA, 1701 nt, Artificial Sequence
  derived and/or modified sequence opt3 from hemagglutinin__InfluenzaA__AHL80751
augaaggccauccuggugguccuccuuuacaccuucgcuacagcaaacgccgacacucugugcauuggcuaucacgcgaauaacagcacggauaccguugacacaauauuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaagaacucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaaauucuggugcuuuggggcauccaccaccccucaacgagcgcugaucaacagaguuuguaccagaacgccgacgcguacguauucguugggacuucucgcuauuccaagaaauuuaagccugagauugcaauccgaccaaaagugcgugaucaggagggaagaaugaauuacuauuggacccuggucgaacccggugacaagauaacauucgaggccacuggcaaccuaguggugccuagguacgcuuuugccauggagaaaaacgcagggagcggaauuaucauuucggauaccccaguccaugacugcaauacaaccugucaaacgccgaagggcgcuaucaacacuucucuccccuuccagaauauccacccuauuacaauagguaagugcccaaaauauguuaaguccaccaaacugcggcuugccacugggcugcgcaacgugcccucaauccagaguagaggauuguuuggcgcgauugccggcuucaucgaagggggauggacagguaugguagacggcugguacggguaucaucaccagaaugaacaaggaagcggcuacgcagcugaucucaaguccacccagaacgccauagacgagauuacgaauaaagugaacucugucaucgagaagaugaauacccaguuuacagcuguggguaaggaguucaaccaccuggagaaaaggaucgaaaauuuaaacaagaaaguugaugacggguuccuggauauuuggacuuacaaugccgagcuccuugugcuguuggaaaacgagcggacccuagacuaucaugauagcaaugucaagaaccuguacgagaaagugcgcucacagcucaagaacaaugcaaaggaaguaggcaacggauguuuugaguucuaucacaaaugcgacaauacauguauggaaaguguuaagaacggcacuuacgauuauccuaaauacuccgaggaagccaagcugaaucgagaggagaucgacggggugaaacuugaaagcaccagaauuuaucaaauacuggcuaucuacucuacagucgcgucaaguuuggugcucgucgugagccugggagcaauuuccuuuuggaugugcucuaacgguucguuacagugcaggaucuguaucuga

SEQ ID NO: 133150 - RNA, 1701 nt, Artificial Sequence
  derived and/or modified sequence opt3 from hemagglutinin__InfluenzaA__AHL80762
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggauucugguggaacccggugauaagaucaccuucgaggccacaggcaaccuagucguuccuagguacgcuuuugccauggaacggaaugcagggagcggaauaauuaucucggacacuccagugcaugauugcaacaccacaugucaaaccccgaaaggcgcuauuaauacgucucuccccuuccagaacauccacccuaucacuauugguaagugcccaaaguauguaaaauccacaaagcugcgccuugccaccgggcugagaaaugugcccucaauacagaguaggggauuguuuggcgcgaucgccggcuucauugaagggggauggacugguauggucgacggcugguacggguaucaucaccagaacgaacaaggaagcggcuacgcagcugaccucaaauccacacagaaugccaucgauaagauaaccaacaaaguuaauucugugauugagaagaugaacacgcaguuuaccgcuguggguaaggaguucaaucaccuggaaaaacggaucgagaacuuaaauaagaaagucgacgauggguuccuggacaucuggacauacaacgccgaacuccuugugcuguuggagaaugaacgcacucuagauuaucaugacagcaacguaaagaaccuguacgagaaaguucgaucacagcucaaggauaaugcaaaggagauuggcaacggauguuuugaguucuaucacaaaugcgacaauaccuguauggaaagugugaagaacggcacauacgauuauccuaaauacuccgaagaggccaagcugaauagagaagagaucgacggggucaaacuugagagcacuaggauuuaucaaauacuggcuaucuacucuaccguggcgucaaguuugguccucgugguuagccugggagcaauuuccuuuuggaugugcucuaacgguucguuacagugccggaucuguaucuga

SEQ ID NO: 133151 - RNA, 1701 nt, Artificial Sequence
  derived and/or modified sequence opt3 from hemagglutinin__InfluenzaA__AHL80784
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaaggguaucaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugguggaacccggugacaagaucacauucgaggccacuggcaaccuaguggucccuagguacgcuuuugccauggaacggaacgcagggagcggaauaauuaucucggauaccccaguucaugacugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacguacccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacaagauaacgaauaaagucaacucugugauugagaagaugaauacccaguuuacagcuguugguaaggaguucaaccaccuggaaaaacggaucgagaauuuaaacaagaaaguggaugacggguuccuggauaucuggacuuacaaugccgaacuccuuguccuguuggagaacgaacgcacccuagacuaucaugauagcaaugugaagaaccuguacgagaaaguacgaucacagcucaagaacaaugcaaaggagauuggcaacggauguuuugaguucuaucacaaaugcgacaauacauguauggaaaguguuaagaacggcacuuacgauuauccuaaauacuccgaagaggccaagcugaauagagaagagaucgacggggugaaacuugagagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 133152 - RNA, 1701 nt, Artificial Sequence; identical to SEQ ID NO: 125849
  derived and/or modified sequence opt3 from hemagglutinin__InfluenzaA__AHL80795

SEQ ID NO: 133153 - RNA, 1701 nt, Artificial Sequence
  derived and/or modified sequence opt3 from hemagglutinin__InfluenzaA__AHL80817
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaacugcaauauagccggcuggauccuggggaacccugagugugaaucuuugucaacagcaaguagcugguccuacauuguugaggccucuucgucagacaauggaaccugcuauccaggcgauuuuaucgacuacgaggagcucagggagcagcugagcaguguguccucuuucgaacgguuugagauuuucccgaaaacuagcuccuggcccaaccacgauucaaauaagggugucacagcugcauguccucaugccggggcuaagaguuuuuauaaaaaccugaucuggcucgugaagaaaggaaauagcuacccaaaguuaucuaaauccuauauaaacgacaagggcaaggaaguacugguucuuuggggcauccaccaccccucaaccagcgccgaucaacagaguuuguaccagaaugcggacgcauacguguucgucgggacgucucgcuauuccaaaaaguuuaaaccugagauugccauccgaccaaaggugcgugaucaggagggaagaaugaacuacuauuggacucugguggaacccggugacaaaauuaccuucgaggcuacaggcaaccuagucguuccuagguacgccuuugcaauggaacggaaugcugggagcggaaucauaauuucggauacuccagugcaugacugcaacaccacaugucaaaccccgaagggcgccaucaauacgucucuccccuuccagaacauucacccuaucacuaucgguaaaugcccaaaguauguaaaguccacaaaacugcgccuugcgaccgggcugagaaaugugcccucaauucagaguaggggauuguuuggcgccauagcaggcuucaucgaagggggauggacugguauggucgacggcugguacggguaucaucaccagaacgaacaaggaagcggcuacgcugccgaucucaaguccacacagaaugcuauugacaaaaucaccaacaagguaaauucuguuauagagaaaaugaacacgcaguuuaccgccguggguaaggaguucaaucaccuggaaaagcggauugagaacuuaaauaaaaaggucgaugacggguuccuggauaucuggacauacaacgcagaacuccuugugcuguuggagaaugaacgcacucuagacuaucaugauagcaacgugaaaaaccuguacgagaagguucgaucacagcucaaaaauaacgccaaggagaucggcaauggauguuuugaguucuaucacaagugcgacaacaccuguauggaaagugugaaaaauggcacauacgauuauccuaaguacuccgaagaggcuaaacugaacagagaagagauugacggggucaaacuugagagcacuaggaucuaucaaauucuggcgauauacucuaccguggcaucaaguuugguccucgugguuagccugggagccaucuccuuuuggaugugcucuaaugguucguuacagugccggauuuguaucuga

SEQ ID NO: 133154 - RNA, 1701 nt, Artificial Sequence; identical to SEQ ID NO: 133153
  derived and/or modified sequence opt3 from hemagglutinin__InfluenzaA__AHL80828

SEQ ID NO: 133155 - RNA, 1701 nt, Artificial Sequence
  derived and/or modified sequence opt3 from hemagglutinin__InfluenzaA__AHL80839
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaaggguaucaccgccgcuuguccucaugcaggggccaaaaguuuuuauaagaaucugauauggcucgucaaaaagggaaacagcuacccaaaauuaucucgcuccuauaucaaugacaagggcaaggaagugcugguacuuuggggcauucaccaccccucaacgagcgcugaucaacagaguuuguaccagaacgccgacgcguacguuuucguggggacuucucgauauuccaaaaaguuuaaaccugagaucgcaauucguccaaaggucagagaucaggagggaaggaugaauuacuauuggacccugguggaacccggugacaaaaucacauucgaggccacuggcaaccuaguggucccucgguacgcuuuugccauggaacgcaacgcagggagcggaauaauuaucucggauaccccaguucaugacugcaauacaaccugucaaacgccgaagggcgcuauuaacacuucucuccccuuccagaauauccacccuaucacaauugguaaaugcccaaaguaugugaaguccaccaaacugagacuugccacugggcugaggaacguacccucaauacagagucggggauuguuuggcgcgaucgccggcuucauugaagggggauggacagguaugguggacggcugguacggguaucaucaccagaaugaacaaggaagcggcuacgcagcugaucucaaguccacccagaacgccaucgacaaaauaacgaauaaggucaacucugugauugagaaaaugaauacccaguuuacagcuguugguaaggaguucaaccaccuggaaaagcgcaucgagaauuuaaacaaaaagguggaugacggguuccuggauaucuggacuuacaaugccgaacuccuuguccuguuggagaacgaacgaacccuagacuaucaugauagcaaugugaaaaaccuguacgagaagguaagaucacagcucaaaaacaaugcaaaggagauuggcaacggauguuuugaguucuaucacaagugcgacaauacauguauggaaaguguuaaaaacggcacuuacgauuauccuaaguacuccgaagaggccaaacugaauagggaagagaucgacggggugaaacuugagagcacccggauuuaucaaauacuggcuaucuacucuacagucgcgucaaguuuggugcucgucgugagccugggagcaauuuccuuuuggaugugcucuaacgguucguuacagugccguaucuguaucuga

SEQ ID NO: 133156 - RNA, 1701 nt, Artificial Sequence
  derived and/or modified sequence opt3 from hemagglutinin__InfluenzaA__AHL80861
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugggaauuuaaacaagaaagucgaugacggcuuccuggauaucuggacuuacaaugccgagcuccuugugcuguuggaaaacgagcgcacccuagacuaucaugauagcaauguaaagaaccuguacgaaaaaguucgaucacagcucaagaacaaugcaaaggagaucggaaacggcuguuuugaguucuaucacaaaugcgacaauacauguauggaaagugugaagaacgggacuuacgauuauccuaaauacuccgaggaagccaagcugaauagagaggaaauugacggagucaaacuugagagcaccaggaucuaucaaauucuggcuauauacucuacaguggcgucaaguuugguccucgugguuagccugggugcaaucuccuuuuggaugugcucuaacggcucguuacagugccggauuuguaucuga

SEQ ID NO: 133157 - RNA, 1701 nt, Artificial Sequence
  derived and/or modified sequence opt3 from hemagglutinin__InfluenzaA__AHL80872
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgaacgcugaucaacagagcuuguaccagaaugccgacgcguacguguucgucgggacuucccgcuauucuaagaaauuuaagccugagauugcaauccgaccaaaagugcgugaucaggagggaagaaugaacuacuauuggacccugguggaacccggugacaagauuacauucgaggccacuggcaaccuagucguuccuagguacgcuuuugccauggaacggaaugcaggguccggaaucauaauuagcgauaccccagugcaugacugcaacacaaccugucaaacgccgaaaggcgcuaucaauacuucgcuccccuuccagaacauucacccuaucacaaucgguaagugcccaaaguauguaaaaucuaccaagcugcgccuugccacugggcugagaaaugugcccuccauucagucaaggggauuguuuggcgcgauagccggcuucaucgaagggggauggacagguauggucgacggcugguacggguaucaucaccagaacgaacaaggaaguggcuacgcagcugaucucaaaagcacccagaaugccauugacaagaucacgaacaaagugaauaguguuauagagaagaugaacacccaguuuacagcuguggguaaggaguucaaucaccuggaaaaacggauugagaacuuaaauaagaaagucgaugacggguuccuggauaucuggacuuacaacgccgaacuccuugugcuguuggagaaugaacgcacccuagacuaucaugauucuaacguaaagaaccuguacgagaaaguucgaagccagcucaagaauaacgcaaaggagaucggcaauggauguuuugaguucuaucacaaaugcgacaacacauguauggaaucagugaagaauggcacuuacgauuauccuaaauacagugaagaggccaagcugaacagagaagagauugacggggucaaacuugaguccaccaggaucuaucaaauucuggcuauauacagcacaguggcgucuucauugguccucgugguuagucugggagcaaucagcuuuuggaugugcuccaaugguucuuuacagugccggauuuguaucuga

SEQ ID NO: 133158 - RNA, 1701 nt, Artificial Sequence; identical to SEQ ID NO: 125849
  derived and/or modified sequence opt3 from hemagglutinin__InfluenzaA__AHL80883

SEQ ID NO: 133159 - RNA, 1701 nt, Artificial Sequence; identical to SEQ ID NO: 125849
  derived and/or modified sequence opt3 from hemagglutinin__InfluenzaA__AHL80894

SEQ ID NO: 133160 - RNA, 1701 nt, Artificial Sequence; identical to SEQ ID NO: 125849
  derived and/or modified sequence opt3 from hemagglutinin__InfluenzaA__AHL80905

SEQ ID NO: 133161 - RNA, 1701 nt, Artificial Sequence; identical to SEQ ID NO: 128470
  derived and/or modified sequence opt3 from hemagglutinin__InfluenzaA__AHL80916

SEQ ID NO: 133162 - RNA, 1701 nt, Artificial Sequence; identical to SEQ ID NO: 128871
  derived and/or modified sequence opt3 from hemagglutinin__InfluenzaA__AHL80927

SEQ ID NO: 133163 - RNA, 1701 nt, Artificial Sequence; identical to SEQ ID NO: 128871
  derived and/or modified sequence opt3 from hemagglutinin__InfluenzaA__AHL80946

SEQ ID NO: 133164 - RNA, 1701 nt, Artificial Sequence
  derived and/or modified sequence opt3 from hemagglutinin__InfluenzaA__AHL80958
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagaucagcuccuggcccaaccacgacucaaauaagggugucacagccgcuuguccucaugcaggggccaaaaguuuuuauaagaaccugauauggcucgugaaaaagggaaauagcuacccaaaauuaucuaaguccuauaucaacgauaagggcaaagaaguacugguucuuuggggcauucaccaccccucaaccacggcugaccaacagagcuuguaccagaaugccgaugcguacguguucgucgggacuucucgcuauucuaagaaauuuaagccugagaucgcaauucgaccaaaagugcgugaccaggagggaagaaugaacuacuauuggacccugguggaacccggugauaagaucacauucgaggccacuggcaaccuagucguuccuagguacgcuuuugccauggaacggaaugcaggguccggaauaauuaucagcgacaccucggugcaugauugcaacacaaccugucaaacgccaaaaggcgcuauuaauacuucucucccguuccagaacauccaccccaucacaauugguaagugcccuaaguauguaaaauccaccaagcugcgccuugccacugggcugagaaaugugccaucaauacagaguaggggauuguuuggcgcgaucgccggcuucauugaagggggauggacagguauggucgacggcugguacggguaucaucaccagaacgaacaaggaagcggcuacgcagcugaccucaaauccacccagaaugccaucgauaagauaacgaacaaagugaauaguguuauugagaagaugaacacccaguuuacagcuguggguaaggaguucaaucaccuggaaaaacggaucgagaacuuaaauaagaaagucgacgauggguuccuggacaucuggacuuacaacgccgaacuccuugugcuguuggagaaugaacgcacccuagauuaucaugacagcaacguaaagaaccuguacgagaaaguucgaaaucagcucaagaacaaugcaaaggagauuggcaacggauguuuugaguucuaucacaaaugcgauaauacauguauggaaucagugaagaacggcacuuacgacuaucccaaauacagugaagaggccaagcugaauagagaagagaucgauggggucaaacuugaguccaccaggauuuaucaaauacuggcuaucuacagcacaguggcgucuucauugguccucgugguuagucugggagcaauuagcuuuuggaugugcuccaacgguucuuuacagugccggaucuguaucuga

SEQ ID NO: 133165 - RNA, 1701 nt, Artificial Sequence
  derived and/or modified sequence opt3 from hemagglutinin__InfluenzaA__AHL81001
augaagaccaucauugcccugagcuacauacucugccuuaucuucgcucagaaacugcccggcaacgacaauuccacagcaacuuuguguuuagggcaccaugccgugccuaacggaacgauugucaagaccaucacaaaugaucaaauugagguuacuaacgcgaccgaacuggugcagucuucaaguacaggugagaucugcaauagcccacaccagauacuagacggcgaaaacuguacccucaucgaugcucugcuuggggacccgcagugcgauggauuucaaaauaaaaagugggaccuguucguagagagauccaaagcccauucuaacuguuaucccuacgaugugccugacuaugcaucguugaggucacucgucgccagcaguggcacucuggaauuuaauaacgaguccuucaauuggacaggugugacccagaacgggacgucuagcgcuugcauucggcgcuccaauaacucauuuuucagucgacugaauuggcucacucacuuaaacuuuaaguacccagcacugaacguuaccaugcccaauaacgagcaguucgauaaguuguauaucuggggagugcaucacccuggcacagacaaagaucagauuuuucuuuacgcccaagcugccggccguaucacugucagcaccaagagaucucagcaggcggugauaccaaauauuggguccaggccccggguacgcaacaucccuucaagaguuagcauuuauuggacaaucgugaaaccaggagacauccugcuaauuaauaguaccgguaaccucauagcaccgaggggcuacuucaagauccggucugggaaauccagcauuaugcgcucggaugcccccaucggaaaguguaauucugcuugcauaacgccuaacggcuccauuccaaaugacaagcccuuucagaacgucaaucgaaucacuuacggugccuguccuagauaugugaaacaaaacacacugaaacuugcaaccgggaugaggaaugugccagaaaaacagacucggggaaucuucggcgcuauugccggcuuuaucgagaacgggugggaaggaauggucgacgguugguacggcuuccgucaccaaaauucagaggggcgcggacaggcggccgaucugaagaguacacaggcagcuauugaccagauaaacggcaaauugaacagacucaucgguaagaccaaugagaaauuccaucagauugaaaaggaguuuagcgaaguugaggggaggauccaagaucuggaaaaguauguggaggacacgaaaaucgauuuaugguccuacaacgccgagcugcucguagcucuugaaaaucagcacaccauugaccugacagauucugagaugaacaaguuguucgaaaagacuaagaaacagcuacgggagaaugccgaagacaugggcaacggaugcuuuaagauauaucauaagugugauaaugcaugcaucggcagcauucgaaacgggaccuacgaccacgauguguaucgcgacgaggcccugaauaacagauuccagaucaaaggagucgagcucaagucagguuacaaagacuggauucuguggaucaguuuugcuauauccugcuuccuucuguguguggcguugcucggcuuuaucaugugggcaugccaaaaggggaauauuagguguaacaucugcauuuga

SEQ ID NO: 133166 - RNA, 1701 nt, Artificial Sequence; identical to SEQ ID NO: 128871
  derived and/or modified sequence opt3 from hemagglutinin__InfluenzaA__AHL81013

SEQ ID NO: 133167 - RNA, 1701 nt, Artificial Sequence; identical to SEQ ID NO: 128871
  derived and/or modified sequence opt3 from hemagglutinin__InfluenzaA__AHL81025

SEQ ID NO: 133168 - RNA, 1701 nt, Artificial Sequence; identical to SEQ ID NO: 128871
  derived and/or modified sequence opt3 from hemagglutinin__InfluenzaA__AHL81037

SEQ ID NO: 133169 - RNA, 1701 nt, Artificial Sequence; identical to SEQ ID NO: 128871
  derived and/or modified sequence opt3 from hemagglutinin__InfluenzaA__AHL81049

SEQ ID NO: 133170 - RNA, 1701 nt, Artificial Sequence; identical to SEQ ID NO: 133164
  derived and/or modified sequence opt3 from hemagglutinin__InfluenzaA__AHL81061

SEQ ID NO: 133171 - RNA, 1701 nt, Artificial Sequence; identical to SEQ ID NO: 133164
  derived and/or modified sequence opt3 from hemagglutinin__InfluenzaA__AHL81072

SEQ ID NO: 133172 - RNA, 1701 nt, Artificial Sequence; identical to SEQ ID NO: 130377
  derived and/or modified sequence opt3 from hemagglutinin__InfluenzaA__AHL81083

SEQ ID NO: 133173 - RNA, 1701 nt, Artificial Sequence; identical to SEQ ID NO: 128871
  derived and/or modified sequence opt3 from hemagglutinin__InfluenzaA__AHL81095

SEQ ID NO: 133174 - RNA, 1701 nt, Artificial Sequence
  derived and/or modified sequence opt3 from hemagglutinin__InfluenzaA__AHL81118
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaaacagcuggcccaaucacgacuccaacaagggugucaccgccgcuuguccucaugcaggggccaaaucauuuuauaagaaucugaucuggcucgugaaaaagggaaacaguuacccaaaauuaagcaagucuuauauaaaugauaagggcaaagaaguacugguucuuuggggcauccaccaccccuccacgacugcugaccaacagucauuguaccagaacgccgaugcguacguguucgucgggaccagccgcuauaguaagaaauuuaagccugagauugcaauccgaccaaaagugcgugaccaggagggaagaaugaacuacuauuggacacugguggaacccggugauaagauuacuuucgaggccaccggcaaucuagucguuccuagguacgcuuuugccauggaacggaacgcagggucuggaaucauaauuuccgacacaccagugcaugauugcaauaccacgugucaaacuccgaaaggcgcuaucaacacaagccuccccuuccagaauauucacccuaucaccaucgguaagugcccaaaguauguaaaaucgacuaagcugcgccuugccacagggcugagaaacgugcccucuauucaguccaggggauuguuuggcgcgauagccggcuucaucgaagggggauggaccgguauggucgacggcugguacggguaucaucaccagaaugaacaaggaucaggcuacgcagcugaccucaaaaguacgcagaacgccauugauaagaucaccaauaaagugaacagcguuauagagaagaugaauacacaguuuacugcuguggguaaggaguucaaccaccuggaaaaacggauugagaauuuaaacaagaaagucgacgauggguuccuggacaucuggaccuacaaugccgaacuccuugugcuguuggagaacgaacgcacacuagauuaucaugacuccaacguaaagaaucuguacgagaaaguucgaaaccagcucaagaauaacgcaaaggagaucggcaauggauguuuugaguucuaucacaaaugcgauaacacuuguauggaaucugugaagaauggcaccuacgacuauccuaaauacagcgaagaggccaagcugaacagagaagagauugauggggucaaacuugagucaacaaggaucuaucaaauucuggcuauauacaguaccguggcguccagcuugguccucgugguuucucugggagcaaucucauuuuggaugugcaguaaugguagcuuacagugccggauuuguaucuga

SEQ ID NO: 133175 - RNA, 1701 nt, Artificial Sequence; identical to SEQ ID NO: 128871
  derived and/or modified sequence opt3 from hemagglutinin__InfluenzaA__AHL81129

SEQ ID NO: 133176 - RNA, 1701 nt, Artificial Sequence; identical to SEQ ID NO: 128871
  derived and/or modified sequence opt3 from hemagglutinin__InfluenzaA__AHL81141

SEQ ID NO: 133177 - RNA, 1701 nt, Artificial Sequence; identical to SEQ ID NO: 128871
  derived and/or modified sequence opt3 from hemagglutinin__InfluenzaA__AHL81153

SEQ ID NO: 133178 - RNA, 1701 nt, Artificial Sequence
  derived and/or modified sequence opt3 from hemagglutinin__InfluenzaA__AHL81165
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaagugcuggugagauuugcgacagcccacaccagauccuagauggcgaaaauuguacacucauagacgcccugcuuggggauccgcagugcgacggauuucaaaacaaaaagugggaucuguucguggagagauccagggcauauucuaauuguuaccccuaugacgucccugauuacgccucguugcggucacucguggcuagcaguggcacccuggaauuuaacaaugaguccuucaacuggacugguguuacacagaaugggaccucuagcgcaugcauccgccgauccaacaauucauuuuucagucgucugaacuggcucacgcauuuaaauuuuaaauauccagcccugaacgugacuaugcccaacaaugagcaguucgacaaacuuuacauuuggggaguccaccauccuggcaccgauaaggaccagaucuuuuuguaugcucaagccagcggcagaauuacagugucuacuaaaaggucccagcaggcgguaaucccaaacauagggucacggccccgcguuagaaauauuccuagcaggaucaguauuuacuggaccaucgugaagccaggagauauccugcuaauuaacucuacagguaaucucauagcaccgcggggcuacuucaaaauccgcuccggaaagagcucgauuaugcgaucugacgcccccaucgggaaauguaacuccgaaugcauaaccccuaauggcucaauuccaaacgacaagcccuuucagaaugucaacagaaucacguauggugcuuguccuagguacgugaagcaaaguacucugaaacuugccacagggaugcggaaugugccagagaagcagacccguggaaucuucggcgcaauugcuggcuuuaucgaaaacgggugggagggaaugauggaugguugguauggcuuccgccaccagaauagcgaggggagaggacaagccgcggaccugaaauccacucaggccgcaauugaucagauaaacggcaaguugaauaggcucaucgguaaaacaaacgaaaaguuccaccagauugagaaagaauuuucugaggucgaagggcggauccaagaccuggagaaguacguugaggauaccaagaucgacuuauggagcuauaacgcugaacugcucguggcccuugagaaucagcauacgauugaucugaccgacucagaaaugaacaaauuguucgagaagacaaagaagcagcuacgagaaaaugcugaggauaugggcaacggaugcuuuaaaauauaccacaagugugacaaugccugcaucggcaguauucgcaacgggacuuaugaucaugacguauacagagacgaggcacugaauaacagguuccagaucaagggaguggaacucaaauccgguuacaaggauuggauucuguggaucagcuuugccauaucuugcuuccuucugugugucgcuuugcucggcuuuaucaugugggcgugccaaaaagggaauauucgguguaacaucugcauuuga

SEQ ID NO: 133179 - RNA, 1701 nt, Artificial Sequence; identical to SEQ ID NO: 133178
  derived and/or modified sequence opt3 from hemagglutinin__InfluenzaA__AHL81177

SEQ ID NO: 133180 - RNA, 1701 nt, Artificial Sequence; identical to SEQ ID NO: 133165
  derived and/or modified sequence opt3 from hemagglutinin__InfluenzaA__AHL81189

SEQ ID NO: 133181 - RNA, 1701 nt, Artificial Sequence
  derived and/or modified sequence opt3 from hemagglutinin__InfluenzaA__AHL81212
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaagaaugaguccuucaacuggacagguguuacccagaaugggacgucuagcgcuugcauccggcgcuccaacaauucauuuuucagucgacugaacuggcucacucacuuaaauuuuaaguacccagcacugaacgugaccaugcccaacaaugagcaguucgauaaacuuuauauuuggggaguccaucacccuggcacagacaaggaucagaucuuuuuguacgcccaagcugccggccguauuacugugagcaccaaaagaucucagcaggcgguaaucccaaacauaggguccaggccccggguucgcaauauuccuucaagagugagcaucuauuggacaauugucaagccaggagacauccugcuaaucaacaguaccgguaaucucauugcaccgaggggcuacuucaaaauacggucugggaaguccagcaucaugcgcucggaugcccccauuggaaaguguaacucugcuugcaucacgccuaauggcuccauaccaaacgacaaacccuuucagaaugugaaccgaauuacuuacggugccuguccuagauaugugaagcaaaauacacugaaacuugcaaccgggaugaggaacgucccagaaaagcagacucggggaaucuucggcgcuaucgccggcuuuauugagaaugggugggaaggaaugguugacgguugguacggcuuccgucaccagaacucagaggggcgcggacaagcggccgaucugaaaaguacacaggcagcuaucgaccagauuaauggcaaguugaacagacucauagguaaaaccaacgagaaguuccaucagaucgaaaaggaguuuagcgaaguggaggggaggauucaagaucuggaaaaauauguagaggacacgaagaucgauuuaugguccuacaaugccgagcugcucguggcucuugaaaaccagcacaccaucgaccugacagauucugagaugaauaaauuguucgaaaagacuaaaaagcagcuacgggagaacgccgaagacaugggcaauggaugcuuuaagauuuaucauaaaugugauaacgcaugcauaggcagcauccgaaaugggaccuacgaccacgaugucuaucgcgacgaggcccugaacaauagauuccagauuaagggaguggagcucaaaucagguuacaaggacuggauccuguggauuaguuuugcuaucuccugcuuccuucuguguguugcguugcucggcuuuauaaugugggcaugccaaaaagggaacaucagguguaauauuugcaucuga

SEQ ID NO: 133182 - RNA, 1701 nt, Artificial Sequence
  derived and/or modified sequence opt3 from hemagglutinin__InfluenzaA__AHL81224
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugaucaggaggguagaaugaauuacuauuggacucugguggaacccggcgacaagauuaccuucgaggcaacagggaaccuagucguuccuagguacgccuuugcuauggaacggaccgccggaucuggcaucauaauuuccgauacgccagugcaugacugcaacacuacaugucaaaccccgaaaggugcaaucaauacuagccuccccuuccagaacauucacccuaucacaaucgggaagugcccaaaguauguaaaaucgaccaagcugcgccuugcuacgggacugagaaaugugcccucuauucaguccaggggcuuguuuggcgccauagcgggguucaucgagggagguuggaccggcauggucgacgggugguacggauaucaucaccagaacgaacaaggcucagguuacgccgcagaucucaaaaguacacagaaugcuauugacaagaucacuaacaaagugaauagcguuauagagaagaugaacacccaguuuacagccguggggaaggaguucaaucaccuggaaaaacggauugagaacuuaaauaagaaagucgaugacggcuuccuggauaucuggacuuacaacgcugaacuccuugugcuguuggagaaugaacgcacccuagacuaucaugauuccaacguaaagaaucuguacgagaaaguucgaaaccagcucaagaacaaugccaaggagaucggaaacggcuguuuugaguucuaucacaaaugcgacaauacauguauggagucugugaagaacgggaccuacgauuauccuaaauacagcgaagaggcaaagcugaauagagaagagauugacggagucaaacuugagucaacuaggaucuaucaaauucuggccauauacaguacgguggcuuccagcuugguccucgugguuucucugggugcgaucucauuuuggaugugcaguaacggcagcuuacagugccggauuuguaucuga

SEQ ID NO: 133183 - RNA, 1701 nt, Artificial Sequence; identical to SEQ ID NO: 128871
  derived and/or modified sequence opt3 from hemagglutinin__InfluenzaA__AHL81235

SEQ ID NO: 133184 - RNA, 1701 nt, Artificial Sequence; identical to SEQ ID NO: 128871
  derived and/or modified sequence opt3 from hemagglutinin__InfluenzaA__AHL81247

SEQ ID NO: 133185 - RNA, 1701 nt, Artificial Sequence; identical to SEQ ID NO: 128871
  derived and/or modified sequence opt3 from hemagglutinin__InfluenzaA__AHL81259

SEQ ID NO: 133186 - RNA, 1701 nt, Artificial Sequence; identical to SEQ ID NO: 128871
  derived and/or modified sequence opt3 from hemagglutinin__InfluenzaA__AHL81271

SEQ ID NO: 133187 - RNA, 1701 nt, Artificial Sequence; identical to SEQ ID NO: 128871
  derived and/or modified sequence opt3 from hemagglutinin__InfluenzaA__AHL81283

SEQ ID NO: 133188 - RNA, 1701 nt, Artificial Sequence; identical to SEQ ID NO: 128871
  derived and/or modified sequence opt3 from hemagglutinin__InfluenzaA__AHL81295

SEQ ID NO: 133189 - RNA, 1701 nt, Artificial Sequence; identical to SEQ ID NO: 133164
  derived and/or modified sequence opt3 from hemagglutinin__InfluenzaA__AHL81307

SEQ ID NO: 133190 - RNA, 1701 nt, Artificial Sequence; identical to SEQ ID NO: 128883
  derived and/or modified sequence opt3 from hemagglutinin__InfluenzaA__AHL81329

SEQ ID NO: 133191 - RNA, 1701 nt, Artificial Sequence
  derived and/or modified sequence opt3 from hemagglutinin__InfluenzaA__AHL81340
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccaggacgggacgucuagcgcuugcauccggggauccaaaaauucauuuuucagucgccugaacuggcucacucauuuaaauuuuaaauauccagcacugaacgugaccaugcccaauaacgagcaguucgauaagcuguacauuuggggcguccaccauccuggcacagacaaagaucagaucuuuuuguaugcccaagcuagcgggcgaauuacugugucuaccaagcguucccagcaggccgcgaucccaaacauaggaucaagacccaggguacggaauauuccuagccgcaucaguauuuacuggacaaucguuaaaccaggugacauccugcuaauuaacucuaccggcaaucucauagcaccgagaggguacuucaagaucagguccggaaagagcucgauuaugcggucugacgcccccaucggcaaauguaacuccgagugcauaacgccuaaugguucaauuccaaacgauaagcccuuucagaaugugaaccgcaucacuuauggggcuuguccucgauacgucaaacaaaauacacugaaacuugccaccggaaugagaaacgugccagaaaagcagacuaggggcaucuucggcgcaauugcuggguuuaucgagaauggaugggaagguaugguggacggcugguauggguuccggcaccagaacagugagggacguggccaagccgcggaucuuaagagcacacaggccgcaauugaccagauaaaugguaaauugaaccgccucaucgggaagaccaaugagaaguuccaccagauugaaaaagaguuuuccgaagucgagggcagaauccaagaucuggaaaaguacguugaggacacgaaaaucgauuuauggucuuauaacgcugagcugcucguggcccuugaaaaccagcauaccauugaccugacagauagcgagaugaauaaguuguucgaaaagacuaagaagcagcuaagggagaacgcugaagacaugggaaauggcugcuuuaaaauauaccacaagugugauaacgccugcaucgggucaauucggaauggaaccuauaaccaugacguauaccgagacgaggcacugaauaaacgcuuccagaucaaggguauugagcucaaaaguggcuacaaggauuggauccuguggauauccuuugccaucagcugcuuccuucuguguguggcuuugcucggguuuauuaugugggcgugccaaaagggaaacaucagauguaauauuugcaucuga

SEQ ID NO: 133192 - RNA, 1701 nt, Artificial Sequence; identical to SEQ ID NO: 128871
  derived and/or modified sequence opt3 from hemagglutinin__InfluenzaA__AHL81352

SEQ ID NO: 133193 - RNA, 1701 nt, Artificial Sequence
  derived and/or modified sequence opt3 from hemagglutinin__InfluenzaA__AHL81364
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggagccugcuauccaggcgauuuuaucaauuacgaggagcucagggagcagcugagcaguguguccucuuucgaacgguuugagauuuucccgaagacuaacagcuggcccaaucacgacuccaacaagggugucacagcugcauguccucaugccggggcuaaaucauuuuauaagaaucugaucuggcucgugaaaaagggaaacaguuacccaaaauuaagcaagucuuauauaaaugauaagggcaaagaaguacugguucuuuggggcauccaccaccccuccaccacggccgaccaacagucauuguaccagaacgcggaugcauacguguucgucgggacuagccgcuauaguaagaaauuuaagccugagauugccauccgaccaaaagugcgugaccaggagggaagaaugaacuacuauuggacccugguggaacccggugauaagauuacauucgaggcuacuggcaaucuagucguuccuagguacgccuuugcaauggaacggaacgcugggucuggaaucauaauuuccgacaccccagugcaugauugcaauacaaccugucaaacgccgaaaggcgccaucaacacuagccuccccuuccagaauauucacccuaucacaaucgguaagugcccaaaguauguaaaaucgaccaagcugcgccuugcgacugggcugagaaacgugcccucuauucaguccaggggauuguuuggcgccauagcaggcuucaucgaagggggauggacagguauggucgacggcugguacggguaucaucaccagaaugaacaaggaucaggcuacgcugccgaccucaaaaguacccagaacgcuauugauaagaucacgaauaaagugaacagcguuauagagaagaugaauacccaguuuacagccguggguaaggaguucaaccaccuggaaaaacggauugagaauuuaaacaagaaagucgacgauggguuccuggacaucuggacuuacaaugcagaacuccuugugcuguuggagaacgaacgcacccuagauuaucaugacuccaacguaaagaaucuguacgagaaaguucgaaaccagcucaagaauaacgccaaggagaucggcaauggauguuuugaguucuaucacaaaugcgauaacacauguauggaaucugugaagaauggcacuuacgacuauccuaaauacagcgaagaggcuaagcugaacagagaagagauugauggggucaaacuugagucaaccaggaucuaucaaauucuggcgauauacaguacaguggcauccagcuugguccucgugguuucucugggagccaucucauuuuggaugugcaguaaugguagcuuacagugccggauuuguaucuga

SEQ ID NO: 133194 - RNA, 1701 nt, Artificial Sequence
  derived and/or modified sequence opt3 from hemagglutinin__InfluenzaA__AHL81386
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaaacagcuggcccaaucacgacuccaacaagggugucaccgccgcuuguccucaugcaggggugaaaucauuuuauaagaaucugaucuggcucguuaaaaagggaaacaguuacccaaaauuaagcaagucuuauauaaaugauaagggcaaagaaguacuggugcuuuggggcauccaccaccccuccacgacugccgaccaacagucauuguaccagaacgcugaugccuacgucuucguggggaccagccgcuauaguaagaaauuuaagccugagauugcgauccgaccaaaagugcgugaccaggagggaagaaugaacuacuauuggacacuggucgaacccggugauaagauuacuuucgaggcaaccggcaaucuaguugugccuagguacgccuuugcuauggaacggaacgccgggucuggaaucauaauuuccgacacaccaguacaugauugcaauaccacgugucaaacuccgaaaggcgcaaucaacacaagccuccccuuccagaauauucacccuaucaccaucgguaagugcccaaaguaugugaaaucgacuaagcugcgccuugcuacagggcugagaaacguccccucuauucaguccaggggauuguuuggcgccauagcgggcuucaucgaagggggauggaccgguaugguggacggcugguacggguaucaucaccagaaugaacaaggaucaggcuacgccgcagaccucaaaaguacgcagaacgcuauugauaagaucaccaauaaaguuaacagcgugauagagaagaugaauacacaguuuacugccgucgguaaggaguucaaccaccuggaaaaacggauugagaauuuaaacaagaaaguggacgauggguuccuggacaucuggaccuacaaugcugaacuccuuguacuguuggagaacgaacgcacacuagauuaucaugacuccaacguuaagaaucuguacgagaaagugcgaaaccagcucaagaauaacgccaaggagaucggcaauggauguuuugaguucuaucacaaaugcgauaacacuuguauggaaucugucaagaauggcaccuacgacuauccuaaauacagcgaagaggcaaagcugaacagagaagagauugauggggugaaacuugagucaacaaggaucuaucaaauucuggccauauacaguaccgucgcuuccagcuuggugcucguugugucucugggagcgaucucauuuuggaugugcaguaaugguagcuuacagugccggauuuguaucuga

SEQ ID NO: 133195 - RNA, 1701 nt, Artificial Sequence; identical to SEQ ID NO: 128871
  derived and/or modified sequence opt3 from hemagglutinin__InfluenzaA__AHL81397

SEQ ID NO: 133196 - RNA, 1701 nt, Artificial Sequence; identical to SEQ ID NO: 133181
  derived and/or modified sequence opt3 from hemagglutinin__InfluenzaA__AHL81409

SEQ ID NO: 133197 - RNA, 1701 nt, Artificial Sequence; identical to SEQ ID NO: 133151
  derived and/or modified sequence opt3 from hemagglutinin__InfluenzaA__AHL81419

SEQ ID NO: 133198 - RNA, 1701 nt, Artificial Sequence; identical to SEQ ID NO: 125849
  derived and/or modified sequence opt3 from hemagglutinin__InfluenzaA__AHL81430

SEQ ID NO: 133199 - RNA, 1701 nt, Artificial Sequence; identical to SEQ ID NO: 122646
  derived and/or modified sequence opt3 from hemagglutinin__InfluenzaA__AHL88951

SEQ ID NO: 133200 - RNA, 1701 nt, Artificial Sequence; identical to SEQ ID NO: 122646
  derived and/or modified sequence opt3 from hemagglutinin__InfluenzaA__AHL89030

SEQ ID NO: 133201 - RNA, 1701 nt, Artificial Sequence
  derived and/or modified sequence opt3 from hemagglutinin__InfluenzaA__AHL89042
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugagaacuucaauuggacagguguuacccagaacgggacguccucugcuugcaagcggcgcagcaauaacuccuuuuucucacgacugaauuggcucacucauuuaaaguuuaaauauccagcacugaacgugaccaugcccaacaaugagaaguucgacaaacuuuacaucuggggaguccaccauccuggcacagauaacgaccagauuuuucuuuaugcccaggcuaguggccguaucacugugagcaccaagagaucucaacagacaguaauuccaaauaucggguccaggccccggguucgcaacauaccuucaagaauuagcaucuacuggaccauugugaaaccaggagauauccugcuaaucaauaguacggguaaccucauugccccgaggggcuacuucaagauacggucugggaaguccagcaucaugcgcucggacgcgcccauuggaaaauguaauucugaaugcaucacuccuaacggcuccauaccaaaugacaagcccuuucagaacgucaaucgaauuacauauggugcauguccuagauacgugaaacagaacacccugaaguuggccacugggaugaggaaugugccagagaaacaaacacggggaaucuucggcgcuaucgccggcuuuauugaaaacgggugggagggaauggucgaugguugguauggcuuccgucaccaaaauucagaggggaucggacaggcagcugaccugaagaguacccaggccgcgauuaaccagauaaacggcaaauugaaucgccucaucgguaagacgaacgaaaaguuccaccagauugagaaagaauuuagcgagguugaagggagaauccaggaucuggagaaguacguggaggacaccaaaaucgauuuaugguccuauaaugccgaacugcucguagcacuugagaaccaacauacaauugaccugacugauucugaaaugaauaaguuguucgagaggaccaaaaagcagcuacgggaaaacgcugaggacaugggcaauggaugcuuuaagauauaccacaaaugugauaacgccugcaucggcagcauucgaaaugggacauaugaccaugauguguaccgcgacgaggcucugaacaauagauuccagaucaagggagucgaacucaaaucagguuacaaggacuggauucuguggaucaguuuugccauauccugcuuccuucuguguguggcauugguuggcuuuaucaugugggccugccagaaagggaacauuagguguaauaucugcauuuga

SEQ ID NO: 133202 - RNA, 1701 nt, Artificial Sequence
  derived and/or modified sequence opt3 from hemagglutinin__InfluenzaA__AHL89054
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagaucuuuuuguaugcccaggcuagcgggcguauuacugugucuaccaagagaucccaacagacaguaauuccaaacaucggaucaaggccccggguucgcaauauaccuagcagaauuaguaucuacuggaccauugugaaaccaggugauauccugcuaaucaacucuacgggcaaucucauugccccgaggggguacuucaagauacgguccggaaagagcucgaucaugcgcucugacgcgcccauuggcaaauguaacuccgagugcaucacuccuaaugguucaauaccaaacgacaagcccuuucagaaugucaaccgaauuacauauggggcauguccuagauacgugaaacagaauacccugaagcuggccacuggaaugaggaacgugccagaaaaacaaacacggggcaucuucggcgcuaucgccggguuuauugagaauggaugggaagguauggucgauggcugguauggguuccgucaccagaacagugagggaaucggccaggcagcugaccuuaagagcacccaagccgcgauuaaucagauaaacgguaaauugaaccgccucaucgggaagacgaaugagaaguuccaccagauugaaaaagaguuuuccgaaguugagggcagaauccaggaucuggaaaaguacguggaggacaccaaaaucgauuuauggucuuauaacgccgagcugcucguagcacuugaaaaucaacauacaauugaccugacugauagcgagaugaacaaguuguucgaaaggaccaaaaagcagcuacgggagaaugcugaagacaugggaaacggcugcuuuaagauauaccacaaaugugauaaugccugcaucgggucaauucgaaacggaacauaugaccaugauguguaccgcgacgaggcucugaauaacagauuccagaucaagggugucgagcucaaaaguggcuacaaggacuggauucuguggaucuccuuugccaugagcugcuuccuucuguguguggcauugcucggguuuauaaugugggccugccagaaaggaaauaucagguguaacauuugcaucuga

SEQ ID NO: 133203 - RNA, 1701 nt, Artificial Sequence; identical to SEQ ID NO: 123597
  derived and/or modified sequence opt3 from hemagglutinin__InfluenzaA__AHL89066

SEQ ID NO: 133204 - RNA, 1701 nt, Artificial Sequence
  derived and/or modified sequence opt3 from hemagglutinin__InfluenzaA__AHL89078
augaagaccaucauugcccugagcuacauacucugccuuguguucgcucagaaacugcccggcgacgauaacuccacagcaacuuuguguuuagggcaccaugccgucccuaauggaacgguugugaagaccaucacaaacgaccaaauugagguaacuaaugcgaccgaacuggugcagucuucaaguacagguggcaucugcgauagcccacaccagauucuagacggggagaacuguacccucaucgaugcucugcuuggagacccgcagugcgauggcuuucaaaauaaaaagugggaccuguucgucgaaagauccaaagccuauucuaacuguuaccccuaugaugugccugacuacgcaucguugaggucacucguugccagcagugguacucuggaguuuaauaacgaauccuucaauuggacaggggugacccagaacggaacgucuagcgcuugcaagcggcgcuccaauaacucauuuuucagucgacugaauuggcucacucauuuaaaguuuaaauauccagcacugaacgucaccaugcccaauaacgagaaguucgauaaacuuuacauauggggcgugcaccauccuggcacagacaacgaucagaucuuuuuguaugcccaggcuagcgggcguauuacuguaucuaccaagagaucccaacagacaguuaucccaaauauuggaucaaggccccgggugcgcaacaucccuagcagaauaaguauuuacuggaccaucgucaaaccaggugacauucugcuaaucaauucuacgggcaaccucaucgccccgaggggguacuucaagauucgguccggaaagagcucgauaaugcgcucugacgcgcccaucggcaaauguaauuccgagugcauuacuccuaacgguucaaucccaaaugauaagcccuuucagaacgugaaucgaauaacauauggggcauguccuagauacgugaaacagaacacccugaagcuggccacuggaaugaggaaugucccagaaaaacaaacacggggcauuuucggcgcuaucgccggguuuaucgagaacggaugggaagguaugguugacggcugguauggguuccgucaccagaauagugagggaauuggccaggcagcugaucuuaagagcacccaagccgcgaucaaccagauuaaugguaaauugaaccgccucauagggaagacgaacgagaaguuccaccagaucgaaaaagaguuuuccgaaguggagggcaggauucaggaccuggaaaaguacguagaggauaccaaaaucgacuuauggucuuauaaugccgagcugcucguggcacuugaaaaccaacauacaaucgaucugacugacagcgagaugaauaaguuguucgaaagaaccaaaaagcagcuacgggagaacgcugaagauaugggaaauggcugcuuuaagauuuaccacaaaugugacaacgccugcauagggucaauccgaaauggaacauaugaucaugacgucuaccgcgacgaggcucugaacaauagauuccagauuaaggguguggagcucaaaaguggcuacaaggauuggauccuguggauuuccuuugccaucagcugcuuccuucuguguguugcauugcucggguuuauaaugugggccugccagaaaggaaacaucagguguaauauuugcaucuga

SEQ ID NO: 133205 - RNA, 1701 nt, Artificial Sequence
  derived and/or modified sequence opt3 from hemagglutinin__InfluenzaA__AHL89090
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccauaucagauccuagauggggagaauuguacccucauagacgcucugcuuggagauccgcagugcgacggcuuucaaaacaaaaagugggaucuguucguggaaagauccaaagccuacucuaauuguuaucccuacgacgucccugauuaugcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucacuuaaaguuuaaauacccagcacugaaugugaccaugcccaacaacgagaaguucgacaaacuuuauaucuggggcguccaucacccuggcacagauaaugaccagaucuuuuuguacgcccaggcuagcgggcguauuacugugucuaccaagagaucccaacagacaguaauuccaaacaucggaucaaggccccggguucgcaauauaccuagcagaauuaguaucuacuggaccauugugaaaccaggugauauccugcuaaucaacucuacgggcaaucucauugccccgaggggguauuucaagauacgguccggaaagagcucgaucaugcgcucugacgcgcccauuggcaaauguaacuccgagugcaucacuccuaaugguucaauaccaaacgacaagcccuuucagaaugucaaccgaauuacauacggggcauguccuagauaugugaaacagaauacccugaagcuggccacuggaaugaggaacgugccagaaaaacaaacacggggcaucuucggcgcuaucgccggguuuauugagaauggaugggaagguauggucgauggcugguacggguuccgucaucagaacagugagggaaucggccaggcagcugaccuuaagagcacccaagccgcgauuaaucagauaaacgguaaauugaaccgccucaucgggaagacgaaugagaaguuccaccagauugaaaaagaguuuuccgaaguugagggcagaauccaggaucuggaaaaguauguggaggacaccaaaaucgauuuauggucuuacaacgccgagcugcucguagcacuugaaaaucaacacacaauugaccugacugauagcgagaugaacaaguuguucgaaaggaccaaaaagcagcuacgggagaaugcugaagacaugggaaacggcugcuuuaagauauaucauaaaugugauaaugccugcaucgggucaauucgaaacggaacauacgaccacgauguguaccgcgacgaggcucugaauaacagauuccagaucaagggugucgagcucaaaaguggcuauaaggacuggauucuguggaucuccuuugccauaagcugcuuccuucuguguguggcauugcucggguuuaucaugugggccugccagaaaggaaauauuagguguaacaucugcauuuga

SEQ ID NO: 133206 - RNA, 1701 nt, Artificial Sequence; identical to SEQ ID NO: 122646
  derived and/or modified sequence opt3 from hemagglutinin__InfluenzaA__AHL89102

SEQ ID NO: 133207 - RNA, 1701 nt, Artificial Sequence; identical to SEQ ID NO: 122646
  derived and/or modified sequence opt3 from hemagglutinin__InfluenzaA__AHL89114

SEQ ID NO: 133208 - RNA, 1701 nt, Artificial Sequence
  derived and/or modified sequence opt3 from hemagglutinin__InfluenzaA__AHL89126
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaaaacuucaauuggacagggguuacccagaacggaacguccucugcuugcaagcggcgcagcaauaacuccuuuuucucacgacugaauuggcucacucauuuaaaguuuaaauauccagcacugaacgugaccaugcccaacaaugagaaguucgacaaacuuuacaucuggggcguccaccauccuggcacagauaacgaccagauuuuucuuuaugcccaggcuagugggcguaucacugugagcaccaagagaucucaacagacaguaauuccaaauaucggauccaggccccggguucgcaacauaccuucaagaauuagcaucuacuggaccauugugaaaccaggugauauccugcuaaucaauaguacgggcaaccucauugccccgaggggguacuucaagauacggucuggaaaguccagcaucaugcgcucggacgcgcccauuggcaaauguaauucugagugcaucacuccuaacgguuccauaccaaaugacaagcccuuucagaacgucaaucgaauuacauauggggcauguccuagauacgugaaacagaacacccugaaguuggccacuggaaugaggaaugugccagaaaaacaaacacggggcaucuucggcgcuaucgccggguuuauugagaacggaugggaagguauggucgauggcugguauggguuccgucaccaaaauucagagggaaucggccaggcagcugaccugaagaguacccaggccgcgauuaaccagauaaacgguaaauugaaucgccucaucgggaagacgaacgagaaguuccaccagauugaaaaagaguuuagcgaaguugagggcagaauccaggaucuggaaaaguacguggaggacaccaaaaucgauuuaugguccuauaaugccgagcugcucguagcacuugaaaaccaacauacaauugaccugacugauucugagaugaauaaguuguucgaaaggaccaaaaagcagcuacgggagaacgcugaagacaugggaaauggcugcuuuaagauauaccacaaaugugauaacgccugcaucgggagcauucgaaauggaacauaugaccaugauguguaccgcgacgaggcucugaacaauagauuccagaucaagggugucgagcucaaaucaggcuacaaggacuggauucuguggaucaguuuugccauauccugcuuccuucuguguguggcauugcucggguuuaucaugugggccugccagaaaggaaacauuagguguaauaucugcauuuga

SEQ ID NO: 133209 - RNA, 1701 nt, Artificial Sequence
  derived and/or modified sequence opt3 from hemagglutinin__InfluenzaA__AHL89138
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggaguccaccauccuggcacagauaaugaccagauuuuucuuuaugcccagagcucuggccguaucacuguguccaccaagagaucacaacagacaguaauuccaaacaucgggagcaggccccggguucgcaauauaccuaguagaauuucuaucuacuggaccauugugaaaccaggagauauccugcuaaucaacuccacggguaaucucauugcuccgaggggcuacuucaagauacggagcgggaagucgucuaucaugcgcuccgacgcccccauuggaaaauguaacucagaaugcaucacuccuaauggcaguauaccaaacgacaagcccuuucagaaugucaaccgaauuacauauggugcguguccuagauacgugaaacagaauacccugaaguuggcaacugggaugaggaacgugccagagaaacaaacacggggaaucuucggcgccaucgcuggcuuuauugaaaaugggugggagggaauggucgaugguugguauggcuuccgucaccagaacagcgaggggaucggacaggccgcagaccugaaguccacccaagcugccauuaaucagauaaacggcaaauugaaccgccucaucgguaagacgaaugaaaaguuccaccagauugagaaagaauuuucugagguugaagggagaauccaggaucuggagaaguacguggaggacaccaaaaucgauuuauggagcuauaacgcggaacugcucguagcccuugagaaucaacauacaauugaccugacugauucagaaaugaacaaguuguucgagaggaccaaaaagcagcuacgggaaaaugcagaggacaugggcaacggaugcuuuaagauauaccacaaaugugauaaugcuugcaucggcaguauucgaaacgggacauaugaccaugauguguaccgcgacgaggcccugaauaacagauuccagaucaagggagucgaacucaaauccgguuacaaggacuggauucuguggaucagcuuugcuauaucuugcuuccuucuguguguggccuugcucggcuuuaucaugugggcaugccagaaagggaauauuagguguaacaucugcauuuga

SEQ ID NO: 133210 - RNA, 1701 nt, Artificial Sequence
  derived and/or modified sequence opt3 from hemagglutinin__InfluenzaA__AHL89150
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagaucuuuuuguaugcccaggcuagcgggcguauuacugugucuaccaagagaucccaacagacaguaauuccaaacaucggaucaaggccccggguucgcaauauaccuagcagaauuaguaucuacuggaccauugugaaaccaggugauauccugcuaaucaacucuacgggcaaucucauugccccgaggggguacuucaagauacgguccggaaagagcucgaucaugcgcucugacgcgcccauuggcaaauguaacuccgagugcaucacuccuaaugguucaauaccaaacgacaagcccuuucagaaugucaaccgaauuacauauggggcauguccuagauacgugaaacagaauacccugaagcuggccacuggaaugaggaacgugccagaaaaacaaacacggggcaucuucggcgcuaucgccggguuuauugagaauggaugggaagguauggucgauggcugguauggguuccgucaccagaacagugagggaaucggccaggcagcugaccuuaagagcacccaagccgcgauuaaucagauaaacgguaaauugaaccgccucaucgggaagacgaaugagaaguuccaccagauugaaaaagaguuuuccgaaguugagggcagaauccaggaucuggaaaaguacguggaggacaccaaaaucgauuuauggucuuauaacgccgagcugcucguagcacuugaaaaucaacauacaauugaccugacugauagcgagaugaacaaguuguucgaaaggaccaaaaagcagcuacgggagaaugcugaagacaugggaaacggcugcuuuaagauauaccacaaaugugauaaugccugcaucgggucaauucgaaacggaacauaugaccaugauguguaccgcgacgaggcucugaauaacagauuccagaucaagggugucgagcucaaaaguggcuacaaggacuggauucuguggaucuccuuugccauaagcugcuuccuucuguguguggcauugcucguuuuuaucaugugggccugccagaaagggaauauuagguguaacaucugcauuuga

SEQ ID NO: 133211 - RNA, 1701 nt, Artificial Sequence
  derived and/or modified sequence opt3 from hemagglutinin__InfluenzaA__AHL89162
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagaucuuuuuguaugcccaggcuagcgggcguauuacugugucuaccaagagaucccaacagacaguaauuccaaacaucggaucaaggccccggguucgcaauauaccuagcagaauuaguaucuacuggaccauugugaaaccaggugauauccugcuaaucaacucuacgggcaaucucauugccccgaggggguacuucaagauacgguccggaaagagcucgaucaugcgcucugacgcgcccauuggcaaauguaacuccgagugcaucacuccuaaugguucaauaccaaacgacaagcccuuucagaaugucaaccgaauuacauauggggcauguccuagauacgugaaacagaauacccugaagcuggccacuggaaugaggaacgugccagaaaaacaaacacggggcaucuucggcgcuaucgccggguuuauugagaauggaugggaagguauggucgauggcugguauggguuccgucaccagaacagugagggaaccggccaggcagcugaccuuaagagcacgcaagccgcgaccaaucagaucaacgguaaauugaaccgccucauugggaagacaaaugagaaguuccaccagauagaaaaagaguuuuccgaaguugagggcagaauccaggaucuggaaaaguacguggaggacacuaaaauugauuuauggucuuauaacgccgagcugcucguagcacuugaaaaucaacauaccaucgaccugacagauagcgagaugaacaaguuguucgaaaggacuaaaaagcagcuacgggagaaugcugaagacaugggaaacggcugcuuuaagaucuaccacaaaugugauaaugccugcauugggucaauacgaaacggaaccuaugaccaugauguguaccgcgacgaggcucugaauaacagauuccagaucaagggugucgagcucaaaaguggcuacaaggacuggauucuguggaucuccuuugccauuagcugcuuccuucuguguguggcauugcucggguuuaucaugugggccugccagaaaggaaauauaagguguaacaucugcauuuga

SEQ ID NO: 133212 - RNA, 1701 nt, Artificial Sequence
  derived and/or modified sequence opt3 from hemagglutinin__InfluenzaA__AHL89174
augaagaccaucauugcccugagcuacacacucugccuuguguucgcucagaaacugcccggcaacgacaauuccacugcaacguuguguuuagggcaccaugccgucccuaacggaaccauaguuaagacaaucacuaaugaucaaauugaggugaccaacgcgacagaacugguacagucuucaaguaccgguggcaucugcgacagcccacaccagauucuagauggggagaauuguacucucaucgacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacacuggaguuuaacaaugaauccuucaacuggaccgggguuacgcagaauggaacuucuagcgcuugcaagcggcgcuccaacaauucauuuuucagucgacugaacuggcucacccauuuaaaguuuaaauauccagcacugaaugugacaaugcccaacaacgagaaguucgacaaacuuuacauauggggcguccaccauccuggcacugauaaugaccagaucuuuuuguaugcccaggcuagcgggcguauuaccgugucuacaaagagaucccaacagaccguaaucccaaacauuggaucaaggccccggguucgcaauaucccuagcagaauaaguauuuacuggacgaucgugaaaccaggugauauucugcuaaucaacucuacuggcaaucucaucgccccgaggggguacuucaagauucgguccggaaagagcucgauaaugcgcucugacgcgcccaucggcaaauguaacuccgagugcauuacaccuaaugguucaaucccaaacgacaagcccuuucagaaugucaaccgaauaaccuauggggcauguccuagauacgugaaacagaauacucugaagcuggccacaggaaugaggaacgugccagaaaaacaaacccggggcauuuucggcgcuaucgccggguuuaucgagaauggaugggaagguauggucgauggcugguauggguuccgucaccagaacagugagggaauuggccaggcagcugaccuuaagagcacgcaagccgcgaucaaucagauuaacgguaaauugaaccgccucauagggaagaccaaugagaaguuccaccagaucgaaaaagaguuuuccgaaguugagggcaggauucaggaucuggaaaaguacguggaggacacaaaaaucgauuuauggucuuauaacgccgagcugcucguagcacuugaaaaucaacauacuaucgaccugaccgauagcgagaugaacaaguuguucgaaagaacuaaaaagcagcuacgggagaaugcugaagacaugggaaacggcugcuuuaagauuuaccacaaaugugauaaugccugcauagggucaauccgaaacggaacauaugaccaugauguguaccgcgacgaggcucugaauaacagauuccagauuaagggugucgagcucaaaaguggcuacaaggacuggauccuguggauuuccuuugccaucagcugcuuccuucuguguguggcauugcucggguuuauaaugugggccugccagaaaggaaauaucagguguaacauuugcaucuga

SEQ ID NO: 133213 - RNA, 1701 nt, Artificial Sequence
  derived and/or modified sequence opt3 from hemagglutinin__InfluenzaA__AHL89210
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggaguccaccauccuggcacagauaaugaccagaucuuuuuguaugcccaggcuagcggccguauuacugugucuaccaagagaucccaacagacaguaauuccaaacaucgggucaaggccccggguucgcaauauaccuagcagaauuaguaucuacuggaccauugugaaaccaggagauauccugcuaaucaacucuacggguaaucucauugccccgaggggcuacuucaagauacgguccggaaagagcucgaucaugcgcucugacgcgcccauugggaaauguaacuccgaaugcaucacuccuaauggcucaauaccaaacgacaagcccuuucagaaugucaaccgaauuacauauggugcauguccuagauacgugaaacagaauacccugaagcuggccacugggaugaggaacgugccagagaaacaaacacggggaaucuucggcgcuaucgccggcuuuauugaaaaugggugggagggaauggucgaugguugguauggcuuccgucaccagaacagugaggggaucggacaggcagcugaccuuaagagcacccaagccgcgauuaaucagauaaacggcaaauugaaccgccucaucgguaagacgaaugaaaaguuccaccagauugagaaagaauuuuccgagguugaagggagaauccaggaucuggagaaguacguggaggacaccaaaaucgauuuauggucuuauaacgccgaacugcucguagcacuugagaaucaacauacaauugaccugacugauagcgaaaugaacaaguuguucgagaggaccaaaaagcagcuacgggaaaaugcugaggacaugggcaacggaugcuuuaagauauaccacaaaugugauaaugccugcaucggcucaauucgaaacgggacauaugaccaugauguguaccgcgacgaggcucugaauaacagauuccagaucaagggagucgaacucaaaagugguuacaaggacuggauucuguggaucuccuuugccauaagcugcuuccuucuguguguggcauugcucggcuuuaucaugugggccugccagaaagggaauauuagguguaacaucugcauuuga

SEQ ID NO: 133214 - RNA, 1701 nt, Artificial Sequence; identical to SEQ ID NO: 133213
  derived and/or modified sequence opt3 from hemagglutinin__InfluenzaA__AHL89222

SEQ ID NO: 133215 - RNA, 1701 nt, Artificial Sequence
  derived and/or modified sequence opt3 from hemagglutinin__InfluenzaA__AHL89234
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggaguccaccauccuggcacagauaaugaccagaucuuuuuguaugcccaggcuagcggccguauuacugugucuaccaagagaucccaacagacaguaauuccaaacaucgggucaaggccccggguucgcaauauaccuagcagaauuaguaucuacuggaccauugugaaaccaggagauauccugcuaaucaacucuacggguaaucucauugccccgaggggcuacuucaagauacgguccggaaagagcucgaucaugcgcucugacgcgcccauugggaaauguaacuccgaaugcaucacuccuaauggcucaauaccaaacgacaagcccuuucagaaugucaaccgaauuacauauggugcauguccuagauacgugaaacagaauacccugaagcuggccacugggaugaggaacgugccagagaaacaaacacggggaaucuucggcgcuaucgccggcuuuauugaaaaugggugggagggaauggucgaugguugguauggcuuccgucaccagaacagugaggggaugggacaggcagcugaccuuaagagcacccaagccgcgaucaaucagauuaacggcaaauugaaccgccucauagguaagacgaaugaaaaguuccaccagaucgagaaagaauuuuccgagguugaagggaggauucaggaucuggagaaguacguggaggacaccaaaaucgauuuauggucuuauaacgccgaacugcucguagcacuugagaaucaacauacaaucgaccugacugauagcgaaaugaacaaguuguucgagagaaccaaaaagcagcuacgggaaaaugcugaggacaugggcaacggaugcuuuaagauuuaccacaaaugugauaaugccugcauaggcucaauccgaaacgggacauaugaccaugauguguaccgcgacgaggcucugaauaacagauuccagauuaagggagucgaacucaaaagugguuacaaggacuggauccuguggauuuccuuugccaucagcugcuuccuucuguguguggcauugcucggcuuuauaaugugggccugccagaaagggaauaucagguguaacauuugcaucuga

SEQ ID NO: 133216 - RNA, 1701 nt, Artificial Sequence
  derived and/or modified sequence opt3 from hemagglutinin__InfluenzaA__AHL89246
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggaguccaccauccuggcacagauaaugaccagaucuuuuuguaugcccaggcuagcggccguauuacugugucuaccaagagaucccaacagacaguaauuccaaacaucgggucaaggccccggguucgcaauauaccuagcagaauuaguaucuacuggaccauugugaaaccaggagauauccugcuaaucaacucuacggguaaucucauugccccgaggggcuacuucaagauacgguccggaaagagcucgaucaugcgcucugacgcgcccauugggaaauguaacuccgaaugcaucacuccuaauggcucaauaccaaacgacaagcccuuucagaaugucaaccgaauuacauauggugcauguccuagauacgugaaacagaauacccugaagcuggccacugggaugaggaacgugccagagaaacaaacacggggaaucuucggcgcuaucgccggcuuuauugaaaaugggugggagggaauggucgaugguugguauggcuuccgucaccagaacagugaggggaucggacaggcagcugaccuuaagagcacccaagccgcgauuaaucagauaaacggcaaauugaaccgccucaucgguaagacgaaugaaaaguuccaccagauugagaaagaauuuuccgagguugaagggagaauccaggaucuggagaaguacguggaggacaccaaaaucgauuuauggucuuauaacgccgaacugcucguagcacuugagaaucaacauacaauugaccugacugauagcgaaaugaacaaguuguucgagaggaccaaaaagcagcuacgggaaaaugcugaggacaugggcaacggaugcuuuaagauauaccacaaauguggcaaugccugcaucgggucaauucgaaacggaacauaugaucaugacguguaccgcgaugaggcucugaauaacagauuccagaucaagggugucgaacucaaaaguggcuacaaggacuggauucuguggaucuccuuugccauaagcugcuuccuucuguguguggcauugcucggguuuaucaugugggccugccagaaaggaaauauuagguguaacaucugcauuuga

SEQ ID NO: 133217 - RNA, 1701 nt, Artificial Sequence
  derived and/or modified sequence opt3 from hemagglutinin__InfluenzaA__AHL89258
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcaagcggcgcuccaacaauucauuuuucagucgacugaacuggcucacucauuuaaaguuuaaauaucaggcacugaaugugaccaugccaaacaacgagaaguucgacaaacuuuacaucuggggaguccaccaucccggcacagauaaugaccagaucuuuuuguaugcccaagcuagcggccguauuacugugucuaccaagagaucccagcagacaguaauuccuaacaucgggucaaggccacggguucgcaauauacccagcagaauuaguaucuacuggaccauugugaaaccuggagauauccugcuaaucaacucuacggguaaucucauugccccaaggggcuacuucaagauacgguccggaaagagcucgaucaugcgcucugacgcgccgauugggaaauguaacuccgaaugcaucacucccaauggcucaauaccuaacgacaagccauuucagaaugucaaccgaauuacauauggugcaugucccagauacgugaaacaaaauacccugaagcuggccacugggaugaggaacgugccugagaaacagacacggggaaucuucggcgcuaucgccggcuuuauugaaaaugggugggagggaauggucgaugguugguauggcuuccgucaccagaacagugaggggaucggacaagcagcugaccuuaagagcacccaggccgcgauuaaucagauaaacggcaaauugaaccgccucaucgguaagacgaaugaaaaguuccaccagauugagaaagaauuuuccgagguugaagggagaauccaagaucuggagaaguacguggaggacaccaaaaucgauuuauggucuuauaacgccgaacugcucguagcacuugagaaucagcauacaauugaccugacugauagcgaaaugaacaaguuguucgagaggaccaaaaagcagcuacgggaaaaugcugaggacaugggcaacggaugcuuuaagauauaccacaaaugugauaaugccugcaucggcucaauucgaaacgggacauaugaccaugauguguaccgcgacgaggcucugaauaacagauuccagaucaagggagucgaacucaaaagugguuacaaggacuggauucuguggaucuccuuugccauaagcugcuuccuucugugugugguuuugcucggcuuuaucaugugggcaugccaaaaagggaauauuagguguaacaucugcauuuga

SEQ ID NO: 133218 - RNA, 1701 nt, Artificial Sequence; identical to SEQ ID NO: 133213
  derived and/or modified sequence opt3 from hemagglutinin__InfluenzaA__AHL89270

SEQ ID NO: 133219 - RNA, 1701 nt, Artificial Sequence; identical to SEQ ID NO: 133213
  derived and/or modified sequence opt3 from hemagglutinin__InfluenzaA__AHL89282

SEQ ID NO: 133220 - RNA, 1701 nt, Artificial Sequence; identical to SEQ ID NO: 133213
  derived and/or modified sequence opt3 from hemagglutinin__InfluenzaA__AHL89294

SEQ ID NO: 133221 - RNA, 1701 nt, Artificial Sequence; identical to SEQ ID NO: 133213
  derived and/or modified sequence opt3 from hemagglutinin__InfluenzaA__AHL89306

SEQ ID NO: 133222 - RNA, 1701 nt, Artificial Sequence; identical to SEQ ID NO: 123597
  derived and/or modified sequence opt3 from hemagglutinin__InfluenzaA__AHL89318

SEQ ID NO: 133223 - RNA, 1701 nt, Artificial Sequence
  derived and/or modified sequence opt3 from hemagglutinin__InfluenzaA__AHL89330
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcaagcggcgcuccaacaauucauuuuucagucgacugaacuggcucacucauuuaaaauuuaaguauccagcacugaaugugaccaugcccaacaacgagaaauucgacaaguuguacaucuggggaguccaccauccuggcacagauaaugaccagauuuuucuuuaugcccaggcuagcggccguaucacugugucuaccaaaagaucccaacagacaguaauuccaaacaucgggucaaggccccggguucgcaauauaccuagcagaauuaguaucuacuggaccauugugaagccaggagauauccugcuaaucaacucuacggguaaucucauugccccgaggggcuacuucaagauacgguccgggaaaagcucgaucaugcgcucugacgcgcccauuggaaaguguaacuccgagugcaucacuccuaauggcucaauaccaaacgacaaacccuuucagaaugucaaccgaauuacauauggugcauguccuagauacgugaagcagaauacccugaaacuugccacugggaugaggaacgugccagaaaagcaaacacggggaaucuucggcgcuaucgccggcuuuauugagaaugggugggaaggaauggucgaugguugguauggcuuccgucaccagaacagugaggggaucggacaggcagcugaccugaaaagcacccaagccgcgauuaaucagauaaacggcaaguugaaccgccucaucgguaagacgaaugagaaauuccaccagauugaaaaggaguuuuccgaaguugaggggagaauccaggaucuggaaaaauacguggaggacaccaagaucgauuuauggucuuauaacgccgagcugcucguagcacuugaaaaucaacauacaauugaccugacugauagcgagaugaacaaauuguucgaaaggaccaagaagcagcuacgggagaaugcugaagacaugggcaacggaugcuuuaaaauauaccacaagugugauaaugccugcaucggcucaauucgaaacgggacauaugaccaugauguguaccgcgacgaggcucugaauaacagauuccagaucaaaggagucgagcucaagagugguuacaaagacuggauucuguggaucuccuuugccauaagcugcuuccuucuguguguggcauugcucggcuuuaucaugugggccugccagaaggggaauauuagguguaacaucugcauuuga

SEQ ID NO: 133224 - RNA, 1701 nt, Artificial Sequence; identical to SEQ ID NO: 122646
  derived and/or modified sequence opt3 from hemagglutinin__InfluenzaA__AHL89342

SEQ ID NO: 133225 - RNA, 1701 nt, Artificial Sequence; identical to SEQ ID NO: 123577
  derived and/or modified sequence opt3 from hemagglutinin__InfluenzaA__AHL89354

SEQ ID NO: 133226 - RNA, 1701 nt, Artificial Sequence
  derived and/or modified sequence opt3 from hemagglutinin__InfluenzaA__AHL89366
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggaguccaccauccuggcacagauaaugaccagaucuuuuuguaugcccaggcuagcggccguauuacugugucuaccaagagaucccaacagacaguaauuccaaacaucgggucaaggccccggguucgcaauauaccuagcagaauuaguaucuacuggaccauugugaaaccaggagauauccugcuaaucaacucuacggguaaucucauugccccgaggggcuacuucaagauacgguccggaaagagcucgaucaugaaaucugacgcgcccauugggaaguguaacuccgaaugcaucacuccuaauggcucaauaccaaacgacaaacccuuucagaaugucaaccgcauuacauauggugcauguccucgauacgugaagcagaauacccugaaacuugccacugggaugagaaacgugccagagaagcaaacaaggggaaucuucggcgcuaucgccggcuuuauugaaaaugggugggagggaauggucgaugguugguauggcuuccggcaccagaacagugaggggaucggacaggcagcugaccugaaaagcacccaagccgcgauuaaucagauaaacggcaaguugaaccgucucaucgguaagacgaaugaaaaauuccaccagauugagaaggaauuuuccgagguugaagggcgcauccaggaucuggagaaauacguggaggacaccaagaucgauuuauggucuuauaacgccgaacugcucguagcacuugagaaucaacauacaauugaccugacugauagcgaaaugaacaaauuguucgagagaaccaagaagcagcuaagggaaaaugcugaggacaugggcaacggaugcuuuaaaauauaccacaagugugauaaugccugcaucggcucaauucggaacgggacauaugaccaugauguguaccgagacgaggcucugaauaaccgcuuccagaucaaaggaauugaacucaagagugguuacaaagacuggauccuguggauauccuuugccaucagcugcuuccuucugugugucguguugcucggcuuuauuaugugggcaugccagaaggggaauaucagauguaacauuugcaucuga

SEQ ID NO: 133227 - RNA, 1701 nt, Artificial Sequence; identical to SEQ ID NO: 133213
  derived and/or modified sequence opt3 from hemagglutinin__InfluenzaA__AHL89378

SEQ ID NO: 133228 - RNA, 1701 nt, Artificial Sequence; identical to SEQ ID NO: 123844
  derived and/or modified sequence opt3 from hemagglutinin__InfluenzaA__AHL89390

SEQ ID NO: 133229 - RNA, 1701 nt, Artificial Sequence; identical to SEQ ID NO: 133213
  derived and/or modified sequence opt3 from hemagglutinin__InfluenzaA__AHL89402

SEQ ID NO: 133230 - RNA, 1701 nt, Artificial Sequence; identical to SEQ ID NO: 123597
  derived and/or modified sequence opt3 from hemagglutinin__InfluenzaA__AHL89414

SEQ ID NO: 133231 - RNA, 1701 nt, Artificial Sequence
  derived and/or modified sequence opt3 from hemagglutinin__InfluenzaA__AHL89426
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggaguccaccauccuggcacagauaaugaccagauuuucuuguaugcccaggcuagcggccguaucacugugucuaccaagagaucccaacagacaguaauuccaaacaucgggucaaggccccggguucgcaauauaccuagcagaauuaguaucuacuggaccauugugaaaccaggagauauccuguucaucaacucuacggguaaucuaauugccccgaggggcuacuuuaagauacgguccggaaagagcucgaucaugcgcucugacgcgcccauugggaaauguaacuccgaaugcaucacuccuaauggcucaauaccaaacgacaagcccuuccagaaugucaaccgaauuacauauggugcauguccuagauacgugaaacagaauacccucaagcuggccacugggaugaggaacgugccagagaaacaaacacggggaaucuuuggcgcuaucgccggcuucauugaaaaugggugggagggaauggucgaugguugguauggcuuccgucaccagaacagugaggggaucggacaggcagcugaccuuaagagcacccaagccgcgauuaaucagauaaacggcaaacugaaccgcuugaucgguaagacgaaugaaaaguuucaccagauugagaaagaauuuuccgagguugaagggagaauccaggaucucgagaaguacguggaggacaccaaaaucgaucuguggucuuauaacgccgaauuacugguagcacucgagaaucaacauacaauugaccuuacugauagcgaaaugaacaagcuguuugagaggaccaaaaagcaguugcgggaaaaugcugaggacaugggcaacggaugcuucaagauauaccacaaaugugauaaugccugcaucggcucaauucgaaacgggacauaugaccaugauguguaccgcgacgaggcucuaaauaacagauuucagaucaagggagucgaacugaaaagugguuacaaggacuggauucucuggaucuccuucgccauaagcugcuuucugcuuugugugguucuguugggcuucaucaugugggcaugccagaaagggaauauuagguguaacaucugcauuuga

SEQ ID NO: 133232 - RNA, 1701 nt, Artificial Sequence; identical to SEQ ID NO: 133213
  derived and/or modified sequence opt3 from hemagglutinin__InfluenzaA__AHL89438

SEQ ID NO: 133233 - RNA, 1701 nt, Artificial Sequence; identical to SEQ ID NO: 133213
  derived and/or modified sequence opt3 from hemagglutinin__InfluenzaA__AHL89450

SEQ ID NO: 133234 - RNA, 1701 nt, Artificial Sequence; identical to SEQ ID NO: 133213
  derived and/or modified sequence opt3 from hemagglutinin__InfluenzaA__AHL89462

SEQ ID NO: 133235 - RNA, 1701 nt, Artificial Sequence; identical to SEQ ID NO: 133213
  derived and/or modified sequence opt3 from hemagglutinin__InfluenzaA__AHL89474

SEQ ID NO: 133236 - RNA, 1701 nt, Artificial Sequence; identical to SEQ ID NO: 123844
  derived and/or modified sequence opt3 from hemagglutinin__InfluenzaA__AHL89486

SEQ ID NO: 133237 - RNA, 1701 nt, Artificial Sequence; identical to SEQ ID NO: 123597
  derived and/or modified sequence opt3 from hemagglutinin__InfluenzaA__AHL89498

SEQ ID NO: 133238 - RNA, 1701 nt, Artificial Sequence; identical to SEQ ID NO: 123597
  derived and/or modified sequence opt3 from hemagglutinin__InfluenzaA__AHL89510

SEQ ID NO: 133239 - RNA, 1701 nt, Artificial Sequence; identical to SEQ ID NO: 123597
  derived and/or modified sequence opt3 from hemagglutinin__InfluenzaA__AHL89522

SEQ ID NO: 133240 - RNA, 1701 nt, Artificial Sequence
  derived and/or modified sequence opt3 from hemagglutinin__InfluenzaA__AHL89534
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggaguccaccauccuggcacagauaaugaccagaucuuuuuguaugcccaggcuagcggccguauuacugugucuaccaagagaucccaacagacaguaauuccaaacaucgggucaaggccccggguucgcaauauaccuagcagaauuaguaucuacuggaccauugugaaaccaggagauauccugcuaaucaacucuacggguaaucucauugccccgaggggcuacuucaagauacgguccggaaagagcucgaucaugcgcucugacgcgcccauugggaaauguaacuccgaaugcaucacuccuaauggcucaauaccaaacgacaagcccuuucagaaugucaaccgaauuacauauggugcauguccuagauacgugaaacagaauacccugaagcuggccacugggaugaggaacgugccagagaaacaaacacggggaaucuucggcgcuaucgccggcuuuauugaaaaugggugggagggaauggucgaugguugguauggcuuccgucaccagaacagugaggggaucggacaggcagcugaccuuaagagcacccaagccgcgauuaaucagauaaacggcaaauugaaccgccucaucgguaagacgaaugaaaaguuccaccagauugagaaagaauuuuccgagguugaagggagaauccaggaucuggagaaguacguggaggacaccaaaaucgauuuauggucuuauaacgccgaacugcucguagcacuugagaaucaacauacaauugaccugacugauagcgaaaugaacaaguuguucgagaggaccaaaaagcagcuacgggaaaaugcugaggacaugggcaacggaugcuuuaagauauaccacaaaugugauaaugccugcaucggcucaauucgaaacgggacauaugaccaugauguguaccgcgacgaggcucugaauaacagauuccagaucaagggaauugaacucaaaagugguuacaaggacuggauccuguggauauccuuugccaucagcugcuuccuucugugugucguguugcucggcuuuauuaugugggcaugccagaaagggaauaucagguguaacauuugcaucuga

SEQ ID NO: 133241 - RNA, 1698 nt, Artificial Sequence
  derived and/or modified sequence opt3 from hemagglutinin__InfluenzaA__AHL89546
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaauccgcuuaugucucaguggugagcagucauuacucucgacguuucacccccgagauagcaaaaagaccuaaggucagggaccaggaaggacggaucaacuauuacuggacacuucuggagccaggugauacuauuaucuuugaggccaauggcaacuugauugcuccgcgcuucgccuuugcgcucuccagaggguucggaagcggcaucauaaccucgaaugcacccauggacgaaugugaugccaagugccagacaccucaaggugcuauuaacucuucccugccauuucagaauguucaccccgugaccaucggggaguguccuaaauauguaaggucagccaaguuacggauggugacgggacugcgcaacauuccaaguauccagagccgaggccucuucggcgcaaucgcuggguuuauugaaggagguuggacuggcauggucgacgggugguacggauaucaucaccagaaugagcaaggcuccgguuacgccgcggaucagaaaucuacacagaacgccauaaaugggaucaccaacaaggugaauagcguuauugaaaagaugaacacucaguucacagcagugggcaaagaguucaauaaacuugagagaaggauggaaaaccugaauaagaaggucgacgauggauuuuuggacaucuggaccuacaacgcugagcuacuggugcuccuggaaaacgagcggacgcuugacuuccacgauucaaauguuaaaaaccuguaugaaaagguaaaaagucaauugaagaauaacgccaaagagauaggcaaugggugcuuugaguucuaccauaaguguaacgacgaaugcauggaguccgugaagaauggaaccuaugauuaccccaaauauagcgaagagucuaagcucaaccgugagcgcauugacggugucaaacuggaaucaaugggcguguaccagaucuuagcuaucuauaguacagucgccagcucccuggugcuacucguuucucugggggcaauuucguuuuggaugugcagcaauggaucccuucaguguagaaucugcauuuga

SEQ ID NO: 133242 - RNA, 1698 nt, Artificial Sequence; identical to SEQ ID NO: 123930
  derived and/or modified sequence opt3 from hemagglutinin__InfluenzaA__AHL89558

SEQ ID NO: 133243 - RNA, 1698 nt, Artificial Sequence; identical to SEQ ID NO: 123930
  derived and/or modified sequence opt3 from hemagglutinin__InfluenzaA__AHL89570

SEQ ID NO: 133244 - RNA, 1698 nt, Artificial Sequence; identical to SEQ ID NO: 123946
  derived and/or modified sequence opt3 from hemagglutinin__InfluenzaA__AHL89582

SEQ ID NO: 133245 - RNA, 1698 nt, Artificial Sequence; identical to SEQ ID NO: 123946
  derived and/or modified sequence opt3 from hemagglutinin__InfluenzaA__AHL89594

SEQ ID NO: 133246 - RNA, 1698 nt, Artificial Sequence; identical to SEQ ID NO: 123946
  derived and/or modified sequence opt3 from hemagglutinin__InfluenzaA__AHL89606

SEQ ID NO: 133247 - RNA, 1698 nt, Artificial Sequence; identical to SEQ ID NO: 123930
  derived and/or modified sequence opt3 from hemagglutinin__InfluenzaA__AHL89618

SEQ ID NO: 133248 - RNA, 1698 nt, Artificial Sequence; identical to SEQ ID NO: 123946
  derived and/or modified sequence opt3 from hemagglutinin__InfluenzaA__AHL89630

SEQ ID NO: 133249 - RNA, 1698 nt, Artificial Sequence
  derived and/or modified sequence opt3 from hemagglutinin__InfluenzaA__AHL89642
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauaaccacaaugggaaacuaugccuccugaagggaauagcgccccuucagcuggguaacuguucuguggccggcuggaucuuggggaauccugagugcgaacuccugauuucaaaagagaguuggagcuacaucguugaaaccccaaacccggagaauggaacuuguuaucccggcuacuuugcugacuaugaggaacugagagagcaacucuccucugugucgucauucgaaagguuugagauuuucccuaaggagagcaguuggccaaaccauacagucaccgguguguccgccucuugcagccacaaugggaaguccucauuuuaccggaacuuacuguggcuuacgggcaaaaauggauuguaucccaaccugaguaagagcuacgcaaauaacaaagaaaaggaggugcuaguucucuggggcgugcaucacccuccaaacaucggggaucagcgcgcccuguaccacacugaaaaugcuuaugucucugugguguccucacauuacagccgacguuucacccccgagauagcaaaaagaccuaaggucagggaccaggaaggacggaucaacuauuacuggacacuucuggagccaggugauacuauuaucuuugaggccaauggcaacuugauugcuccgcgcuucgccuuugcgcucaguagaggguucggaucuggcaucauaaccuccaaugcacccaugggugaaugugacgccaagugccagacaccucaaggggcuauuaacagcucgcugccauuucagaauguucaccccgugaccaucggagaguguccuaaauauguaaggucugccaaguuacggauggugacgggccugcgcaacauuccauccauccagucacgaggccucuucggggcaaucgcuggauuuauugaagguggcuggacugggauggucgauggaugguacggcuaucaucaccagaaugagcaagguaguggguacgccgcggaccagaaaagcacacagaacgccauaaauggcaucaccaacaagguaaauuccguuauugaaaagaugaacacucaguucacagcagugggaaaagaguucaauaaacuugagagaaggauggaaaaccugaacaagaaggucgaugacggcuuuuuggauaucuggaccuacaaugcugagcuacuggugcuccuggaaaacgagcggacgcuugacuuccacgacucuaauguuaaaaaccuguaugaaaagguaaaaagccaauugaagaauaacgccaaagagauagggaauggaugcuuugaguucuaccauaaguguaacgaugaaugcauggagucagugaagaaugguaccuaugacuaccccaaauauagugaagaguccaagcucaaccgugagaaaauugauggcgucaagcuggaaagcauggggguguaccagaucuuagcuaucuauucuacagucgccucaagucuggugcuacucguuagccugggagcaauuuccuuuuggaugugcucuaauggcucgcuucagugucgcaucugcauuuga

SEQ ID NO: 133250 - RNA, 1698 nt, Artificial Sequence; identical to SEQ ID NO: 123961
  derived and/or modified sequence opt3 from hemagglutinin__InfluenzaA__AHL89654

SEQ ID NO: 133251 - RNA, 1698 nt, Artificial Sequence
  derived and/or modified sequence opt3 from hemagglutinin__InfluenzaA__AHL89666
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauaaccacaaugggaaacuaugccuccugaagggaauagcgccccuucagcuggguaacuguucuguggccggcuggaucuuggggaauccugagugcgaacuccugauuucaaaagagaguuggagcuacaucguugaaaccccaaacccggagaauggaacuuguuaucccggcuacuuugcugacuaugaggaacugagagagcaacucuccucugugucgucauucgaaagguuugagauuuucccuaaggagagcaguuggccaaaccauacagucaccgguguguccgccucuugcagccacaaugggaaguccucauuuuaccggaacuuacuguggcuuacgggcaaaaauggauuguaucccaaccugaguaagagcuacgcaaauaacaaagaaaaggaggugcuaguucucuggggcgugcaucacccuccaaacaucggggaucagcgcgcccuguaccacacugaaaaugcuuaugucucugugguguccucacauuacagccgacguuucacccccgagauagcaaaaagaccuaaggucagggaccaggaaggacggaucaacuauuacuggacacuucuggagccaggugauacuauuaucuuugaggccaauggcaacuugauugcuccgcgcuucgccuuugcgcucaguagaggguucggaucuggcaucauaaccuccaaugcacccaugggugaaugugacgccaagugccagacaccucaaggggcuauuaacagcucgcugccauuucagaauguucaccccgugaccaucggagaguguccuaaauauguaaggucugccaaguuacggauggugacgggccugcgcaacauuccauccauccagucacgaggccucuucggggcaaucgcuggauuuauugaagguggcuggacugggauggucgauggaugguacggcuaucaucaccagaaugagcaagguaguggguacgccgcggaccagaaaagcacacagaacgccauaaauggcaucaccaacaagguaaauuccguuauugaaaagaugaacacucaguucacagcagugggaaaagaguucaauaaacuugagagaaggauggaaaaccugaacaagaaggucgaugacggcuuuuuggauaucuggaccuacaaugcugagcuacuggugcuccuggaaaacgagcggacgcuugacuuccacgacucuaauguuaaaaaccuguaugaaaagguaaaaagccaauugaagaauaacgccgaggagauagggaauggaugcuuugaguucuaccauaaauguaacgaugaaugcauggaaucagugaagaaugguaccuaugacuaccccaaguauagugaggaguccaaacucaaccgugaaaagauugauggcgucaaacuggagagcauggggguguaccagaucuuagcuaucuauucuacagucgccucaagucuggugcuacucguuagccugggagcaauuuccuuuuggaugugcucuaauggcucgcuucagugucgcaucugcauuuga

SEQ ID NO: 133252 - RNA, 1698 nt, Artificial Sequence
  derived and/or modified sequence opt3 from hemagglutinin__InfluenzaA__AHL89678
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuucgccuuugcgcucucuagaggguucggauccggcaucauaaccagcaacgcacccaugggugaaugugacgccaagugccagacaccucaaggggcuauuaauucgucucugccauuucagaacguucaccccgugaccaucggagaguguccuaaauauguaagguccgccaaguuacggauggugacgggccugcgcaauauuccaucaauccagagucgaggccucuucggggcaaucgcuggauuuauugaagguggcuggacugggauggucgauggaugguacggcuaucaucaccagaacgagcaagguagcggguacgccgcggaccagaaauccacacagaaugccauaaacggcaucaccaauaaggugaacucuguuauugaaaagaugaauacucaguucacagcagugggaaaagaguucaacaaacuugagagaaggauggaaaaucugaacaagaaggucgaugacggcuuuuuggauaucuggaccuacaacgcugagcuacuggugcuccuggaaaaugagcggacgcuugacuuccacgacagcaacguuaaaaaucuguaugaaaagguaaaaucacaauugaagaacaaugccaaagagauagggaacggaugcuuugaguucuaccauaaguguaaugaugaaugcauggagagugugaagaacgguaccuaugacuaccccaaauauuccgaagagagcaagcucaaucguaaaaagauugauggcgucaaacuggagucuauggggguguaccagaucuuagcuaucuauucaacagucgccaguagccuggugcuacucguuucccugggagcaauuucuuuuuggaugugcucgaacggcagccuucagugucgcaucugcauuuga

SEQ ID NO: 133253 - RNA, 1698 nt, Artificial Sequence
  derived and/or modified sequence opt3 from hemagglutinin__InfluenzaA__AHL89690
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaagccagacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaaugggaaaucaaguuuuuauaagaacuuacuguggcuuaccggcaaaaauggauuguaccccaaccugagcaagucuuaugcaaauaacaaagaaaaggagguucuaguacucuggggcgugcaccacccuccaaauaucggggaccagaaggcccuguaccauacggaaaacgcuuacgucuccguggugucaagccacuauagucggaaauucacucccgagauagcaaagcgcccuaaaguccgagaucaggaaggacguaucaacuacuauuggacccuucuggagccaggugacacaauuaucuuugaggccaauggcaacuugauugcuccgagauacgccuucgcgcucucuaggggguuuggauccggcaucauaaauagcaacgcacccauggauaagugugacgccaaaugccagacuccucaaggugcuauuaauucgucucugccauuccagaacguucaucccgugaccaucggggaauguccuaaguauguacgguccgccaaauuacgcauggugacaggacugagaaauauuccaucaauccagaguaggggccucuuuggcgcaaucgcuggguucauugagggagguuggaccggcauggucgaugggugguacggauaucaccaccagaacgaacaaggcagcgguuacgccgcggaccagaaguccacgcagaaugccauaaacgggaucacuaauaaggugaacucuguuauugagaaaaugaauacacaguuuaccgcagugggcaaggaguucaacaaacuugaacggcgcauggagaaucugaacaagaaagucgaugacggauucaucgacauauggacuuacaacgcugaauugcuagugcugcucgagaaugaacgaacacuggauuuucaugacagcaacguaaagaaucuuuaugagaagguuaaaucacaacugaagaacaaugccaaagaaauuggcaacgggugcuucgaguuuuaccacaaguguaaugaugagugcauggaaagugugaaaaacggaaccuaugacuaccccaaguauuccgaggaaagcaaguugaauagagagaaaaucgauggugucaagcucgagucuaugggcguguaccagauccuggcuauuuauucaacggucgccaguagcuuagugcugcuaguuucccucggggcaaucucuuucuggaugugcucgaacggaagccugcaguguaggauuugcauauga

SEQ ID NO: 133254 - RNA, 1698 nt, Artificial Sequence; identical to SEQ ID NO: 123961
  derived and/or modified sequence opt3 from hemagglutinin__InfluenzaA__AHL89702

SEQ ID NO: 133255 - RNA, 1698 nt, Artificial Sequence; identical to SEQ ID NO: 123930
  derived and/or modified sequence opt3 from hemagglutinin__InfluenzaA__AHL89714

SEQ ID NO: 133256 - RNA, 1698 nt, Artificial Sequence
  derived and/or modified sequence opt3 from hemagglutinin__InfluenzaA__AHL89726
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggaaagaacggcuuguaucccaaucugagcaagucuuacgcaaacaauaaagaaaaggagguucuaguacucuggggcgugcaucacccuccaaacaucggggaucagaaagcccuguaccacacugaaaacgcuuaugucuccguggugucaagccauuacagucgccgauucacccccgagauagcaaagcguccuaaggucagagaccaggaaggaaggaucaauuauuacuggacacuucuggagccaggugauacuauuaucuuugaggccaacggcaauuugauugcuccgcgguucgccuuugcgcucucucgcggguucggauccggcaucauaaccagcaacgcacccauggacgaaugugaugccaaaugccagacaccucaaggugcuauuaauucgucucugccauuucagaacguucaccccgugaccaucggggaguguccuaaguauguaagauccacgaaauuaaggauggugacuggacugcggaauauuccaucaauccagagucgcggccucuucggcgccaucgcaggguuuauugaaggagguuggacaggcauggucgacgggugguacggauaucaucaccagaacgagcaaggcagcgguuacgcugccgaucagaaguccacccagaaugcgauaaacgggaucacuaauaaagugaacucuguuauugaaaagaugaauacacaguucaccgccgugggcaaagaguucaacaaacuugagcgaagaauggaaaaucugaacaagaaagucgacgauggauuuuuggacaucuggacguacaacgcagagcuacuggugcuccuggaaaaugagaggacccuugacuuccacgauagcaacguaaagaaucuguaugaaaaaguuaagucacaauugaaaaacaaugcuaaggagauaggcaacgggugcuuugaguucuaccauaaguguaaugacgaaugcauggagagugugaaaaacggaacauaugauuaccccaaguauuccgaagagagcaaacucaaucgggagaagauugacggugucaaacuggaaucuaugggcguguaccagaucuuagccaucuauucaacugucgcuaguagccuggugcuacucguuucccugggggccauuucuuuuuggaugugcucgaacggaagccuucagugucguaucugcauuuga

SEQ ID NO: 133257 - RNA, 1698 nt, Artificial Sequence
  derived and/or modified sequence opt3 from hemagglutinin__InfluenzaA__AHL89750
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuucgccuuugcgcucucuagaggguucggauccggcaucauaaccagcaacgcacccauggacgguugugaugccaagugccagacaccucaaggggcuauuaauucgucucugccauuucagaacguucaccccgugaccaucggagaauguccuaaauauguaagguccacgaaguuacggauggugacuggccugcgcaauauuccaucaauccagagucgaggccucuucggggccaucgcaggauuuauugaggguggcuggacagggauggucgacggaugguacggcuaucaucaccagaacgaacaagguagcggguacgcugccgaucagaaauccacccagaaugcgauaaacggcaucacuaauaaggugaacucuguuauugagaaaaugaauacacaguucaccgccgugggaaaggaguucaacaaacuugaaagaaggauggagaaucugaacaagaaggucgacgauggcuuuuuggacaucuggacguacaacgcagaacuacuggugcuccuggagaaugaacggacccuugacuuccacgauagcaacguuaaaaaucuguaugagaagguaaaaucacaauugaagaacaaugcuaaagaaauagggaacggaugcuuugaguucuaccauaaguguaaugacgagugcauggaaagugugaagaacgguacauaugauuaccccaaauauuccgaggaaagcaagcucaaucgugagaaaauugacggcgucaagcuggagucuauggggguguaccagaucuuagccaucuauucaacugucgcuaguagccuggugcuacucguuucccugggagccauuucuuuuuggaugugcucgaacggcagccuucagugucgcaucugcauuuga

SEQ ID NO: 133258 - RNA, 1698 nt, Artificial Sequence; identical to SEQ ID NO: 123926
  derived and/or modified sequence opt3 from hemagglutinin__InfluenzaA__AHL89762

SEQ ID NO: 133259 - RNA, 1698 nt, Artificial Sequence; identical to SEQ ID NO: 123972
  derived and/or modified sequence opt3 from hemagglutinin__InfluenzaA__AHL89774

SEQ ID NO: 133260 - RNA, 1698 nt, Artificial Sequence; identical to SEQ ID NO: 123961
  derived and/or modified sequence opt3 from hemagglutinin__InfluenzaA__AHL89786

SEQ ID NO: 133261 - RNA, 1698 nt, Artificial Sequence
  derived and/or modified sequence opt3 from hemagglutinin__InfluenzaA__AHL89798
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauagacacaacgggaaacuaugccuccugaagggaauagcgccccuucagcuggguaauuguucuguggccggcuggaucuuggggaacccugagugcgaacuccugauuucaaaagagaguuggagcuacaucguugaaaccccaaauccggagaacggaacuuguuaucccggcuacuuugcugacuaugaggaacugagggagcaacucuccucugugucgucauucgaacgguuugagauuuucccuaaggagagcaguuggccaaaucauacagucaccgguguguccgccucuugcagccacaacgggaaguccucauuuuaccgcaauuuacuguggcuuacgggaaagaacggcuuguaucccaaucugagucgaagcuacgcaaacaauaaggaaaaagaggugcuaguucucuggggcgugcaucacccuccaucuaucggggaucagcgugcccuguaccacacugaaaacgcuuaugucuccguggugucaagccauuacaguagaagguucacccccgagauagcaaagcggccuaaaguccgcgaccaggaaggaagaaucaacuauuacuggacacuucuggagccaggugauacuauuaucuuugaggccaauggcaacuugauugcuccgagguucgccuuugcgcucucucggggguucggauccggcaucauaaccagcaaugcacccauggacgaaugugaugccaagugccagacaccucaaggugcuauuaacucgucucugccauuucagaauguucaccccgugaccaucggggaguguccuaaguauguacgcuccgccaaauuacgaauggugacgggacugagaaacauuccaucaauccagaguaggggccucuucggcgcaaucgcuggguuuauugaaggagguuggacuggcauggucgacgggugguacggauaucaucaccagaaugagcaaggcagcgguuacgccgcggaucagaaguccacacagaacgccauaaaugggaucaccaacaaaguaaauucuguuauugaaaagaugaacacucaguucacagcagugggcaaagaguucaauaaacuugagcggcguauggaaaaccugaauaaaaaggucgacgauggauuuuuggacaucuggaccuacaacgcugagcuacuggugcuccuggaaaacgagcgcacgcuugacuuccacgauagcaauguaaagaaccuguaugaaaaaguuaagucacaauugaaaaauaacgccaaggagauaggcaaugggugcuuugaguucuaccauaaauguaacgacgaaugcauggagagugugaagaauggaaccuaugauuaccccaaguauuccgaagagagcaaacucaacagagagaagauugacggugucaaacuggaaucuaugggcguguaccagaucuuagcuaucuauucaacagucgccaguagccuggugcuacucguuucccugggggcaauuucuuuuuggaugugcucgaauggaagccuucaguguaggaucugcauuuga

SEQ ID NO: 133262 - RNA, 1698 nt, Artificial Sequence
  derived and/or modified sequence opt3 from hemagglutinin__InfluenzaA__AHL89810
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggaaagaacggcuuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuucgccuuugcgcucucuagaggguucggauccggcaucauaaccagcaacgcacccaugggugaaugugacgccgagugccagacaccucaaggggcuauuaauucgucucugccauuucagaacguucaccccgugaccaucggagaauguccuaaguauguaagguccgccaaauuacggauggugacgggccugcgcaauauuccaucaauccagagucgaggccucuucggggcaaucgcuggauuuauugaggguggcuggacugggauggucgauggaugguacggcuaucaucaccagaacgaacaagguagcggguacgccgcggaccagaaguccacacagaaugccauaaacggcaucaccaauaaagugaacucuguuauugagaagaugaauacucaguucacagcagugggaaaagaguucaacaaacuugaaagaaggauggagaaucugaacaaaaaggucgaugacggcuuuuuggauaucuggaccuacaacgcugaacuacuggugcuccuggagaaugaacggacgcuugacuuccacgacagcaacguaaagaaucuguaugagaaaguuaagucacaauugaaaaacaaugccaaggagauagggaacggaugcuuugaguucuaccauaaauguaaugaugaaugcauggaaagugugaagaacgguaccuaugacuaccccaaguauuccgaggagagcaaacucaaucgugaaaagauugauggcgucaaacuggagucuauggggguguaccagaucuuagcuaucuauucaacagucgccaguagccuggugcuacucguuucccugggagcaauuucuuuuuggaugugcucgaacggcagccuucagugucgcaucugcauuuga

SEQ ID NO: 133263 - RNA, 1698 nt, Artificial Sequence
  derived and/or modified sequence opt3 from hemagglutinin__InfluenzaA__AHL89822
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauagacacaacgggaaacuaugccuccugaagggaauagcgccccuucagcuggguaauuguucuguggccggcuggaucuuggggaacccugagugcgaacuccugauuucaaaagagaguuggagcuacaucguugaaaccccaaauccggagaacggaacuuguuaucccggcuacuuugcugacuaugaggaacugagggagcaacucuccucugugucgucauucgaacgguuugagauuuucccuaaggagagcaguuggccaaaucauacagucaccgguguguccgccucuugcagccacaacgggaaguccucauuuuaccgcaauuuacuguggcuuacgggcaaaaacggauuguaucccaaucugaguaagagcuacgcaaacaauaaagaaaaggagguucuaguacucuggggcgugcaucacccuccaaacaucggggaucagcgagcccuguaccacacugaaaacgcuuaugucucugugguguccucacauuacagccguagauucacccccgagauagcaaaaaggccuaagguccgggaccaggaaggacgcaucaauuauuacuggacacuucuggagccaggugauacuauuaucuuugaggccaacggcaauuugauugcuccgagauucgccuuugcgcucaguaggggguucggaucuggcaucauaaccuccaacgcacccauggacgaaugugaugccaagugccagacaccucaaggugcuauuaauagcucgcugccauuucagaacguucaccccgugaccaucggggaguguccuaaauauguacggucugccaaguuacgcauggugacgggacugcgaaauauuccauccauccagucaagaggccucuucggcgcaaucgcuggguuuauugaaggagguuggacuggcauggucgacgggugguacggauaucaucaccagaacgagcaaggcagugguuacgccgcggaucagaaaagcacacagaaugccauaaacgggaucaccaauaaggugaacuccguuauugaaaagaugaauacucaguucacagcagugggcaaagaguucaacaaacuugagaggcggauggaaaaucugaacaagaaggucgacgauggauuuuuggacaucuggaccuacaacgcugagcuacuggugcuccuggaaaaugagcguacgcuugacuuccacgauucuaacguuaaaaaucuguaugaaaagguaaaaagccaauugaagaacaaugccaaagagauaggcaacgggugcuuugaguucuaccauaaguguaaugacgaaugcauggagucagugaagaacggaaccuaugauuaccccaaauauagugaagaguccaagcucaaucgcgagaaaauugacggugucaagcuggaaagcaugggcguguaccagaucuuagcuaucuauucuacagucgccucaagucuggugcuacucguuagccugggggcaauuuccuuuuggaugugcucuaacggaucgcuucaguguagaaucugcauuuga

SEQ ID NO: 133264 - RNA, 1698 nt, Artificial Sequence
  derived and/or modified sequence opt3 from hemagglutinin__InfluenzaA__AHL89834
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcaauuuugcugacuacgaggaacugagagagcaacucucuucggugagcucauucgaaagguuugagauuuucccuaaggagaguuccuggccaaaccauacagucaccggugugucugccagcugcucccacaaugggaagucaaguuuuuaucggaacuuacuguggcuuacgggcaaaaauggauuguaccccaaccugagcaagucuuaugcaaauaacaaagaaaaggaggugcuaguucucuggggcgugcaucacccuccaaacaucggggaucagcgcgcccuguaccacacugaaaaugcuuacgucuccguggugucaagccauuauagucgacguuucacccccgagauagcaaaaagaccuaaggucagggaccaggaaggacggaucaacuacuauuggacacuucuggagccaggugauacuauuaucuuugaggccaauggcaacuugauugcuccgcgcuucgccuuugcgcucucuagaggguucggauccggcaucauaaccagcaaugcacccauggacgaaugugaugccaagugccagacaccucaaggugcuauuaacucgucucugccauuucagaauguucaccccgugaccaucggggaguguccuaaauacguaagguccgccaaguuacggauggugacgggacugcgcaacauuccaucaauccagagucgaggccucuucggcgcaaucgcuggguuuauugaaggagguuggacuggcauggucgacgggugguauggauaccaucaccagaaugagcaaggcagcgguuaugccgcggaucagaaauccacacagaacgccauaaaugggaucaccaacaagguaaauucuguuauugaaaagaugaacacucaguucacagcagugggcaaagaguucaauaaacuugagagaaggauggaaaaccugaacaagaaggucgacgauggauuuuuggacaucuggaccuacaaugcugagcuacuggugcuccuggaaaacgagcggacgcuugacuuccacgauagcaauguuaaaaaccuguacgaaaagguaaaaucacaauugaagaauaacgccaaagagauaggcgacgggugcuuugaguucuaucauaaguguaaugaugaaugcauggagagugugaagaacggaaccuacgacuaucccaaauacuccgaagagagcaagcucaaucgugagaaaauugauggugucaagcuggaaucuaugggcguguaucagaucuuagcuaucuacucaacagucgccaguagccuggugcuacucguuucccugggggcaauuucuuuuuggaugugcucgaacggaagccuucagugucgcaucugcauuuga

SEQ ID NO: 133265 - RNA, 1698 nt, Artificial Sequence; identical to SEQ ID NO: 123972
  derived and/or modified sequence opt3 from hemagglutinin__InfluenzaA__AHL89846

SEQ ID NO: 133266 - RNA, 1701 nt, Artificial Sequence; identical to SEQ ID NO: 123944
  derived and/or modified sequence opt3 from hemagglutinin__InfluenzaA__AHL89858

SEQ ID NO: 133267 - RNA, 1701 nt, Artificial Sequence; identical to SEQ ID NO: 123944
  derived and/or modified sequence opt3 from hemagglutinin__InfluenzaA__AHL89870

SEQ ID NO: 133268 - RNA, 1701 nt, Artificial Sequence
  derived and/or modified sequence opt3 from hemagglutinin__InfluenzaA__AHL89882
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggggcuccgacaacucauuuuucagucgccugaauuggcucacucauuuaaaguuuaaauauccagcacugaacgugaccaugcccaauaacgagaaguucgauaaacuuuacaucuggggcguccaccauccugggacagacaacgaucagaucuuuuuguaugcccaggcuagcggacgaauuacugugucuaccaagcguucccaacagacaguaauuccaaauaucgguucaagacccaggguucggaacauaccuagccgcauuaguaucuacuggaccauugugaaaccaggcgacauccugcuaaucaauucuacggggaaccucauugccccgagaggauacuucaagauaagguccggcaagagcucgaucaugcggucugacgcgcccauugguaaauguaauuccgagugcaucacuccuaacgggucaauaccaaaugauaagcccuuucagaacgucaaucgcauuacauauggagcauguccucgauacgugaaacagaacacccugaagcuggccacuggcaugagaaaugugccagaaaaacaaacaaggggcaucuucggggcuaucgccggauuuauugagaacgguugggaaggcauggucgacgggugguauggauuccggcaccagaauagugagggcaucggucaggcagcugaucuuaagagcacccaagccgcgauuaaccagauaaaugggaaauugaaccgucucaucggcaagacgaacgagaaguuccaccagauugaaaaagaguuuuccgaaguugagggacgcauccaggaccuggaaaaguacguggaggauaccaaaaucgacuuauggucuuauaaugccgagcugcucguagcacuugaaaaccaacauacaauugaucugacugacagcgagaugaauaaguuguucgaaagaaccaaaaagcagcuaagggagaacgcugaagauaugggcaaugggugcuuuaagauauaccacaaaugugacaacgccugcaucggaucaauucggaaugguacauaugaucaugacguguaccgagacgaggcucugaacaaucgcuuccagaucaagggcgucgagcucaaaaguggguacaaggauuggauucuguggaucuccuuugccauaagcugcuuccuucuguguguggcauugcucggauuuaucaugugggccugccagaaaggcaacauuagauguaauaucugcauuuga

SEQ ID NO: 133269 - RNA, 1701 nt, Artificial Sequence; identical to SEQ ID NO: 123944
  derived and/or modified sequence opt3 from hemagglutinin__InfluenzaA__AHL89894

SEQ ID NO: 133270 - RNA, 1701 nt, Artificial Sequence
  derived and/or modified sequence opt3 from hemagglutinin__InfluenzaA__AHL89906
augaagaccaucauugcccugagcuacauacucugccuuguguaugcucagaaacugcccggcaucgacaacuccacagcaacuuuguguuuagggcaccaugccgucccuaauggaacgauuguuaagaccaucacaaacgaucaaauugaggugacuaaugcgaccgaacugguacagucuucaaguacaggugagaucugcgacagcccacaccagauacuagauggcgaaaacuguacccucaucgacgcucugcuuggggauccgcagugcgacggauuccaaaauaaaaagugggaucuguuuguggagagauccaaagccuacucuaacuguuaucccuacgacgucccugauuaugcaucguugaggucacucguggccagcaguggcacucuggaguucaauaacgaauccuuuaauugggcugguguuacacagaacgggaccucuagcgcaugcaagcggggauccaauaacucauucuuuagucgccugaauuggcucacgcauagcaaguucaaauacccagccuuaaacgugacuaugcccaauaacgaggaauuugacaagcuguauauuuggggcguccaccauccuggcaccgauaacgaccagaucuuccuuuacgcucaggccucugggcgaauuacaguguccacuaaacguucacaacagaccguaaucccaaauauaggaagcagacccaggguucggaacauuccuagucgcaucucuauuuacuggacaaucgugaagccaggugauaucuugcugauuaauuccaccggcaaccuaauagcgccgagaggguauuuuaaaaucaggagcggaaagucgucuauuaugcgguccgacgcacccaucggcaaguguaauucagagugcauaacgccuaacgguaguauuccaaaugacaaacccuuccagaacgucaaucgcaucacuuacggggccuguccucgauaugugagacagaacacacucaagcuggcuaccggaaugaggaaugugccagaaaaacaaacucggggcaucuuuggcgccauugcaggguucaucgagaacggaugggaggguauggucgauggcugguacggguuucgucaccagaauagcgaaggaauuggccaggcugccgaccuuaaguccacacaagcggccauagaucagaucaacgguaaacugaaucgcuugauugggaagaccaacgagaaauuccaccagaucgaaaaggaguucucugaaguugagggcagaauccaggaccucgagaaguauguggaagauacgaaaauugaccuguggagcuacaacgcagaguuacugguagcucucgaaaaucaacauaccauagaucuuacagacucagagaugaacaagcuguuugagaaaacuaagaaacaguugagggaaaaugccgaggauaugggaaacggcugcuucaagaucuaucacaagugugacaaugcuugcauugggaguauccggaacggaaccuacgaucaugacguguaccgagacgaagcccuaaauaaccgcuuucagauuaaaggugucgagcugaaguccggcuauaaagauuggauccucuggaucagcuucgcaauaucuugcuuucugcuuuguguggcccuguugggguucauuaugugggcuugccagaagggaaauaucagauguaacauuugcaucuga

SEQ ID NO: 133271 - RNA, 1701 nt, Artificial Sequence
  derived and/or modified sequence opt3 from hemagglutinin__InfluenzaA__AHL89918
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaguuguacauuuggggaguccaccauccuggcacagauaaugaccagacuuuucuuuaugcccaggcuagcggccguaucaccgugucuacaaaaagaucccaacagaccguaauuccaaacaucgggucaaggccccggguucgcaauauaccuagcagaauuaguaucuacuggacgauugugaagccaggagauauccugcuaaucaacucuacugguaaucucauugccccgaggggcuacuucaaaauacaguccgggaaaagcucgaucaugcggucugacgcgcccauuggaaaguguaacuccgaaugcaucacaccuaauggcucaauaccaaacgacaaacccuuucagaaugucaaccgcauuaccuauggugcauguccucgauacgugaagcaaaauacucugaaacuugccacagggaugagaaacgugccagagaagcagaccaggggaaucuucggcgcuaucgccggcuuuauugaaaaugggugggagggaauggucgaugguugguauggcuuccggcaccagaacagugaggggaucggacaagcagcugaccugaaaagcacgcaggccgcgauugaucagauaaauggcaaguugaaccgucucaucgguaaaaccaacgaaaaguuccaccagauugagaaggaauuuuccgagguugaagggcgcauccaagaccuggagaaauacguggaggauacaaagaucgacuuauggucuuauaaugccgaacugcucguagcacuugagaaccagcauacuauugaucugaccgacagcgaaaugaauaaauuguucgagaagacaaagaagcagcuaagagaaaacgcugaggauaugggcaauggaugcuuuaagauauaccacaaaugugacaacgccugcaucggcucaauuaggaaugggacuuaugaucaugacguguaccgggacgaggcucugaacaaucgauuccagaucaagggagucgaacucaaaagugguuacaaggauuggauucuguggaucuccuuugccauaagcugcuuccuucuguguguggcauugcucggcuuuaucaugugggccugccaaaaagggaacauucgcuguaauaucugcauuuga

SEQ ID NO: 133272 - RNA, 1701 nt, Artificial Sequence
  derived and/or modified sequence opt3 from hemagglutinin__InfluenzaA__AHL89930
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagucuucaaguacagguggcaucugcgacagcccacaccagauacuagauggggagaacuguacccucaucgacgcucugcuuggagauccgcagugcgacggcuuucaaaauaaaaagugggaucuguucguggaaagauccaaagccuauucuaacuguuaccccuaugacgucccugauuacgcaucguugaggucacucguggccagcagugguacucuggaguuuaauaacgaauccuucaauugggcugggguuacacagaacggaaccucuagcgcaugcaagcggggcuccaauaacucauuuuucagucgccugaauuggcucacgcauagcaaguuuaaauauccagccuuaaacgugacuaugcccaauaacgaggaguucgacaagcuguacauuuggggcguccaccauccugggaccgauaacgaccagaucuuucuuuaugcucaggccucuggacgaauuacaguguccacuaaacguucacaacagaccguaaucccaaauauagguagcagacccaggguucggaacauuccuagucgcaucucuauuuacuggacaaucgugaagccaggcgauaucuugcugauuaauuccaccgggaaccuaauagcgccgagaggauacuucaaaaucaggagcggcaagucgucuauuaugcgguccgacgcacccaucucaaaguguaauagugaaugcauaacgccuaacgguagcauuccaaaugacaaacccuuucagaacgucaaucgcaucacuuauggggccuguccucgauacgugaagcagaacacacucaaacuggcuaccggaaugagaaaugugccagagaagcaaacuaggggcaucuucggcgccauugcaggguuuaucgaaaacggaugggaggguauggucgauggcugguauggguuccggcaccaaaauuccgagggaaugggccaggcugccgaccuuaaaucuacacaggcggccauugaucagauaaacgguaagcugaaucguuugaucgggaaaaccaacgaaaaguuccaccagauugagaaggaauuuagcgagguugaaggccgcauccaggaccucgagaaauacguggaggauacgaagaucgaccuguggucauauaacgcagaauuacugguagcucucgagaaucaacauaccauugaucuuacagacagugaaaugaacaaacuguucgagaagacuaaaaagcaguugagagaaaaugccgaggauaugggaaacggcugcuuuaagauauaccacaaaugugacaaugcuugcaucggguccauuaggaacggaaccuaugaucaugacguguaccgggacgaggcccuaaauaaccgauuccagaucaagggugucgaacugaaaagcggcuacaaggauuggauucucuggaucucuuuugcaauaucaugcuuccugcuuuguguggcccuguugggguuuaucaugugggcuugccagaaaggaaauauucgcuguaacaucugcauuuga

SEQ ID NO: 133273 - RNA, 1701 nt, Artificial Sequence; identical to SEQ ID NO: 123931
  derived and/or modified sequence opt3 from hemagglutinin__InfluenzaA__AHL89942

SEQ ID NO: 133274 - RNA, 1701 nt, Artificial Sequence
  derived and/or modified sequence opt3 from hemagglutinin__InfluenzaA__AHL89954
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugaucaugcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucacuuaaaguuuaaguacccagcacugaaugugaccaugcccaacaacgagaaauucgacaaacuuuauauuuggggaguccaucacccuggcacagauaaugaccagaucuuuuuguacgcccaggcuagcggccguauuacugugucuaccaagagaucccaacagacaguaaucccaaacauagggucaaggccccggguucgcaauauuccuagcagaaucaguauuuauuggaccaucgugaagccaggagauauccugcuaauuaacucuacggguaaucucauagccccgaggggcuacuucaaaauccgguccggaaagagcucgauuaugcgcucugacgcgcccaucgggaaguguaacuccgaaugcauaacuccuaauggcucaauuccaaacgacaaacccuuucagaaugucaaccgaaucacauacggugcauguccuagauaugugaagcagaauacccugaaacuugccacugggaugaggaacgugccagagaagcaaacacggggaaucuucggcgcuauugccggcuuuaucgaaaaugggugggagggaauggucgaugguugguacggcuuccgucaccagaacagugaggggauuggacaggcagcugaccugaaaagcacccaagccgcgauagaucagaucaauggcaaguugaaccgccucauugguaaaacgaacgaaaaguuccaucagaucgagaaggaauuuuccgagguugaagggagaauccaggaccuggagaaauauguggaggauaccaagauugacuuauggucuuacaaugccgaacugcucguagcacuugagaaccaacacacaauagaucugacugacagcgaaaugaauaaauuguucgagaagaccaaaaagcagcuaagggaaaacgcugaggauaugggcaauggaugcuuuaagaucuaucauaaaugugacaacgccugcauuggcucaauccggaaugggacauacgaucacgacguguaucgagacgaggcucugaacaaucgcuuccagauuaagggagucgaacucaaaagugguuacaaggauuggauccuguggauauccuuugccaucagcugcuuccuucuguguguggcauugcucggcuuuauuaugugggccugccagaaagggaacaucagauguaauauuugcaucuga

SEQ ID NO: 133275 - RNA, 1701 nt, Artificial Sequence; identical to SEQ ID NO: 123944
  derived and/or modified sequence opt3 from hemagglutinin__InfluenzaA__AHL89966

SEQ ID NO: 133276 - RNA, 1701 nt, Artificial Sequence; identical to SEQ ID NO: 123944
  derived and/or modified sequence opt3 from hemagglutinin__InfluenzaA__AHL89978

SEQ ID NO: 133277 - RNA, 1701 nt, Artificial Sequence; identical to SEQ ID NO: 124003
  derived and/or modified sequence opt3 from hemagglutinin__InfluenzaA__AHL89990

SEQ ID NO: 133278 - RNA, 1701 nt, Artificial Sequence
  derived and/or modified sequence opt3 from hemagglutinin__InfluenzaA__AHL90002
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagucuucaaguacagguggcaucugcgacagcccacaccagauacuagauggggagaacuguacccucaucgacgcucugcuuggagauccgcagugcgacggcuuucaaaauaaaaagugggaucuguucguggaaagauccaaagccuauucuaacuguuaccccuaugacgucccugauuacgcaucguugaggucacucguggccagcagugguacucuggaguuuaauaacgaauccuucaauugggcugggguuacacagaacggaaccucuagcgcaugcaagcggggcuccaauaacucauuuuucagucgccugaauuggcucacgcauagcaaguuuaaauauccagccuuaaacgugacuaugcccaauaacgaggaguucgacaagcuguacauuuggggcguccaccauccugggaccgauaacgaccagaucuuucuuuaugcucaggccucuggacgaauuacaguguccacuaaacguucacaacagaccguaaucccaaauauagguagcagacccaggguucggaacauuccuagucgcaucucuauuuacuggacaaucgugaagccaggcgauaucuugcugauuaauuccaccgggaaccuaauagcgccgagaggauacuucaaaaucaggagcggcaagucgucuauuaugcgguccgacgcacccaucgguaaguguaauucagaaugcauaacgccuaacgggaguauuccaaaugacaaacccuuucagaacgucaaucgcaucacuuauggagccuguccucgauacgugaagcagaacacacucaaacuggcuaccggcaugagaaaugugccagagaagcaaacuaggggcaucuucggggccauugcaggauuuaucgaaaacgguugggagggcauggucgaugggugguauggauuccggcaccagaauagcgagggcaugggucaggcugccgaccuuaaauccacacaagcggccauugaucagauaaacgggaagcugaaucguuugaucggcaaaaccaacgaaaaguuccaccagauugagaaggaauuuucugagguugaaggacgcauccaggaccucgagaaauacguggaggauacgaagaucgaccuguggagcuauaacgcagaauuacugguagcucucgagaaucaacauaccauugaucuuacagacucagaaaugaacaaacuguucgagaagacuaaaaagcaguugagagaaaaugccgaggauaugggcaacgggugcuuuaagauauaccacaaaugugacaaugcuugcaucggaaguauuaggaacgguaccuaugaucaugacguguaccgggacgaggcccuaaauaaccgauuccagaucaagggcgucgaacugaaauccggguacaaggauuggauucucuggaucagcuuugcaauaucuugcuuccugcuuuguguggcccuguugggauuuaucaugugggcuugccagaaaggcaauauucgcuguaacaucugcauuuga

SEQ ID NO: 133279 - RNA, 1701 nt, Artificial Sequence
  derived and/or modified sequence opt3 from hemagglutinin__InfluenzaA__AHL90014
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaguggagguaacuaacgcgaccgaacuggugcagucuucaaguacaggugagaucugcgacagcccacaccagauucuagauggcgaaaauuguacccucaucgacgcucugcuuggggauccgcagugcgacggauuucaaaacaaaaagugggaucuguucgucgagagauccaaagccuauucuaauuguuaccccuaugacgugccugauuacgcaucguugaggucacucguugccagcaguggcacucuggaauuuaacaaugaguccuucaacuggacaggugugacccagaaugggacgucuagcgcuugcauacggcgcuccaacaauucauuuuucagucgacugaacuggcucacucauuuaaaguuuaaguauccagcacugaaugucaccaugcccaacaacgagaaauucgacaaguuguacaucuggggagugcaccauccuggcacagauaaugaccagauuuuucuuuaugcccaggcuagcggccguaucacuguaucuaccaaaagaucccaacagacaguuauuccaaacaucgggucaaggccccgggugcgcaauauaccuagcagaauuaguaucuacuggaccauugucaagccaggagauauccugcuaaucaacucuacggguaaucucauugccccgaggggcuacuucaaaauacgguccggaaagagcucgaucaugcgcucugacgcgcccauugggaaguguaacuccgaaugcaucacuccuaauggcucaauaccaaacgacaaacccuuucagaaugugaaccgaauuacauauggugcauguccuagauacgugaagcagaauacccugaaacuugccacugggaugaggaacgucccagagaagcaaacacggggaaucuucggcgcuaucgccggcuuuauugaaaaugggugggagggaaugguugaugguugguauggcuuccgucaccagaacagugaggggaucggacaggcagcugaccugaaaagcacccaagccgcgauugaucagauaaauggcaaguugaaccgccucaucgguaaaacgaacgaaaaguuccaccagauugagaaggaauuuuccgagguggaagggagaauccaggaccuggagaaauacguagaggauaccaagaucgacuuauggucuuauaaugccgaacugcucguggcacuugagaaccaacauacaauugaucugacugacagcgaaaugaauaaauuguucgagaagaccaaaaagcagcuaagggaaaacgcugaggauaugggcaauggaugcuuuaagauauaccacaaaugugacaacgccugcaucggcucaauucggaaugggacauaugaucaugacgucuaccgagacgaggcucugaacaaucgcuuccagaucaagggaguggaacucaaaagugguuacaaggauuggauucuguggaucuccuuugccauaagcugcuuccuucuguguguugcauugcucggcuuuaucaugugggccugccagaaagggaacauuagauguaauaucugcauuuga

SEQ ID NO: 133280 - RNA, 1701 nt, Artificial Sequence; identical to SEQ ID NO: 133279
  derived and/or modified sequence opt3 from hemagglutinin__InfluenzaA__AHL90026

SEQ ID NO: 133281 - RNA, 1701 nt, Artificial Sequence
  derived and/or modified sequence opt3 from hemagglutinin__InfluenzaA__AHL90050
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuacuucaaaauccgguccggaaagagcucgauuaugcgcucugacgcgcccaucgggaaguguaacuccgaaugcauaacuccuaauggcucaauuccaaacgacaaacccuuucagaaugucaaccgaaucacauauggugcauguccuagauacgugaagcagaauacccugaaacuugccacugggaugaggaacgugccagagaagcaaacacggggaaucuucggcgcuauugccggcuuuaucgaaaaugggugggagggaauggucgaugguugguauggcuuccgucaccagaacagugaggggauuggacaggcagcugaccugaaaagcacccaagccgcgauagaucagaucaauggcaaguugaaccgccucauugguaaaacgaacgaaaaguuccaccagaucgagaaggaauuuuccgagguugaagggagaauccaggaccuggagaaauacguggaggauaccaagauugacuuauggucuuauaaugccgaacugcucguagcacuugagaaccaacauacaauagaucugacugacgcugaaaugaauaaauuguucgagaagaccaaaaagcagcuaagggaaaacgccgaggauaugggcaauggaugcuuuaagaucuaccacaaaugugacaacgcuugcauuggcagcauccggaaugggacauaugaucaugacguguaccgagacgaggcccugaacaaucgcuuccagauuaagggagucgaacucaaaucagguuacaaggauuggauccuguggauaaguuuugcaaucuccugcuuccuucuguguguggccuugcucggcuuuauuaugugggcuugccagaaagggaacaucagauguaauauuugcaucuga

SEQ ID NO: 133282 - RNA, 1701 nt, Artificial Sequence
  derived and/or modified sequence opt3 from hemagglutinin__InfluenzaA__AHL90062
augaagaccaucauugcccugagcuacauacucugccuuguguucgcucagaaacugcccgagaacgacaauuccacagcaacuuuguguuuaggccaccaugccgucccuaacgggacgaucguuaagaccauuacaaaugaucaaaucgaagugacuaacgcgaccgagcugguacagucuucaaguacaggagaaauuugcgacagcccacaccagauccuagauggugagaauuguacccucauagacgcucugcuuggcgauccgcagugcgacggguuucaaaacaaaaagugggaucuguucguggaaagauccaaagccuauucuaauuguuaccccuaugacgucccugauuacgcaucguugaggucacucguggccagcaguggaacucuggaguuuaacaaugaguccuucaacuggacaggcguuacccagaaugguacgucuagcgcuugcauccggcgcuccaacaauucauuuuucagucgacugaacuggcucacucauuuaaaguuuaaguauccagcacugaaugugaccaugcccaacaacgaaaaauucgacaaacuuuacauuuggggaguccaccauccugggacagauaaugaccagaucuuuuuguaugcccaggcuagcggccguauuacugugucuaccaagagaucccaacagacaguaaucccaaacauaggcucaaggccccggguucgcaauauuccuagcagaaucaguauuuacuggaccaucgugaagccaggggauauccugcuaauuaacucuacgggaaaucucauagccccgagggguuacuucaaaauccgguccggcaagagcucgauuaugcgcucugacgcgcccaucgggaaguguaacuccgagugcauaacuccuaauggaucaauuccaaacuauaaacccuuucagaaugucaaccgaaucacauacggcgcauguccuagauaugugaagcagaauacccugaaacuugccacugguaugaggaacgugccagaaaagcaaacacgggggaucuucggagcuauugccggcuuuaucgagaauggcugggaggggauggucgacggaugguacgguuuccgucaccagaacagugaaggcauugggcaggcagcugaucugaaaagcacccaagccgcgauagaccagaucaauggaaaguugaaccgccucauuggcaaaacgaacgagaaguuccaccagaucgaaaaggaguuuuccgaaguugaggguagaauccaggaucuggagaaauauguggaagacaccaagauugauuuauggucuuacaaugccgagcugcucguagcacuugaaaaccaacauacaauagaccugacugauagcgagaugaauaaauuguucgaaaagaccaaaaagcagcuaagggagaacgcugaggacauggggaauggcugcuuuaagaucuaucacaaaugugauaacgccugcauuggaucaauccggaauggcacauacgaccaugauguguaccgagacgaagcucugaacaaucgcuuccagauuaagggggucgagcucaaaaguggauauaaggacuggauccuguggauauccuuugccaucagcugcuuccuucuguguguggcauugcucgguuuuauuaugugggccugccagaaaggcaacaucagauguaauauuugcaucuga

SEQ ID NO: 133283 - RNA, 1701 nt, Artificial Sequence; identical to SEQ ID NO: 123944
  derived and/or modified sequence opt3 from hemagglutinin__InfluenzaA__AHL90074

SEQ ID NO: 133284 - RNA, 1701 nt, Artificial Sequence
  derived and/or modified sequence opt3 from hemagglutinin__InfluenzaA__AHL90086
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuauaacaauuccuuuuucucacgacugaacuggcucacucauuuaaaguuuaaguacccagcacugaaugugaccaugcccaacaacgagaaauucgacaaacuuuauauuuggggaguccaccauccuggcacagauaaugaccagaucuuuuuguacgcccaggcuaguggccguauuacugugagcaccaagagaucucaacagacaguaaucccaaacauaggguccaggccccggguucgcaauauuccuucaagaaucagcauuuacuggaccaucgugaagccaggagauauccugcuaauuaacaguacggguaaucucauagccccgaggggcuauuucaaaauccggucugggaaguccagcauuaugcgcucggacgcgcccaucggaaaguguaacucugaaugcauaacuccuaauggcuccauuccaaacgacaaacccuuucagaaugucaaccgaaucacauacggugcauguccuagauaugugaagcagaauacccugaaacuugccacugggaugaggaacgugccagagaagcaaacacggggaaucuucggcgcuauugccggcuuuaucgaaaaugggugggagggaauggucgaugguugguacggcuuccgucaccagaacucagaggggauuggacaggcagcugaccugaaaaguacccaagccgcgauagaucagaucaauggcaaguugaaccgccucauugguaaaacgaacgaaaaguuccaccagaucgagaaggaauuuagcgagguugaagggagaauccaggaccuggagaaauauguggaggauaccaagauugacuuaugguccuacaaugccgaacugcucguagcacuugagaaccaacauacaauagaucugacugacucugaaaugaauaaauuguucgagaagaccaaaaagcagcuaagggaaaacgcugaggauaugggcaauggaugcuuuaagaucuaucacaaaugugacaacgccugcauuggcagcauccggaaugggacauacgaucaugacguguaccgagacgaggcucugaacaaucgcuuccagauuaagggagucgaacucaaaucagguuauaaggauuggauccuguggauaaguuuugccaucuccugcuuccuucuguguguggcauugcucggcuuuauuaugugggccugccagaaagggaacaucagauguaauauuugcaucuga

SEQ ID NO: 133285 - RNA, 1701 nt, Artificial Sequence
  derived and/or modified sequence opt3 from hemagglutinin__InfluenzaA__AHL90098
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggggcuccgacaacucauuuuucagucgccugaauuggcucacucauuuaaaguuuaaauauccagcacugaacgugaccaugcccaauaacgagaaguucgauaaacuuuacaucuggggcguccaccauccugggacagacaacgaucagaucuuuuuguaugcccaggcuagcggacgaauuacugugucuaccaagcguucccaacagacaguaauuccaaauaucgguucaagacccaggguucggaacauaccuagccgcauuaguaucuacuggaccauugugaaaccaggcgacauccugcuaaucaauucuacggggaaccucauugccccgagaggauacuucaagauaagguccggcaagagcucgaucaugcggucugacgcgcccauugauaaauguaauuccgagugcaucacuccuaacgguucaauaccaaaugacaagcccuuucagaacgucaaucgcauuacauauggggcauguccucgauacgugaaacagaacacccugaagcuggccacuggaaugagaaaugugccagaaaaacaaacaaggggcaucuucggcgcuaucgccggguuuauugagaacggaugggaagguauggucgauggcugguauggguuccggcaccagaauagugagggaaucggccaggcagcugaccuuaagagcacccaagccgcgauuaaccagauaaaugguaaauugaaccgucucaucgggaagacgaacgagaaguuccaccagauugaaaaagaguuuuccgaaguugagggccgcauccaggaucuggaaaaguacguggaggacaccaaaaucgauuuauggucuuauaaugccgagcugcucguagcacuugaaaaccaacauacaauugaccugacugauagcgagaugaauaaguuguucgaaagaaccaaaaagcagcuaagggagaacgcugaagacaugggaaauggcugcuuuaagauauaccacaaaugugauaacgccugcaucgggucaauucggaauggaacauaugaccaugacguguaccgagaugaggcucugaacaaucgcuuccagaucaagggugucgagcucaaaaguggcuacaaggacuggauucuguggaucuccuuugccauaagcugcuuccuucuguguguggcauugcucggguuuaucaugugggccugccagaaaggaaacauuagauguaauaucugcauuuga

SEQ ID NO: 133286 - RNA, 1701 nt, Artificial Sequence
  derived and/or modified sequence opt3 from hemagglutinin__InfluenzaA__AHL90110
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuacuucaaaauccaguccggaaagagcucggucaugcggucugacgcgcccauugggaaguguaacuccgaaugcaucacuccuaauggcucaauaccaaacgacaaacccuuucagaaugugaaccgcauuacauauggugcauguccucgauacgugaagcaaaauacccugaaacuugccacugggaugagaaacgucccagagaagcagacaaggggaaucuucggcgcuaucgccggcuuuauugaaaaugggugggagggaaugguugaugguugguauggcuuccggcaccagaacagugaggggaucggacaagcagcugaccugaaaagcacccaggccgcgauugaucagauaaauggcaaguugaaccgucucaucgguaaaacgaacgaaaaguuccaccagauugagaaggaauuuuccgagguggaagggcgcauccaagaccuggagaaauacguagaggauaccaagaucgacuuauggucuuauaaugccgaacugcucguggcacuugagaaccagcauacaauugaucugacugacagcgaaaugaauaaauuguucgagaagaccaaaaagcagcuaagagaaaacgcugaggauaugggcaauggaugcuuuaagauauaccacaaaugugacaacgccugcaucggcucaauuaggaaugggacauaugaucaugacgucuaccgggacgaggcucugaacaaucgauuccagaucaagggaguggaacucaaaagugguuacaaggauuggauucuguggaucuccuuugccauaagcugcuuccuucuguguguugcauugcucggcuuuaucaugugggccugccaaaaagggaacauucgcuguaauaucugcauuuga

SEQ ID NO: 133287 - RNA, 1698 nt, Artificial Sequence; identical to SEQ ID NO: 126111
  derived and/or modified sequence opt3 from hemagglutinin__InfluenzaA__AHL90122

SEQ ID NO: 133288 - RNA, 1698 nt, Artificial Sequence; identical to SEQ ID NO: 124504
  derived and/or modified sequence opt3 from hemagglutinin__InfluenzaA__AHL90133

SEQ ID NO: 133289 - RNA, 1698 nt, Artificial Sequence; identical to SEQ ID NO: 126111
  derived and/or modified sequence opt3 from hemagglutinin__InfluenzaA__AHL90145

SEQ ID NO: 133290 - RNA, 1698 nt, Artificial Sequence
  derived and/or modified sequence opt3 from hemagglutinin__InfluenzaA__AHL90157
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaagcccuguaccauacggagaaugcuuacgucuccguggugucaagccacuauagucgcaaguucacucccgaaauagcaaagcgaccuaaaguccgugaucaggagggaagaaucaacuacuauuggacccuucuggagccaggugacacaauuaucuuugaagccaauggcaacuugauugcuccgagguacgccuucgcgcucucucggggguuuggauccggcaucauaaauagcaacgcacccauggauaagugugacgccaaaugccagacuccucaaggugcuauuaauucgucucugccauuccagaacguucaucccgugaccaucggggaguguccuaaguauguacgcuccgccaaauuaagaauggugacaggacugaggaauauuccaucaauccagagucggggccucuuuggcgcaaucgcuggguucauugaaggagguuggaccggcauggucgaugggugguacggauaucaccaccagaacgagcaaggcagcgguuacgccgcggaccagaaguccacgcagaaugccauaaacgggaucacuaauaaagugaacucuguuauugaaaagaugaauacacaguuuaccgcagugggcaaggaguucaacaaacuugagcgccgaauggaaaaccugaauaagaaagucgaugacggauucaucgauauauggacuuacaacgcugaguugcuagugcugcucgaaaaugagagaacacuggacuuucaugacagcaacguaaagaaucuuuaugaaaaaguuaagauucaacugaagaacaaugccaaagagaucggcaacgggugcuucgaguuuuaccacaaguguaaugaugaaugcauggagucagugaaaaacggaaccuaugacuaccccaaguauagugaagaguccaaauugaauagggagaagaucgauggugucaagcucgaaagcaugggcguguaccagauucuggcuaucuauucuacgauugccucaaguuuaguccugcuagugagccucggggcaauauccuucuggaugugcucuaacggaucgcugcagugucggaucugcauuuga

SEQ ID NO: 133291 - RNA, 1698 nt, Artificial Sequence; identical to SEQ ID NO: 126111
  derived and/or modified sequence opt3 from hemagglutinin__InfluenzaA__AHL90169

SEQ ID NO: 133292 - RNA, 1698 nt, Artificial Sequence
  derived and/or modified sequence opt3 from hemagglutinin__InfluenzaA__AHL90181
augaaggugaaacugcucguccuucugugcaccuucgccgcuacauacgcagacacuaucuguauuggcuaucacgccaacaauagcacggauaccguugacacaguguuggagaagaacguaacugugacccauuccgucaauuuacuggaaaacucucacaaugggaaacuaugccuccugaagggaauagcgccccuucagcuggguaacuguucaguggcuggcuggaucuuggggaauccugagugcgaacuccugauuaguaaagagagcugguccuacaucguugaaaagccaaacccgaagaauggaacauguuaucccggccauuuugccgauuacgaggagcugagagaacaacucucuucggugagcucauucgagagguuugaaauuuucccuaaagagaguuccuggccaaaccacaccgucacuggugugucugcaagcugcucccauaauggggagucaaguuuuuaucggaacuuacuguggcuuacaggaaagaauggcuuguaccccaaccugagcaaaucuuaugccaauaacaaggaaaaagagguucuaguacucuggggcgugcaccacccuccaaacaucggggaccagaaggcucuguaccauaccgaaaaugcauacgucuccguggugucaagccacuauagucgcaaguucacgcccgagauagccaaacgaccuaagguccgugaucaggaaggaagaaucaacuacuauuggacucuucuggagccaggugacaccauuaucuuugaggcuaauggcaacuugauugccccgagguacgcguucgcacucucucggggguuuggauccggcaucauaaauagcaacgcccccauggauaaaugugacgcuaagugccagacaccucaaggugccauuaauucgucucugccauuccagaacguucaucccgugacuaucggggaauguccuaaauauguacgcuccgcaaaguuaagaauggugaccggacugaggaauauuccaucaauccagagucggggccucuuuggcgcuaucgccggguucauugagggagguuggacaggcauggucgaugggugguacggauaucaccaccagaacgaacaaggcagcgguuacgcggccgaccagaaauccacccagaaugcaauaaacgggaucacgaauaaggugaacucuguuauugagaagaugaauacucaguuuacagcugugggcaaagaguucaacaaacuugaacgccgaauggagaaccugaauaaaaaggucgaugacggauucaucgauauauggaccuacaacgccgaauugcuagugcugcucgagaaugaaagaacucuggacuuucaugacagcaacguaaagaaucuuuaugagaagguuaagucacaacugaaaaacaaugcuaaggaaauuggcaacgggugcuucgaguuuuaccacaaauguaaugaugagugcauggaaagugugaagaacggaacauaugacuaccccaaauauuccgaggaaagcaaguugaauagggagaagaucgauggugucaaacucgagucuaugggcguguaccagauccuggccauuuauucaaccgucgcaaguagcuuagugcugcuaguuucccucggggccaucucuuucuggaugugcucgaacggaagccugcagugucggauuugcauauga

SEQ ID NO: 133293 - RNA, 1698 nt, Artificial Sequence; identical to SEQ ID NO: 125186
  derived and/or modified sequence opt3 from hemagglutinin__InfluenzaA__AHL90217

SEQ ID NO: 133294 - RNA, 1698 nt, Artificial Sequence; identical to SEQ ID NO: 125186
  derived and/or modified sequence opt3 from hemagglutinin__InfluenzaA__AHL90229

SEQ ID NO: 133295 - RNA, 1698 nt, Artificial Sequence
  derived and/or modified sequence opt3 from hemagglutinin__InfluenzaA__AHL90241
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuccaaaagagaguuggagcuacaucguugaaaagccgaaccccgagaauggaaccuguuauccuggccauuuugcugauuacgaggaacugagagagcaacucuccucugugucgucauucgaaagguuugagauuuucccaaaggagagcaguuggcccaaccacacugucacagguguguccgccucuugcagccauaauggggaauccucauuuuaucggaacuuacuguggcuuaccggaaagaauggcuuguacccuaaccugaguaagagcuaugcaaauaacaaagagaaggaaguucuaguacucuggggcgugcaccacccacccaacaucggggaccagaaagcccuguaccauacggagaaugcuuacgucucugugguguccucacacuauagccgcaaguucacuccugaaauagcaaagcgaccaaaaguccgugaucaggagggaagaaucaacuacuauuggacccuucuggagccgggugacacaauuaucuuugaagccaauggcaacuugauugcucccagguacgccuucgcgcucagucggggguuuggaucuggcaucauaaauuccaacgcaccuauggauaagugugacgccaaaugccagacuccacaaggugcuauuaauagcucgcugcccuuccagaacguucauccugugaccaucggggaguguccaaaguauguacgcucugccaaauuaagaauggugacaggacugaggaauauucccuccauccagucacggggccucuuuggcgcaaucgcuggguucauugaaggagguuggaccggcauggucgaugggugguacggauaucaccaccagaacgagcaaggcagugguuacgccgcggaccagaaaagcacgcagaaugccauaaacgggaucacuaauaaagugaacuccguuauugaaaagaugaauacacaguuuaccgcagugggcaaggaguucaacaaacuugagcgccgaauggaaaaccugaauaagaaagucgaugacggauucaucgauauauggacuuacaacgcugaguugcuagugcugcucgaaaaugagagaacacuggacuuucaugacucuaacguaaagaaucuuuaugaaaaaguuaagagccaacugaagaacaaugccaaagagauuggcaacgggugcuucgaguuuuaccacaaguguaaugaugaaugcauggagucagugaaaaacggaaccuaugacuacccgaaguauagugaagaguccaaauugaauagggagaagaucgauggugucaagcucgaaagcaugggcguguaccagauccuggcuauuuauucuacggucgccucaaguuuagugcugcuaguuagccucggggcaaucuccuucuggaugugcucuaacggaucgcugcagugucggauuugcauauga

SEQ ID NO: 133296 - RNA, 1698 nt, Artificial Sequence
  derived and/or modified sequence opt3 from hemagglutinin__InfluenzaA__AHL90253
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggguaguuccuggccaaaccacacugucacaggggugucugccagcugcucccauaauggagagucaaguuuuuaucggaacuuacuguggcuuaccggcaaaaauggcuuguaccccaaccugagcaagucuuaugcaaauaacaaagaaaaggagguucuaguacucuggggagugcaccacccuccaaacaucggggaccagaaaacgcuguaccauacugaaaaugccuacgucuccguggugucaagccacuauagucgcaaguucacccccgagauagcuaagcgaccuaaaguccgugaucaggaagguagaaucaacuacuauuggacacuucuggagccaggcgacacuauuaucuuugaggcaaaugggaacuugauugccccgagguacgcuuucgcccucucucggggauuuggcuccgguaucauaaauagcaacgcgcccauggauaagugugacgcaaaaugccagaccccucaaggggccauuaauucgucucugccauuccagaacguucaucccgugacaaucggagaauguccuaaguauguacgcuccgcuaaauuaagaauggugaccggccugaggaauauuccaucaauccagagucggggccucuuuggggccaucgcaggauucauugaggguggcuggacggggauggucgauggaugguacggcuaucaccaccagaacgaacaagguagcggguacgcugccgaccagaaguccacucagaaugcgauaaacggcaucacaaauaaagugaacucuguuauugagaagaugaauacccaguuuacugccgugggaaaggaguucaacaaacuugaacgccgaauggagaaccugaauaagaaagucgaugacggcuucaucgauauauggacauacaacgcagaauugcuagugcugcucgagaaugaaagaacccuggacuuucaugacagcaacguaaagaaucuuuaugagaaaguuaagucacaacugaagaacaaugcuaaagaaauugggaacggaugcuucgaguuuuaccacaaguguaaugaugagugcauggaaagugugaaaaacgguacguaugacuaccccaaguauuccgaggucagcaaauugaauagggaaaagaucgauggcgugaagcucgagucuaugggggucuaccagauccuggccauuuauucaaccguggcuaguagcuuaguucugcuagugucccucggagccaucucuuucuggaugugcucgaacggcagccugcagugucggauuugcauauga

SEQ ID NO: 133297 - RNA, 1698 nt, Artificial Sequence; identical to SEQ ID NO: 124504
  derived and/or modified sequence opt3 from hemagglutinin__InfluenzaA__AHL90265

SEQ ID NO: 133298 - RNA, 1698 nt, Artificial Sequence
  derived and/or modified sequence opt3 from hemagglutinin__InfluenzaA__AHL90277
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgucgaccagaaaacgcuguaccauacugagaaugccuacguguccguggucucaagccacuauagucgcaaguucacccccgaaauagcuaagcgaccuaaaguucgugaucaggaggggagaaucaacuacuauuggacacuucuggagccaggagacacuauuaucuuugaagcaaaugguaacuugauugccccgagguacgcuuucgcccucucucggggcuuuggguccggaaucauaaauagcaacgcgcccauggauaagugugacgcaaaaugccagaccccucaaggcgccauuaauucgucucugccauuccagaacgugcaucccguaacaaucggugaguguccuaaguaugugcgcuccgcuaaauuaagaauggucaccgggcugaggaauauuccaucaauccagagucggggacucuuuggcgccaucgcaggcuucauugaagggggauggacggguaugguggauggcugguacggguaucaccaccagaacgagcaaggaagcggcuacgcugccgaccagaaguccacucagaaugcgauaaacgguaucacaaauaaaguuaacucugugauugaaaagaugaauacccaguuuacugccgucgggaaggaguucaacaaacuugagcgccgaauggaaaaccugaauaagaaaguggaugacggcuucaucgauauauggacauacaacgcagaguugcuaguacugcucgaaaaugagagaacccuggacuuucaugacagcaacguuaagaaucuuuaugaaaaagugaagucacaacugaagaacaaugcuaaagagauuggaaacggcugcuucgaguuuuaccacaaguguaaugaugaaugcauggagagugucaaaaacgggacguaugacuaccccaaguauuccgaagagagcaaauugaauagggagaagaucgauggagugaagcucgaaucuaugggugucuaccagauccuggccauuuauucaaccguggcuaguagcuuaguucugcuagugucccucggcgccaucucuuucuggaugugcucgaacgggagccugcagugucggauuugcauauga

SEQ ID NO: 133299 - RNA, 1698 nt, Artificial Sequence
  derived and/or modified sequence opt3 from hemagglutinin__InfluenzaA__AHL90289
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaagcccuguaccauacggagaaugcuuacgucuccguggugucaagccacuauagucgcaaguucacucccgaaauagcaaagcgaccuaaaguccgugaucaggagggaagaaucaacuacuauuggacccuucuggagccaagggacacaauuaucuuugaagccaaugguaacuugauugcuccgcgguacgccuucgcgcucucucgcggcuuuggguccggaaucauaaauagcaacgcacccauggauaagugugacgccaaaugccagacuccucaaggcgcuauuaauucgucucugccauuccagaacguucaucccgugaccaucggugaguguccuaaguauguaagauccgccaaauuaaggauggugacagggcugcggaauauuccaucaauccagagucgcggacucuuuggcgcaaucgcuggcuucauugaagggggauggaccgguauggucgauggcugguacggguaucaccaccagaacgagcaaggaagcggcuacgccgcggaccagaaguccacgcagaaugccauaaacgguaucacuaauaaagugaacucuguuauugaaaagaugaauacacaguuuaccgcaguggggaaggaguucaacaaacuugagcgaagaauggaaaaccugaauaagaaagucgaugacggcuucaucgauauauggacuuacaacgcugaguugcuagugcugcucgaaaaugagaggacacuggacuuucaugacagcaacguaaagaaucuuuaugaaaaaguuaagucacaacugaagaacaaugccaaagagauuggaaacggcugcuucgaguuuuaccacaaguguaaugaugaaugcauggagagugugaaaaacgggaccuaugacuaccccaaguauuccgaagagagcaaauugaaucgggagaagaucgauggagucaagcucgaaucuauggguguguaccagauccuggcuauuuauucaacggucgccaguagcuuagugcugcuaguuucccucggcgcaaucucuuucuggaugugcucgaacgggagccugcagugucguauuugcauauga

SEQ ID NO: 133300 - RNA, 1698 nt, Artificial Sequence; identical to SEQ ID NO: 133299
  derived and/or modified sequence opt3 from hemagglutinin__InfluenzaA__AHL90301

SEQ ID NO: 133301 - RNA, 1698 nt, Artificial Sequence
  derived and/or modified sequence opt3 from hemagglutinin__InfluenzaA__AHL90325
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaagcccuguaccauacggagaaugcuuacgucuccguggugucaagccacuauagucgcaaguucacucccgaaauagcaaagcgaccuaaaguccgugaucaggagggaagaaucaacuacuauuggacccuucuggagccaggugacacaauuaucuuugaagccaauggcaacuugauugcuccgagguacgccuucgcgcucucucggggguuuggauccggcaucauaaauagcaacgcacccauggauaagugugacgccaaaugccagacuccucaaggugcuauuaauucgucucugccauuccagaacguucaucccgugaccaucggggaguguccuaaguauguacgcuccgccaaauuaagaauggugacaggacugaggaauauuccaucaauccagagucggggccucuuuggcgcaaucgcuggguucauugaaggagguuggaccggcauggucgaugggugguacggauaucaccaccagaacgagcaaggcagcgguuacgccgcggaccagaaguccacgcagaaugccauaaacgggaucacuaauaaagugaacucuguuauugaaaagaugaauacacaguuuaccgcagugggcaaggaguucaacaaacuugagcgccgaauggaaaaccugaauaagaaagucgaugacggauucaucgauauauggacuuacaacgcugaguugcuagugcugcucgaaaaugagagaacacuggacuuucaugacagcaacguaaagaaucuuuaugaaaaaguuaagucacaacugaagaacaaugccaaagagaugggcaacgggugcuucgaguuuuaccacaaguguaaugaugaaugcauggagagugugaaaaacggaaccuaugacuaccccaaguauuccgaagagagcaaauugaauagggagaagauugauggugucaagcucgaaucuaugggcguguaccagauccuggcuaucuauucaacggucgccaguagcuuagugcugcuaguuucccucggggcaauuucuuucuggaugugcucgaacggaagccugcagugucggaucugcauuuga

SEQ ID NO: 133302 - RNA, 1698 nt, Artificial Sequence; identical to SEQ ID NO: 133301
  derived and/or modified sequence opt3 from hemagglutinin__InfluenzaA__AHL90337

SEQ ID NO: 133303 - RNA, 1698 nt, Artificial Sequence; identical to SEQ ID NO: 124504
  derived and/or modified sequence opt3 from hemagglutinin__InfluenzaA__AHL90349

SEQ ID NO: 133304 - RNA, 1698 nt, Artificial Sequence; identical to SEQ ID NO: 124504
  derived and/or modified sequence opt3 from hemagglutinin__InfluenzaA__AHL90361

SEQ ID NO: 133305 - RNA, 1698 nt, Artificial Sequence; identical to SEQ ID NO: 133298
  derived and/or modified sequence opt3 from hemagglutinin__InfluenzaA__AHL90373

SEQ ID NO: 133306 - RNA, 1701 nt, Artificial Sequence
  derived and/or modified sequence opt3 from hemagglutinin__InfluenzaA__AHL90385
augaagaccaucauugcccugagcuacauacagugccucguguucgcucaaaaauuucccggcaacgacaauuccacagcaacucuuugucuggggcaccaugccgucccuaacggaacgaucguuaagaccauuacaaaugaucagaucgaggugacuaacgcgaccgaauugguacagucuucaaguacaggugagauuugcgacagcccacaccagaucuuagauggcgaaaauuguacccugauagacgcucuacucggggauccgcaaugcgacggauuccagaacaaaaauugggaucuguuuguggagagauccaaggccuauucuaacuguuaccccuaugacgucccugauuacgcaucgcuuaggucacugguggccagcaguggcacuuuggaguucaauaacgaauccuuuaauuggacagguguuacccagaacgggacgucuagcgcuugcauccggcgcuccaauaacucauucuuuagucgacucaauuggcugacucauagcaaauucaaguauccagcacugaacgugaccaugcccaacaaugagaacuuugacaagcucuacauuuggggaguccaccauccuggcacagauaaugaccagaucuucuuauaugcccaagcuagcggccguauuacuguguccaccaaaagaucacagcagacaguaaucccaaacauagggagcaggccccggguucgcaauauuccuaguagaaucucuauuuacuggaccaucgugaagccaggagauauccugcuuauuaacuccacggguaauuugauagccccgaggggcuacuuuaaaauccggagcgggaagucgucuauuaugcgcuccgacgcgcccaucggaaaauguaacucagaaugcauaacuccuaauggcaguauuccaaacgacaagcccuuccagaaugucaaccgaaucacauauggugcauguccuagauacgugaagcaaaauacccugaaacuagccacugggaugaggaacgugccagagaagcagacacggggaaucuuuggcgcuauugccggcuucaucgaaaaugggugggagggaauggucgaugguugguauggcuuccgucaccagaacagcgaggggauuggacaagcagcugaccucaaauccacccaggccgcgauagaucagaucaacggcaagcugaaucgccuuauugguagaacgaacgaaaaauuucaccagaucgagaaggaguucucugaaguugaagggaggauccaagaccuggagaaauacguggaggauaccaagauugacuuguggagcuauaaugccgaacuccugguagcauuagagaaccagcauacaauagaucugacugacucagaaaugaauaagcucuuugagaaaaccaagaaacagcuucgggaaaacgcugaggauaugggcaauggaugcuucaagaucuaccacaaaugugacaacgccugcauuggcaguauccgaaaugggacauaugaucaugacguguaccgcgacgaggcucugaacaauagauuucagauuaagggagucgaauugaaguccgguuacaaagauuggauccuauggauaucuuucgccaucucuugcuuucugcucuguauugcacugcuuggcuucaucaugugggccugccaaaaggggaacauuagguguaauaucugcauauga

SEQ ID NO: 133307 - RNA, 1701 nt, Artificial Sequence
  derived and/or modified sequence opt3 from hemagglutinin__InfluenzaA__AHL90397
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguuccucagaaugcauaacuccuaacggcaguauuccaaaugacaagcccuuucagaacgucaaucgaaucacauauggugcauguccuagauacgugaaacaaaacacccugaaacuugccacugggaugaggaaugugccagagaagcagacacggggaaucuucggcgcuauugccggcuuuaucgaaaacgggugggagggaauggucgaugguugguauggcuuccgucaccagaauagcgaggggcgcggacaagcagcugaccugaaguccacccaggccgcgauugaucagauaaacggcaaauugaauagacucaucgguaagacgaacgaaaaauuccaccagauugagaaggaauuuucugagguugaagggaggauccaagaccuggagaaguacguggaggauaccaaaaucgacuuauggagcuauaacgccgaacugcucguagcacuugagaaucagcauacaauugaucugacugacucagaaaugaacaaguuguucgagaaaaccaagaaacagcuacgggaaaaugcugaggauaugggcaacggaugcuuuaagauauaccacaagugugacaaugccugcaucggcaguauucgaaacgggacauaugaucaugacguguaccgcgacgaggcucugaauaacagauuccagaucaaaggagucgaacucaaguccgguuacaaagauuggauucuguggaucagcuuugccauaucuugcuuccuucuguguguggcauugcucggcuuuaucaugugggccugccaaaaggggaauauuagguguaacaucugcauuuga

SEQ ID NO: 133308 - RNA, 1701 nt, Artificial Sequence; identical to SEQ ID NO: 124450
  derived and/or modified sequence opt3 from hemagglutinin__InfluenzaA__AHL90410

SEQ ID NO: 133309 - RNA, 1701 nt, Artificial Sequence
  derived and/or modified sequence opt3 from hemagglutinin__InfluenzaA__AHL90422
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauagcaaguuuaaguauccagcauuaaaugugaccaugcccaacaacgaggaguucgacaaacuguacauuuggggaguccaccauccuggcacagauaaugaccagaucuuucuuuaugcccaggcuucuggccguauuacuguguccaccaagagaucacaacagacaguaaucccaaacauagggagcaggccccggguucgcaauauuccuaguagaaucucuauuuacuggaccaucgugaaaccaggagauaucuugcugauuaacuccacggguaaucuaauagccccgaggggcuacuucaagauccggagcgggaaaucgucuauuaugcgcuccgacgcgcccaucggaaaguguaacucagaaugcauaacuccuaauggcaguauuccaaacgacaagcccuuucagaaugucaaccgaaucacauauggugcauguccuagauacgugaaacagaauacccucaagcuggccacugggaugaggaacgugccagaaaaacaaacacggggaaucuucggcgcuauugccggcuuuaucgagaaugggugggagggaauggucgaugguugguauggcuuccgucaccagaacagcgaagggauuggacaggcagcugaccuuaaguccacccaagccgcgauagaucagaucaauggcaaacugaaccgcuugauugguaagacgaacgagaaauuccaccagaucgaaaaggaguuuucugaaguugaggggagaauccaggaccucgagaaguacguggaagauaccaaaauugaccuguggagcuauaaugccgaguuacugguagcacucgaaaaccaacauacaauagaucuuacugacucagagaugaguaagcuguucgaaaagaccaagaaacaguugagggagaaugcugaggauaugggcaacggaugcuuuaagaucuaccacaagugugacaauacaugcauuggcuccauccggaacgggacuuaugaucauaauguguaccgagacgaagcccuaaacaaucgcuuccagauuaaaggagucgagcugaaaagcgguuacaaagacuggauccucuggauaucuuuugcuaucucaugcuuccugcuuuguguggcccuguugggcuuuauuaugugggcaugccagaaggggaacaucagauguaauauuugcaucuga

SEQ ID NO: 133310 - RNA, 1701 nt, Artificial Sequence; identical to SEQ ID NO: 124450
  derived and/or modified sequence opt3 from hemagglutinin__InfluenzaA__AHL90434

SEQ ID NO: 133311 - RNA, 1701 nt, Artificial Sequence; identical to SEQ ID NO: 124450
  derived and/or modified sequence opt3 from hemagglutinin__InfluenzaA__AHL90446

SEQ ID NO: 133312 - RNA, 1701 nt, Artificial Sequence
  derived and/or modified sequence opt3 from hemagglutinin__InfluenzaA__AHL90458
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauugugcucucauagacgcccugcuuggggauccgcagugcgacggauuucaaaacaaaaagugggaucuguucguggagagauccaaagcauauucuaauuguuaccccuaugacgucccugauuacgccucguugaggucacucguggcuagcaguggcacccuggaauuuaacaaugaguccuucaacuggacugguguuacacagaaugggaccucuagcgcaugcauccggcgcuccaacaauucauuuuucagucgacugaacuggcucacgcauuuaaaguuuaaguauccagcccugaaugugacuaugcccaacaacgagcaguucgacaaacuuuacauuuggggaguccaccauccuggcaccgauaaugaccagaucuuuuuguaugcucaagccagcggccguauuacagugucuacuaagagaucccagcagaccguaaucccaaacauagggucaaggccccggguucgcaauauuccuagcagaaucaguauuuacuggacaaucgugaaaccaggagauauccugcuaauuaacucuaccgguaaucucauagcgccgaggggcuacuucaagauccgguccgggaaaagcucgauuaugcgcucugacgcacccaucggaaaguguaacuccgaaugcauaacgccuaauggcucaauuccaaacgacaagcccuuucagaaugucaaccgaaucacuuauggugccuguccuagauacgugaaacaaaauacacugaagcuggcuaccgggaugaggaacgugccagagaaacagacucggggaaucuucggcgccauugcaggcuuuaucgaaaaugggugggagggaauggucgaugguugguauggcuuccgucaccagaacagugaggggcgcggacaagcugccgaccuuaagagcacacaggcggccauugaucagauaaauggcaaauugaacagacucaucgguaagaccaacgaaaaauuccaccagauugagaaggaauuuuccgagguugaagggaggauccaagaccuggagaaguacguggaggauacgaaaaucgacuuauggucuuauaaugcagaacugcucguagcucuugagaaccagcauaccauugaucugacagacagcgaaaugaauaaguuguucgagaaaacuaagaaacagcuacgggaaaacgccgaggauaugggcaauggaugcuuuaagauauaccacaagugugacaacgcuugcaucggcucaauucgaaaugggaccuaugaucaugacguguaccgcgacgaggcccugaacaauagauuccagaucaaaggagucgaacucaagagugguuacaaagauuggauucuguggaucuccuuugcaauaagcugcuuccuucuguguguggccuugcucggcuuuaucaugugggcuugccaaaaggggaacauuagguguaauaucugcauuuga

SEQ ID NO: 133313 - RNA, 1701 nt, Artificial Sequence; identical to SEQ ID NO: 124450
  derived and/or modified sequence opt3 from hemagglutinin__InfluenzaA__AHL90470

SEQ ID NO: 133314 - RNA, 1701 nt, Artificial Sequence; identical to SEQ ID NO: 124450
  derived and/or modified sequence opt3 from hemagglutinin__InfluenzaA__AHL90482

SEQ ID NO: 133315 - RNA, 1701 nt, Artificial Sequence; identical to SEQ ID NO: 124553
  derived and/or modified sequence opt3 from hemagglutinin__InfluenzaA__AHL90494

SEQ ID NO: 133316 - RNA, 1701 nt, Artificial Sequence; identical to SEQ ID NO: 124553
  derived and/or modified sequence opt3 from hemagglutinin__InfluenzaA__AHL90506

SEQ ID NO: 133317 - RNA, 1701 nt, Artificial Sequence
  derived and/or modified sequence opt3 from hemagglutinin__InfluenzaA__AHL90518
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaagaacgaguccuucaauuggacagguguuacccagaacgggacgucuagcgcuugcauccggcgcuccaauaacucauuuuucagucgacugaauuggcucacucauuuaaaguuuaaauauccagcacugaacgugaccaugcccaauaaggagaaauucgacaaacuuuacauuuggggaguccaccauccuggcacagauaacgaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaaacccuuucagaaugucaaccgaaucacauauggugcauguccuagauacgugaagcagaauacccugaaacuugccacugggaugaggaacgugccagagaagcaaacacggggaaucuucggcgcuauugccggcuuuaucgaaaaugggugggagggaauggucgaugguugguauggcuuccgucaccagaacagugaggggaccggacaggcagcugaccugaaaagcacgcaagccgcgauugaucagauaaauggcaaguugaaccgccucaucgguaagaccaaugaaaaauuccaccagauugagaaggaauuuuccgagguugaagggagaauccaggaccuggagaaauacguggaggauacaaagaucgacuuauggucuuauaacgccgaacugcucguagcacuugagaaccaacauacuauugaucugaccgacagcgaaaugaauaaauuguucgagaagacaaagaaacagcuaagggaaaacgcugaggauaugggcaauggaugcuuuaagauauaccacaaaugugacaacgccugcaucggcucaauucggaaugggacuuaugaucaugacguguaccgagacgaggcucugaacaaucgcuuccagaucaagggagucgaacucaaaagugguuacaaggauuggauucuguggaucuccuuugccauaagcugcuuccuucuguguguggcauugcucggcuuuaucaugugggccugccagaaggggaacauuagauguaauaucugcauuuga

SEQ ID NO: 133318 - RNA, 1701 nt, Artificial Sequence; identical to SEQ ID NO: 125229
  derived and/or modified sequence opt3 from hemagglutinin__InfluenzaA__AHL90530

SEQ ID NO: 133319 - RNA, 1701 nt, Artificial Sequence; identical to SEQ ID NO: 124450
  derived and/or modified sequence opt3 from hemagglutinin__InfluenzaA__AHL90542

SEQ ID NO: 133320 - RNA, 1701 nt, Artificial Sequence; identical to SEQ ID NO: 124450
  derived and/or modified sequence opt3 from hemagglutinin__InfluenzaA__AHL90554

SEQ ID NO: 133321 - RNA, 1701 nt, Artificial Sequence; identical to SEQ ID NO: 124450
  derived and/or modified sequence opt3 from hemagglutinin__InfluenzaA__AHL90566

SEQ ID NO: 133322 - RNA, 1701 nt, Artificial Sequence; identical to SEQ ID NO: 124450
  derived and/or modified sequence opt3 from hemagglutinin__InfluenzaA__AHL90578

SEQ ID NO: 133323 - RNA, 1701 nt, Artificial Sequence; identical to SEQ ID NO: 124553
  derived and/or modified sequence opt3 from hemagglutinin__InfluenzaA__AHL90590

SEQ ID NO: 133324 - RNA, 1701 nt, Artificial Sequence; identical to SEQ ID NO: 124450
  derived and/or modified sequence opt3 from hemagglutinin__InfluenzaA__AHL90602

SEQ ID NO: 133325 - RNA, 1701 nt, Artificial Sequence; identical to SEQ ID NO: 124450
  derived and/or modified sequence opt3 from hemagglutinin__InfluenzaA__AHL90614

SEQ ID NO: 133326 - RNA, 1701 nt, Artificial Sequence
  derived and/or modified sequence opt3 from hemagglutinin__InfluenzaA__AHL90638
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccggucccgcaaaagcucgauuaugcgaucugacgcgcccaucgggaaguguaacuccgaaugcauaacuccuaauggaucaauuccaaacgacaagcccuuucagaaugucaacagaaucacauauggcgcauguccuagguacgugaaacaaaauacccugaagcuggccacugguaugcggaacgugccagagaaacagacacgugggaucuucggagcuauugccggcuuuaucgaaaauggcugggaggggauggucgauggaugguaugguuuccgccaccagaacagugagggcagagggcaagcagcugaccuuaagagcacccaggccgcgauugaucagauaaauggaaaauugaacaggcucaucggcaagacgaacgaaaaauuccaccagauugagaaggaauuuuccgagguugaaggucggauccaagaccuggagaaguacguggaggauaccaaaaucgacuuauggucuuauaaugccgaacugcucguagcacuugagaaccagcauacaauugaucugacugacagcgaaaugaauaaguuguucgagaaaaccaagaaacagcuacgagaaaacgcugaggauauggggaauggcugcuuuaagauauaccacaagugugacaacgccugcaucggaucaauucgcaauggcacauaugaucaugacguguacagagacgaggcucugaacaauagguuccagaucaaaggggucgaacucaagaguggauacaaagauuggauucuguggaucuccuuugccauaagcugcuuccuucuguguguggcauugcucgguuuuaucaugugggccugccaaaagggcaacauucgguguaauaucugcauuuga

SEQ ID NO: 133327 - RNA, 1701 nt, Artificial Sequence
  derived and/or modified sequence opt3 from hemagglutinin__InfluenzaA__AHL90650
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaccuuuuuguaugcccaagcuagcggccguaucacugugucuacaaagagaucccagcagaccguaauuccaaacaucgggucaaggccccggguucgcaauauaccuagcagaauuaguaucuacuggacgauugugaaaccaggagauauccugcuaaucaacucuacugguaaucucauugccccgaggggcuacuucaagauacgguccgggaaaagcucgaucaugcgcucugacgcgcccauuggaaaguguaacuccgaaugcaucacaccuaauggcucaauaccaaacgacaagcccuuucagaaugucaaccgaauuaccuauggugcauguccuagauacgugaaacaaaauacucugaagcuggccacagggaugaggaacgugccagagaaacagacccggggaaucuucggcgcuaucgccggcuuuauugaaaaugggugggagggaauggucgaugguugguauggcuuccgucaccagaacagugaggggcgcggacaagcagcugaccuuaagagcacgcaggccgcgaucgaucagauuaauggcaaauugaacagacucauagguaagaccaacgaaaaauuccaccagaucgagaaggaauuuuccgagguugaagggaggauucaagaccuggagaaguacguggaggauacaaaaaucgacuuauggucuuauaaugccgaacugcucguagcacuugagaaccagcauacuaucgaucugaccgacagcgaaaugaauaaguuguucgagaaaacaaagaaacagcuacgggaaaacgcugaggauaugggcaauggaugcuuuaagauuuaccacaagugugacaacgccugcauaggcucaauccgaaaugggacuuaugaucaugacguguaccgcgacgaggcucugaacaauagauuccagauuaaaggagucgaacucaagagugguuacaaagauuggauccuguggauuuccuuugccaucagcugcuuccuucuguguguggcauugcucggcuuuauaaugugggccugccaaaaggggaacaucagguguaauauuugcaucuga

SEQ ID NO: 133328 - RNA, 1701 nt, Artificial Sequence; identical to SEQ ID NO: 124450
  derived and/or modified sequence opt3 from hemagglutinin__InfluenzaA__AHL90662

SEQ ID NO: 133329 - RNA, 1701 nt, Artificial Sequence
  derived and/or modified sequence opt3 from hemagglutinin__InfluenzaA__AHL90674
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuacuucaaaauccgguccggaaagagcucgauuaugcgcucugacgcgcccaucgggaaguguaacuccgaaugcauaacuccuaauggcucaauuccaaacgacaaacccuuucagaaugucaaccgaaucacauauggugcauguccuagauacgugaagcagaauacccugaaacuugccacugggaugaggaacgugccagagaagcaaacacggggaaucuucggcgcuauugccggcuuuaucgaaaaugggugggagggaauggucgaugguugguauggcuuccgucaccagaacagugaggggauuggacaggcagcugaccugaaaagcacccaagccgcgauagaucagaucaauggcaaguugaaccgccucauugguaaaacgaacgaaaaguuccaccagaucgagaaggaauuuuccgagguugaagggagaauccaggaccuggagaaauacguggaggauaccaagauugacuuauggucuuauaaugccgaacugcucguagcacuugagaaccaacauacaauagaucugacugacagcgaaaugaauaaauuguucgagaagaccaaaaagcagcuaagggaaaacgcugaggauaugggcaauggaugcuuuaagaucuaccacaaaugugacaacgugugcauuggcucaauccggaaugggacauaugaucaugacgucuaccgagacgaggcccugaacaaucgcuuccagauuaagggaguggaacucaaaagugguuacaaggauuggauccuguggauauccuuugcuaucagcugcuuccuucuguguguugccuugcucggcuuuauuaugugggcaugccagaaagggaacaucagauguaauauuugcaucuga

SEQ ID NO: 133330 - RNA, 1701 nt, Artificial Sequence
  derived and/or modified sequence opt3 from hemagglutinin__InfluenzaA__AHL90686
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauauggugcauguccuagauacgugaaacaaaauacccugaagcuggccacugggaugaggaacgugccagagaaacagacacggggaaucuucggcgcuauugccggcuuuaucgaaaaugggugggagggaauggucgaugguugguauggcuuccgucaccagaacagugaggggcgcggacaagcagcugaccuuaagagcacccaggccgcgauugaucagauaaauggcaaauugaacagacucaucgguaagacgaacgaaaaauuccaccagauugagaaggaauuuuccgagguugaagggaggauccaagaccuggagaaguacguggaggauaccaaaaucgacuuauggucuuauaaugccgaacugcucguagcaauggagaaccagcauacaauugaucuuacugacagcgaaaugaauaagcuguucgagaaaaccaagaaacaguugcgggaaaacgcugaggauaugggcaauggaugcuuuaagauauaccacaagugugacaacgccugcaucggcucaauucgaaaugggacauaugaucaugacguguaccgcgacgaggcucuaaacaauagauuccagaucaaaggagucgaacugaagagugguuacaaagauuggauucucuggaucuccuuugccauaagcugcuuccugcuuuguguggcacuguugggcuuuaucaugugggccugccaaaaggggaacauuagguguaauaucugcauuuga

SEQ ID NO: 133331 - RNA, 1701 nt, Artificial Sequence; identical to SEQ ID NO: 124450
  derived and/or modified sequence opt3 from hemagglutinin__InfluenzaA__AHL90698

SEQ ID NO: 133332 - RNA, 1701 nt, Artificial Sequence; identical to SEQ ID NO: 124450
  derived and/or modified sequence opt3 from hemagglutinin__InfluenzaA__AHL90710

SEQ ID NO: 133333 - RNA, 1698 nt, Artificial Sequence; identical to SEQ ID NO: 127988
  derived and/or modified sequence opt3 from hemagglutinin__InfluenzaA__AHL90722

SEQ ID NO: 133334 - RNA, 1698 nt, Artificial Sequence
  derived and/or modified sequence opt3 from hemagglutinin__InfluenzaA__AHL90746
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucaagagguuugaaauuuucccuaaagagaguuccuggccaaaccacacugucacaggugugucugccagcugcucccauaauggggagucaaguuuuuaucggaacuuacuguggcuuaccggaaagaauggcuuguaccccaaccugagcaaaucuuaugcaaauaacaaggaaaaagagguacuuguucucuggggcgugcaccacccuccaaacaucgucgaccagaagacgcuguaccgcacugaaaaugccuacguguccguggucucaagccauuauagucgaaaguucacccccgagauagcuaaacguccuaagguuagagaucaggaagggaggaucaacuacuauuggacacuucuggagccaggagacacuauuaucuuugaggcaaaugguaacuugauugccccgcgguacgcuuucgcccucucucgcggcuuuggguccggaaucauaaauagcaacgcgcccaugggcaaaugugaugcaaagugccagaccccucaaggugccauuaauucgucucugccauuccagaacgugcaccccguaacaaucggggaauguccuaaauaugugagauccgcuaaguuaaggauggucaccggacugcggaauauuccaucaauccagagucgcggccucuuuggcgccaucgcaggguucauugagggagguuggacgggcaugguggacgggugguacggauaucaucaccagaacgaacaaggcagcgguuacgcugccgaucagaaauccacucagaaugcgauaaacgggaucacaaauaagguuaacucugugauugagaagaugaauacccaguuuacugccgucggcaaagaguucaacaagcuagaacgaagaauggagaaccugaauaaaaagguggacgauggauucaucgacauauggacauacaacgcagaauugcuaguacugcucgagaaugaaaggacccuggauuuucacgacagcaacguuaaaaaucuuuaugagaaggugaagucacaacugaaaaacaaugcuaaggaaauuggcaacgggugcuucgaguuuuaccauaaauguaaugacgagugcauggaaagugucaagaacggaacguaugauuaccccaaauauuccgaggaaagcaaguugaaucgggagaagaucgacggugugaaacucgagucuaugggcgucuaccagauccuggccauuuauucaaccguggcuaguagcuuaguucugcuagugucccucggggccaucucuuucuggaugugcucgaacggaagccugcagugucguauuugcauauga

SEQ ID NO: 133335 - RNA, 1698 nt, Artificial Sequence; identical to SEQ ID NO: 125147
  derived and/or modified sequence opt3 from hemagglutinin__InfluenzaA__AHL90758

SEQ ID NO: 133336 - RNA, 1698 nt, Artificial Sequence
  derived and/or modified sequence opt3 from hemagglutinin__InfluenzaA__AHL90770
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggacaguuccuggccaaaccacacugucacaggugugucugccagcugcucccauaauggggagucaaguuuuuaucggaacuuacuguggcuuaccggcaaaaauggauuguaccccaaccugagcaagucuuaugcaaauaacaaagaaaaggagguucuaguacucuggggcgugcaccacccuccauccaucaacgaucagaaaacgcuguaccauacugaaaaugccuacgucucaguggugagcagucaccauucucgcaaguucacccccgagauagcuaagcgaccuaaaguccgugaccaggaagggagaaucaacuauuacuggacacuucuggagccaggagauacuauuaucuuugaggcaaaugguaacuugauugccccgagguaugcuuucgcccucucccggggcuuugggagcggaaucauaaauucgaacgcgcccauggacaagugugaugcaaaaugccagaccccucaaggcgccauuaauucuucccugccauuccagaacguucaccccgugacaaucggugaauguccuaaguacguacgcucagcuaaauuaagaauggugaccgggcugaggaauauuccaaguauccagagccggggacucuuuggcgccaucgcaggcuucauugaagggggauggacggguauggucgacggcugguauggguaccaccaucagaacgaacaaggauccggcuaugcugccgaucagaagucuacucagaaugcgauaaacgguaucacaaauaaagugaacagcguuauugagaagaugaauacccaguuuacugccguggggaaggaguucaacaaacuugagcgccgaauggagaaccugaauaagaaagucgacgauggcuucaucgacauauggacauacaacgcagaauugcuagugcugcucgagaaugaaagaacccuggacuuucacgauucaaacguaaagaaucuuuacgagaaaguuaagagucaacugaagaacaaugcuaaagaaauuggaaacggcugcuucgaguuuuaucauaaguguaaugacgagugcauggaauccgugaaaaacgggacguacgauuaucccaaguacagcgaggaaucuaaauugaauagggagaagaucgacggagucaagcucgagucaauggguguguaucagauccugaccauuuacaguacagucgccagcuccuuagugcugcuaguuucucucggcgcuaucucguucuggaugugcagcaacgggucccugcagugucggauuugcauauga

SEQ ID NO: 133337 - RNA, 1698 nt, Artificial Sequence; identical to SEQ ID NO: 125632
  derived and/or modified sequence opt3 from hemagglutinin__InfluenzaA__AHL90782

SEQ ID NO: 133338 - RNA, 1698 nt, Artificial Sequence
  derived and/or modified sequence opt3 from hemagglutinin__InfluenzaA__AHL90794
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaagugcuaguucucuggggcgugcaccacccuccaaacaucggggaccagaauacgcuguaccauacugagaacgccuacgucuccguggugucaagccacuauagucgcaaauucacccccgaaauagcuaagcgaccuaagguccgugaucaggagggaagaaucaauuacuauuggacacuucuggagccaggugacacuauuaucuuugaagcaaacggcaauuugauugccccgagguacgcuuucgcccucucucggggguuuggauccggcaucauaaacagcaaugcgcccauggauaaaugugacgcaaagugccagaccccucaaggugccauuaacucgucucugccauuccagaauguucaucccgugacaaucggggaguguccuaaauauguacgcuccgcuaaguuaagaauggugaccggacugaggaacauuccaucaauccagagucggggccucuuuggcgccaucgcaggguucauugaaggagguuggacgggcauggucgaugggugguacggauaucaccaccagaaugagcaaggcagcgguuacgcugccgaccagaaauccacucagaacgcgauaaaugggaucacaaacaagguaaauucuguuauugaaaagaugaacacccaguuuacugccgugggcaaggaguucaacaaacuugagcgccgaauggaaaaucugaacaaaaaggucgaugacggauucaucgauauauggacauacaaugcagaguugcuagugcugcucgaaaacgagagaacccuggacuuucaugacagcaauguuaaaaaccuuuaugaaaagguaaaaucacaacugaagaauaacgcuaaggagauuggcaaugggugcuucgaguuuuaccacaaauguaacgaugaaugcauggagagugugaagaauggaacguaugacuaccccaaauauuccgaagagagcaaguugaacagggagaaaaucgauggugucaagcucgaaucuaugggcguguaccagauccuggccauuuauucaaccgucgcuaguagcuuagugcugcuaguuucccucggggccaucucuuucuggaugugcucgaauggaagccugcagugucggauuugcauauga

SEQ ID NO: 133339 - RNA, 1698 nt, Artificial Sequence
  derived and/or modified sequence opt3 from hemagglutinin__InfluenzaA__AHL90806
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgucgaccagaaaacgcuguaccgcacugagaaugccuacguguccguggucucaagccauuauagucgaaaguucacccccgaaauagcuaagcguccuaaaguuagagaucaggaggggaggaucaacuacuauuggacacuucuggagccaggagacacuauuaucuuugaagcaaaugguaacuugauugccccgcgguacgcuuucgcccucucucgcggcuuuggguccggaaucauaaauagcaacgcgcccauggauaagugugacgcaaaaugccagaccccucaaggcgccauuaauucgucucugccauuccagaacgugcaccccguaacaaucggugaguguccuaaguaugugagauccgcuaaauuaaggauggucaccgggcugcggaauauuccaucaauccagagucgcggacucuuuggcgccaucgcaggcuucauugaagggggauggacggguaugguggauggcugguacggguaucaucaccagaacgagcaaggaagcggcuacgcugccgaccagaaguccacucagaaugcgauaaacgguaucacaaauaaaguuaacucugugauugaaaagaugaauacccaguuuacugccgucgggaaggaguucaacaaacuugagcgaagaauggaaaaccugaauaagaaaguggaugacggcuucaucgauauauggacauacaacgcagaguugcuaguacugcucgaaaaugagaggacccuggacuuucacgacagcaacguuaagaaucuuuaugaaaaagugaagucacaacugaagaacaaugcuaaagagauuggaaacggcugcuucgaguuuuaccauaaguguaaugaugaaugcauggagagugucaaaaacgggacguaugacuaccccaaguauuccgaagagagcaaauugaaucgggagaagaucgauggagugaagcucgaaucuaugggugucuaccagauccuggccauuuauucaaccguggcuaguagcuuaguucugcuaaucucccucggcgccauuucuuucuggaugugcucgaacgggagccugcagugucguauaugcaucuga

SEQ ID NO: 133340 - RNA, 1698 nt, Artificial Sequence; identical to SEQ ID NO: 127988
  derived and/or modified sequence opt3 from hemagglutinin__InfluenzaA__AHL90818

SEQ ID NO: 133341 - RNA, 1698 nt, Artificial Sequence; identical to SEQ ID NO: 127988
  derived and/or modified sequence opt3 from hemagglutinin__InfluenzaA__AHL90830

SEQ ID NO: 133342 - RNA, 1698 nt, Artificial Sequence; identical to SEQ ID NO: 125147
  derived and/or modified sequence opt3 from hemagglutinin__InfluenzaA__AHL90842

SEQ ID NO: 133343 - RNA, 1698 nt, Artificial Sequence; identical to SEQ ID NO: 127529
  derived and/or modified sequence opt3 from hemagglutinin__InfluenzaA__AHL90854

SEQ ID NO: 133344 - RNA, 1698 nt, Artificial Sequence; identical to SEQ ID NO: 125147
  derived and/or modified sequence opt3 from hemagglutinin__InfluenzaA__AHL90866

SEQ ID NO: 133345 - RNA, 1698 nt, Artificial Sequence; identical to SEQ ID NO: 127529
  derived and/or modified sequence opt3 from hemagglutinin__InfluenzaA__AHL90878

SEQ ID NO: 133346 - RNA, 1698 nt, Artificial Sequence; identical to SEQ ID NO: 127988
  derived and/or modified sequence opt3 from hemagglutinin__InfluenzaA__AHL90890

SEQ ID NO: 133347 - RNA, 1698 nt, Artificial Sequence; identical to SEQ ID NO: 127529
  derived and/or modified sequence opt3 from hemagglutinin__InfluenzaA__AHL90902

SEQ ID NO: 133348 - RNA, 1698 nt, Artificial Sequence; identical to SEQ ID NO: 125147
  derived and/or modified sequence opt3 from hemagglutinin__InfluenzaA__AHL90914

SEQ ID NO: 133349 - RNA, 1698 nt, Artificial Sequence; identical to SEQ ID NO: 127529
  derived and/or modified sequence opt3 from hemagglutinin__InfluenzaA__AHL90938

SEQ ID NO: 133350 - RNA, 1698 nt, Artificial Sequence; identical to SEQ ID NO: 127529
  derived and/or modified sequence opt3 from hemagglutinin__InfluenzaA__AHL90950

SEQ ID NO: 133351 - RNA, 1698 nt, Artificial Sequence; identical to SEQ ID NO: 127529
  derived and/or modified sequence opt3 from hemagglutinin__InfluenzaA__AHL90962

SEQ ID NO: 133352 - RNA, 1698 nt, Artificial Sequence
  derived and/or modified sequence opt3 from hemagglutinin__InfluenzaA__AHL90974
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggaaagaauggcuuguaccccaaccugagcaagucuuaugcaaauaacaaagagaaggaaguucuaguacucuggggcgugcaccacccuccauccaucucagaccagaaaacgcuguaccauacugagaacgccuacgucagcguggugaguucucacuauucccgcaaguucacccccgaagucgcuaagcgaccuaaaguucgugaucaggaggggagaauaaauuacuauuggacacuucuggagccaggagacacuaucauuuuugaagcaaacgguaauuugaucgccccgagguacgcuuucgcccucagccggggcuuugggucgggaauuaucaacucuaaugcgcccauggauaagugugacgcaaaaugccagaccccucaaggcgccauaaacuccucacugccauuccagaaugugcaucccguaacaauuggugaguguccuaaguaugugcgcagugcuaaauuaagaauggucaccgggcugaggaacaucccaagcauucagucccggggacucuuuggcgccaucgcaggcuucaucgaagggggauggacggguaugguggauggcugguacggguaucaccaccagaaugagcaaggaucuggcuacgcugccgaccagaaaagcacucagaacgcgauuaaugguauaacaaacaaaguuaauucagugaucgaaaagaugaacacccaguuuacugccgucgggaaggaguucaauaaacuugagcgccgaauggaaaaccugaacaagaaaguggaugacggcuucauugauaucuggacauacaaugcagaguugcuaguacugcucgaaaacgagagaacccuggacuuucaugacaguaauguuaagaaccuuuaugaaaaagugaagggacaacugaagaauaacgcuaaagagauaggcaaugggugcuucgaguuuuaccacaaguguaacgaugaaugcauggaguccgucaaaaauggaacguaugacuaccccaaguauagcgaagagucuaaauugaacagggagaagauugauggugugaagcucgaaucaaugggcgucuaccagauccuggccaucuauaguaccguggcuagcuccuuaguucugcuagugucucucggggccauuucguucuggaugugcagcaauggaucccugcagugucggaucugcauuuga

SEQ ID NO: 133353 - RNA, 1698 nt, Artificial Sequence
  derived and/or modified sequence opt3 from hemagglutinin__InfluenzaA__AHL90986
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccguaaagaauggauuguaccccaaccugagcaagucuuaugcaaauaacaaagagaaggaaguucuagugcucuggggcguccaccacccuccaaacaucguggaccagaaaacgcuguaccgcacugagaaugccuacguguccgucguuucaagccauuauagucgaaaguucacccccgaaauagcuaagcguccuaaagugagagaucaggagggcaggaucaacuacuauuggacacuucuggagccaggggacacuauuaucuuugaagcaaauggaaacuugauugccccgcgguacgcuuucgcccucucuaaggguuuuggcuccgggaucauaaauagcaacgcgcccauggauaaaugugacgcaaagugccagaccccucgcggagccauuaauucgucucugccauuccaaaacguacaccccgugacaaucggcgaguguccuaaauaugucagauccgcuaaguuaaggauggugaccggucugcggaauauuccaucaauccagagucgcgggcucuuuggagccaucgcaggcuucauugaaggcggguggacgggaaugguugaugguugguacggcuaucaucaccagaacgagcaggggagcggauacgcugccgaccaaaaauccacucagaaugcgauaaacggcaucacaaauaaggugaacucugucauugaaaagaugaauacccaguuuacugccguggguaaagaguucaacaaacuugagcgaagaauggaaaaccugaauaaaaagguagaugacggguucaucgauauauggacauacaacgcagaguugcuaguucugcucgaaaaugagaggacccuggacuuucacgacagcaacgugaaaaaucuuuaugaaaaggucaagucacagcugaaaaacaaugcuaaggagauuggcaacggaugcuucgaguuuuaccauaaauguaaugaugaaugcauggagagugugaagaacggcacguaugacuaccccaaauauuccgaagagagcaaguugaaucgggagaagaucgauggggucaaacucgaaucuaugggaguguaccaaauccuggccauuuauucaaccguugcuaguagcuuagugcugcuaguaucccucggugccaucucuuucuggaugugcucgaacggcagccugcagugucguauuugcauauga

SEQ ID NO: 133354 - RNA, 1698 nt, Artificial Sequence
  derived and/or modified sequence opt3 from hemagglutinin__InfluenzaA__AHL91010
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggacaguuccuggccaaaccacacugucacaggugugucugccagcugcucccauaauggggagucaaguuuuuaucggaacuuacuguggcuuaccggcaaaaauggauuguaccccaaccugagcaagucuuaugcaaauaacaaagaaaaggagguucuaguacucuggggcgugcaccacccuccauccaucaacgaucagaaaacgcuguaccauacugaaaaugccuacgucucaguggugagcagucacuauucucgcaaguucacccccgagauagcuaagcgaccuaaaguccgugaccaggaagggagaaucaacuacuauuggacacuucuggagccaggagauacuauuaucuuugaggcaaaugguaacuugauugccccgagguacgcuuucgcccucucccggggcuuugggagcggaaucauaaauucgaacgcgcccauggacaagugugaugcaaaaugccagaccccucaaggcgccauuaauucuucccugccauuccagaacguucaucccgugacaaucggugaauguccuaaguauguacgcucagcuaaauuaagaauggugaccgggcugaggaauauuccaaguauccagagccggggacucuuuggcgccaucgcaggcuucauugaagggggauggacggguauggucgacggcugguacggguaucaccaccagaacgaacaaggauccggcuacgcugccgaucagaagucuacucagaaugcgauaaacgguaucacaaauaaagugaacagcguuauugagaagaugaauacccaguuuacugccguggggaaggaguucaacaaacuugagcgccgaauggagaaccugaauaagaaagucgacgauggcuucaucgacauauggacauacaacgcagaauugcuagugcugcucgagaaugaaagaacccuggacuuucaugauucaaacguaaagaaucuuuaugagaaaguuaagagucaacugaagaacaaugcuaaagaaauuggaaacggcugcuucgaguuuuaccacaaguguaaugacgagugcauggaauccgugaaaaacgggacguaugauuaccccaaguauagcgaggaaucuaaauugaauagggagaagaucgacggagucaagcucgagucaauggguguguaccagauccugaccauuuauaguacagucgccagcuccuuagugcugcuaguuucucucggcgcuaucucguucuggaugugcagcaacgggucccugcagugucggauuugcauauga

SEQ ID NO: 133355 - RNA, 1698 nt, Artificial Sequence
  derived and/or modified sequence opt3 from hemagglutinin__InfluenzaA__AHL91022
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggacaguuccuggccaaaccacacugucacaggugugucugccagcugcucccauaauggggagaacucauuuuaucggaauuuacuguggcuuaccggcaaaaacggauuguaccccaaucugaguaagagcuaugcaaacaacaaagaaaaggaggugcuaguucucuggggcgugcaccacccuccaucuaucaaugaucagaaaacgcuguaccauacugaaaacgccuacgucuccguggugucaagccacuauagucgcaaguucacccccgagauagcuaagcgaccuaaaguccgugaccaggaagggagaaucaauuacuauuggacacuucuggagccaggagauacuauuaucuuugaggcaaacgguaauuugauugccccgagguacgcuuucgcccucucucggggcuuuggguccggaaucauaaacagcaaugcgcccauggacaagugugaugcaaaaugccagaccccucaaggcgccauuaacucgucucugccauuccagaauguucaucccgugacaaucggugaauguccuaaguauguacgcuccgcuaaauuaagaauggugaccgggcugaggaacauuccaucaauccagagucggggacucuuuggcgccaucgcaggcuucauugaagggggauggacggguauggucgacggcugguacggguaucaccaccagaaugaacaaggaagcggcuacgcugccgaucagaaguccacucagaacgcgauaaaugguaucacaaacaaaguaaauucuguuauugagaagaugaacacccaguuuacugccguggggaaggaguucaacaaacuugagcgccgaauggagaaucugaacaagaaagucgacgauggcuucaucgacauauggacauacaaugcagaauugcuagugcugcucgagaacgaaagaacccuggacuuucaugauagcaauguaaagaaccuuuaugagaaaguuaagucacaacugaagaauaacgcuaaagaaauuggaaauggcugcuucgaguuuuaccacaaguguaacgacgagugcauggaaagugugaaaaaugggacguaugauuaccccaaguauuccgaggaaagcaaauugaacagggagaagaucgacggagucaagcucgagucuauggguguguaccagauccugaccauuuauucaacagucgccaguagcuuagugcugcuaguuucccucggcgcuaucucuuucuggaugugcucgaaugggagccugcagugucggauuugcauauga

SEQ ID NO: 133356 - RNA, 1701 nt, Artificial Sequence; identical to SEQ ID NO: 124450
  derived and/or modified sequence opt3 from hemagglutinin__InfluenzaA__AHL91034

SEQ ID NO: 133357 - RNA, 1701 nt, Artificial Sequence; identical to SEQ ID NO: 127516
  derived and/or modified sequence opt3 from hemagglutinin__InfluenzaA__AHL91046

SEQ ID NO: 133358 - RNA, 1701 nt, Artificial Sequence; identical to SEQ ID NO: 133330
  derived and/or modified sequence opt3 from hemagglutinin__InfluenzaA__AHL91058

SEQ ID NO: 133359 - RNA, 1701 nt, Artificial Sequence
  derived and/or modified sequence opt3 from hemagglutinin__InfluenzaA__AHL91070
augaagaccaucauugcccugagcuacauacucugccuuguguucgcucagaaacugcccggcaacgacaauuccauggcaacauuguguuuagggcaccaugccgucccuaacggaacuaucguuaagacgauuaccaaugaucaaaucgaggugacaaacgcgacugaacugguacagucuucaaguaccggugagauuugcgacagcccacaccagauccuagauggcgaaaauuguacacucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacccuggaauuuaacaaugaguccuucaacuggacugguguuacacagaaugggaccucuagcgcuugcaugcggcgcuccaacaauucauuuuucagucgacugaacuggcucacgcauuuaaaguuuaaguauccagcacugaaugugacuaugcccaacaacgagcaguucgacaaacuuuacaucuggggaguccaccauccuggcaccgauaaugaccagaucuuuuuguaugcccaagcuagcggccguauuacagugucuacuaagagaucccagcagaccguaauuccaaacaucgggucaaggccccggguucgcaauauaccuagcagaauuaguaucuacuggacaauugugaaaccaggagauauccugcuaaucaacucuaccgguaaucucauugccccgaggggcuacuucaagauacgguccgggaaaagcucgaucaugcgcucugacgcgcccauuggaaaguguaacuccgaaugcaucacgccuaauggcucaauaccaaacgacaagcccuuucagaaugucaaccgaauuacuuauggugcauguccuagauacgugaaacaaaauacacugaagcuggccaccgggaugaggaacgugccagagaaacagacucggggaaucuucggcgcuaucgccggcuuuauugaaaaugggugggagggaauggucgaugguugguauggcuuccgucaccagaacagugaggggcgcggacaagcagcugaccuuaagagcacacaggccgcgaucgaucagauuaauggcaaauugaacagacucauagguaagaccaacgaaaaauuccaccagaucgagaaggaauuuuccgagguugaagggaggauucaagaccuggagaaguacguggaggauacgaaaaucgacuuauggucuuauaaugccgaacugcucguagcacuugagaaccagcauaccaucgaucugacagacagcgaaaugaauaaguuguucgagaaaacuaagaaacagcuacgggaaaacgcugaggauaugggcaauggaugcuuuaagauuuaccacaagugugacaacgccugcauaggcucaauccgaaaugggaccuaugaucaugacguguaccgcgacgaggcucugaacaauagauuccagauuaaaggagucgaacucaagagugguuacaaagauuggauccuguggauuuccuuugccaucagcugcuuccuucuguguguggcauugcucggcuuuauaaugugggccugccaaaaggggaacaucagguguaauauuugcaucuga

SEQ ID NO: 133360 - RNA, 1701 nt, Artificial Sequence
  derived and/or modified sequence opt3 from hemagglutinin__InfluenzaA__AHL91082
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauauggugcauguccuaucuacgugaaacaaaauacccugaagcuggccacugggaugagaaacgugccagagaaacagacaaggggaauuuucggcgcuaucgccggcuuuauugaaaaugggugggagggaauggucgaugguugguauggcuuccggcaccagaacagugaggggcguggacaagcagcugaccuuaagagcacccaggccgcgauagaucagaucaauggcaaauugaaccgccucauugguaagacgaacgaaaaauuccaccagaucgagaaggaauuuuccgagguugaagggagaauccaagaccuggagaaguacguggaggauaccaaaauugacuuauggucuuauaaugccgaacugcucguagcacuugagaaccagcauacaauagaucugacugacagcgaaaugaauaaguuguucgagaaaaccaagaaacagcuaagggaaaacgcugaggauaugggcaauggaugcuuuaagaucuaccacaagugugacaacgccugcauuggcucaauccggaaugggacauaugaucaugacguguaccgagacgaggcucugaacaaucgcuuccagauuaaaggagucgaacucaagagugguuacaaagauuggauccuguggauauccuuugccaucagcugcuuccuucuguguguggcauugcucggcuuuauuaugugggccugccaaaaggggaacaucagauguaauauuugcaucuga

SEQ ID NO: 133361 - RNA, 1701 nt, Artificial Sequence; identical to SEQ ID NO: 127435
  derived and/or modified sequence opt3 from hemagglutinin__InfluenzaA__AHL91094

SEQ ID NO: 133362 - RNA, 1701 nt, Artificial Sequence
  derived and/or modified sequence opt3 from hemagglutinin__InfluenzaA__AHL91106
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguaaaggugagauuugcgacagcccacaccagauccuagauggcgaaaauuguacacucauagacgcucugcuuggggauccgcagugcgacggauuucaaaacaagaaaugggaucuguucguggagagauccaaggccuauucuaauuguuaccccuaugacgucccugauuacgcaucguugaggucacucguggccagcaguggcacccuggaauuuaacaaugaguccuucaacuggacugguguuacacagaaugggaccucuagcgcuugcauccggcgcuccaacaauucauuuuucagucgacugaacuggcucacgcauuuaaaguuuaaauauccagcacugaaugugacuaugcccaacaacgagcaguucgacaaacuuuacauuuggggaguccaccauccuggcaccgauaaugaccagaucuuuuuguaugcccaagcuagcggccguauuacagugucuacuaagagaucccagcagaccguaaucccaaacauagggucaaggccccggguucgcaauauuccuagcagaaucaguauuuacuggacaaucgugaagccaggagauauccugcuaauuaacucuaccgguaaucucauagccccgaggggcuacuucaaaauccgguccggaaagagcucgauuaugcgcucugacgcgcccaucgggaaguguaacuccgaaugcauaacgccuaauggcucaauuccaaacgacaaacccuuucagaaugucaaccgaaucacuuauggugcauguccuagauacgugaagcaaaauacacugaaacuugccaccgggaugaggaacgugccagagaagcagacucggggaaucuucggcgcuauugccggcuuuaucgaaaaugggugggagggaauggucgaugguugguauggcuuccgucaccagaacagugaggggcgcggacaagcagcugaccugaaaagcacacaggccgcgauugaucagauaaauggcaaguugaacagacucaucgguaaaaccaacgaaaaguuccaccagauugagaaggaauuuuccgagguugaagggaggauccaagaccuggagaaauacguggaggauacgaagaucgacuuauggucuuauaaugccgaacugcucguagcacuugagaaccagcauaccauugaucugacagacagcgaaaugaauaaauuguucgagaagacuaaaaagcagcuacgggaaaacgcugaggauaugggcaauggaugcuuuaagauauaccacaaaugugacaacgccugcaucggcucaauucgaaaugggaccuaugaucaugacguguaccgcgacgaggcucugaacaauagauuccagaucaagggagucgaacucaaaagugguuacaaggauuggauucuguggaucuccuuugccauaagcugcuuccuucuguguguggcauugcucggcuuuaucaugugggccugccaaaaagggaacauuagguguaauaucugcauuuga

SEQ ID NO: 133363 - RNA, 1701 nt, Artificial Sequence
  derived and/or modified sequence opt3 from hemagglutinin__InfluenzaA__AHL91118
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucaguaagcugaacuggcucacucauuuaaaguuuaaauauccagcacugaaugugaccaugcccaacaacgagcaguucgacaaacuuuacauuuggggaguccaccauccuggcacagauaaugaccagaucuuuuuguaugcccaagcuagcggccgaauuacugugucuaccaaacguucccagcagacaguaaucccaaacauagggucaagacccaggguucggaauauuccuagccgcaucaguauuuacuggaccaucgugaagccaggagauauccugcuaauuaacucuacggguaaucucauagccccgagaggcuacuucaaaaucagguccggaaagagcucgauuaugcggucugacgcgcccaucgggaaguguaacuccgaaugcauaacuccuaauggcucaauuccaaacgacaaacccuuucagaaugucaaccgcaucacauauggugcauguccucgauacgugaagcaaaauacccugaaacuugccacugggaugagaaacgugccagagaagcagacaaggggaaucuucggcgcuauugccggcuuuaucgaaaaugggugggagggaauggucgaugguugguauggcuuccggcaccagaacagugaggggcguggacaagcagcugaccugaaaagcacccaggccgcgauugaucagauaaauggcaaguugaaccgccucaucgguaaaacgaacgaaaaguuccaccagauugagaaggaauuuuccgagguugaagggagaauccaagaccuggagaaauacguggaggauaccaagaucgacuuauggucuuauaaugccgaacugcucguaacacuugagaaccagcauacuauugaucugaccgacagcgaaaugaauaaauuguucgagaagacaaagaagcagcuaagggaaaacgcagaggauaugggcaauggaugcuuuaagauauaccacaaaugugacaacgcuugcaucggcucaauucggaaugggacuuaugaucaugacguguaccgagacgaggcccugaacaaucgcuuccagaucaagggagucgaacucaaaagugguuacaaggauuggauucuguggaucuccuuugcuauaagcugcuuccuucuguguguggccuugcucggcuuuaucaugugggcaugccaaaaagggaacauuagauguaauaucugcauuuga

SEQ ID NO: 133364 - RNA, 1701 nt, Artificial Sequence
  derived and/or modified sequence opt3 from hemagglutinin__InfluenzaA__AHL91130
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucaucgccagcaguggcacucuggaauuuaacaaugaguccuucaacuggacaggugugacccagaaugggacgucuagcgcuugcauucggcgcuccaacaauucauuuuucagucgacugaacuggcucacucauuuaaaguuuaaguauccagcacugaauguuaccaugcccaacaacgagcaguucgacaaacuuuacaucuggggagugcaccauccuggcacagauaaugaccagaucuuuuuguaugcccaagcuagcggccguauuacugucucuaccaagagaucccagcagacagugauaccaaacauugggucaaggccccggguacgcaauaucccuagcagaauuaguaucuacuggaccaucguuaaaccaggagauauucugcuaauaaacucuacggguaaucucaucgccccgaggggcuacuucaagauucgguccgggaaaagcucgaucaugcgcucugacgcgcccauaggaaaguguaacuccgaaugcauuacuccuaauggcucaaucccaaacgacaagcccuuucagaaugugaaccgaaucacauauggugcauguccuagauacgucaaacaaaauacccugaagcuggccacugggaugaggaacgugccagagaaacagacacggggaauuuucggcgcuaucgccggcuuuauugaaaaugggugggagggaaugguggaugguugguauggcuuccgucaccagaacagugaggggcgcggacaagcagcugaccuuaagagcacccaggccgcgauagaucagaucaauggcaaauugaacagacucauugguaagacgaacgaaaaauuccaccagaucgagaaggaauuuuccgaggucgaagggaggauccaagaccuggagaaguacguugaggauaccaaaauugacuuauggucuuauaaugccgaacugcucguggcacuugagaaccagcauacaauagaucugacugacagcgaaaugaauaaguuguucgagaaaaccaagaaacagcuacgggaaaacgcugaggauaugggcaauggaugcuuuaagaucuaccacaagugugacaacgccugcauuggcucaauccgaaaugggacauaugaucauaacguauaccgcgacgaggcucugaauaacagauuccagauuaaaggaguggaacucaagagugguuacaaagacuggauccuguggauauccuuugccaucagcugcuuccuucugugugucgcauugcucggcuuuauuaugugggccugccaaaaggggaauaucagguguaacauuugcaucuga

SEQ ID NO: 133365 - RNA, 1701 nt, Artificial Sequence; identical to SEQ ID NO: 124450
  derived and/or modified sequence opt3 from hemagglutinin__InfluenzaA__AHL91142

SEQ ID NO: 133366 - RNA, 1701 nt, Artificial Sequence; identical to SEQ ID NO: 124450
  derived and/or modified sequence opt3 from hemagglutinin__InfluenzaA__AHL91154

SEQ ID NO: 133367 - RNA, 1701 nt, Artificial Sequence; identical to SEQ ID NO: 122646
  derived and/or modified sequence opt3 from hemagglutinin__InfluenzaA__AHL91166

SEQ ID NO: 133368 - RNA, 1701 nt, Artificial Sequence; identical to SEQ ID NO: 132483
  derived and/or modified sequence opt3 from hemagglutinin__InfluenzaA__AHL94984

SEQ ID NO: 133369 - RNA, 1701 nt, Artificial Sequence; identical to SEQ ID NO: 132483
  derived and/or modified sequence opt3 from hemagglutinin__InfluenzaA__AHL94996

SEQ ID NO: 133370 - RNA, 1701 nt, Artificial Sequence; identical to SEQ ID NO: 131851
  derived and/or modified sequence opt3 from hemagglutinin__InfluenzaA__AHL95008

SEQ ID NO: 133371 - RNA, 1701 nt, Artificial Sequence; identical to SEQ ID NO: 132013
  derived and/or modified sequence opt3 from hemagglutinin__InfluenzaA__AHL95020

SEQ ID NO: 133372 - RNA, 1701 nt, Artificial Sequence; identical to SEQ ID NO: 132010
  derived and/or modified sequence opt3 from hemagglutinin__InfluenzaA__AHL95032

SEQ ID NO: 133373 - RNA, 1701 nt, Artificial Sequence; identical to SEQ ID NO: 131884
  derived and/or modified sequence opt3 from hemagglutinin__InfluenzaA__AHL95044

SEQ ID NO: 133374 - RNA, 1701 nt, Artificial Sequence; identical to SEQ ID NO: 131874
  derived and/or modified sequence opt3 from hemagglutinin__InfluenzaA__AHL95056

SEQ ID NO: 133375 - RNA, 1701 nt, Artificial Sequence; identical to SEQ ID NO: 132013
  derived and/or modified sequence opt3 from hemagglutinin__InfluenzaA__AHL95068

SEQ ID NO: 133376 - RNA, 1701 nt, Artificial Sequence; identical to SEQ ID NO: 132561
  derived and/or modified sequence opt3 from hemagglutinin__InfluenzaA__AHL95080

SEQ ID NO: 133377 - RNA, 1701 nt, Artificial Sequence; identical to SEQ ID NO: 131884
  derived and/or modified sequence opt3 from hemagglutinin__InfluenzaA__AHL95092

SEQ ID NO: 133378 - RNA, 1701 nt, Artificial Sequence
  derived and/or modified sequence opt3 from hemagglutinin__InfluenzaA__AHL95104
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcaugcgcggaagcaauuccucauuuuucagucgacugaacuggcucacccauuuaaauuuuaaguauccagcccugaacgugacgaugcccaacaaugagcaguucgacaaacuuuacauuuggggcguccaccauccuggcacugauaaggaccagaucuuuuuguaugcucagagcucugggcguauuaccguguccacaaagagaucacaacaggccguaaucccaaacauaggaagcaggccccggauucgcaauaucccuaguagaauuucuaucuacuggacuaucguuaaaccaggugauauucugcuaauaaacuccaccggcaaucucaucgcgccgaggggguacuucaagauucggagcggaaaaucgucuaucaugcgcuccgacgcacccauaggcaaguguaagucagaaugcauuacaccuaacgguaguaucccaaaugacaaacccuuucagaacgugaaucgaaucaccuauggggccuguccuagauacgucaagcagagcacgcugaaacuugcuacuggaaugaggaacgugccagagaagcaaacacggggcauuuucggcgccaucgcaggguuuauugaaaauggaugggaggguaugauggauggcugguauggguuccgucaccagaacuccgagggacgcggccaggcugccgaccugaaaucuacccaagcggccauagaucagaucaaugguaaguugaacagacucauugggaaaacuaaugaaaaguuccaccagaucgagaaggaauuuagcgagguggaaggcaggauccaggaccuggagaaauacgucgaggauacaaagauugacuuauggucauauaacgcagaacugcucguugcucuugagaaccaacauaccauagaucugacggacagugaaaugaauaaauuguucgagaagaccaaaaagcagcuacgggaaaacgccgaggauaugggaaauggcugcuuuaagaucuaccacaaaugugacaacgcuugcauuggguccauccgaaauggaacauaugaucaugacguguaccgcgacgaggcccugaacaauagauuccagauuaaggguguagaacucaaaagcggcuacaaggauuggauccuguggauaucuuuugcaaucucaugcuuccuucuguguguggccuugcucggguuuauuaugugggcuugccagaaaggaaacaucagguguaauauuugcaucuga

SEQ ID NO: 133379 - RNA, 1701 nt, Artificial Sequence
  derived and/or modified sequence opt3 from hemagglutinin__InfluenzaA__AHL95116
augaagaccaucauugcccugagcuacauacucugccuuguguucgcucaggagcugcccggcaacgacgauuccacagcaacuuuguguuuagggcacuaugccgucccuaauggaacgaucguuaaaaccauuacaaacgaccaaaucgaagugacuaaugcgaccgagcugguacagucuucaaguacaggugaaauuugcaacagcccacaucagauccuagauggcgagaauuguacccucauagacgcucugcuuggggauccgcagugcgacggauuucaaaacaagaaaugggaucuguucguggaaagauccaaggcccacucuaauuguuaccccuaugacgucccugauuacgcaucguugaggucacucguggccagcaguggcacucuggaguuuaacaaugaguccuucaacuggacagguguuacccagaaugggacgucuagcgcuugcauccggcgcuccaacaauucauuuuucagucgacugaacuggcucacucauuuaaauuuuaaauauccagcacugaacgugaccaugcccaacaaugaacaguucgacaagcuguacauuuggggaguccaccauccuggcacagauaaggaccagaucuuuuuguaugccaaagcuagcggccguauuacugugucuaccaagagaucccaacaggccguaaucccaaacauagggucaaggccccggguucgcaauauuccuagcagagugaguaucuacuggacaauugucaaaccaggagauauccugcuaaucaacucuaccgguaaucucauugcgccgaggggcuacuucaagauacgguccgggaaaagcucgaucaugcgcucugacgcacccauuggaaaguguaacuccgccugcaucacgccuaauggcucaauaccaaacgacaagcccuuucagaaugugaaccgaauuacuuauggugcuuguccuagauacgugaaacagaauacacugaaacuugccaccgggaugaggaacgucccagagaagcaaacucggggaaucuucggcgcaaucgcuggcuuuauugaaaaugggugggagggaaugguugaugguugguauggcuuccgucaccagaacagugaggggcgcggacaggccgcggaccuuaagagcacacaagccgcaaucgaucagauuaauggcaaauugaacagacucauagguaagaccaacgaaaaauuccaccagaucgagaaggaauuuuccgagguggaagggaggauucaggaccuggagaaguacguagaggauacgaaaaucgacuuauggucuuauaaugcugaacugcucguggcccuugagaaccaacauaccaucgaucugacagacagcgaaaugaauaaguuguucgagaaaacuaagaaacagcuacgggaaaacgcugaggauaugggcaauggaugcuuuaagauuuaccacaagugugacaacgccugcauaggcucaauccgaaaugggaccuaugaucaugacgucuaccgcgacgaggcacugaacaauagauuccagauuaaaggaguggaacucaagagugguuacaaagauuggauccuguggauuuccuuugccaucagcugcuuccuucuguguguugcuuugcucggcuuuauaaugugggcgugccagaaggggaacaucagguguaauauuugcaucuga

SEQ ID NO: 133380 - RNA, 1701 nt, Artificial Sequence; identical to SEQ ID NO: 131851
  derived and/or modified sequence opt3 from hemagglutinin__InfluenzaA__AHL95128

SEQ ID NO: 133381 - RNA, 1701 nt, Artificial Sequence; identical to SEQ ID NO: 131874
  derived and/or modified sequence opt3 from hemagglutinin__InfluenzaA__AHL95140

SEQ ID NO: 133382 - RNA, 1701 nt, Artificial Sequence; identical to SEQ ID NO: 131884
  derived and/or modified sequence opt3 from hemagglutinin__InfluenzaA__AHL95152

SEQ ID NO: 133383 - RNA, 1701 nt, Artificial Sequence; identical to SEQ ID NO: 131851
  derived and/or modified sequence opt3 from hemagglutinin__InfluenzaA__AHL95164

SEQ ID NO: 133384 - RNA, 1701 nt, Artificial Sequence; identical to SEQ ID NO: 131884
  derived and/or modified sequence opt3 from hemagglutinin__InfluenzaA__AHL95176

SEQ ID NO: 133385 - RNA, 1701 nt, Artificial Sequence; identical to SEQ ID NO: 131884
  derived and/or modified sequence opt3 from hemagglutinin__InfluenzaA__AHL95188

SEQ ID NO: 133386 - RNA, 1701 nt, Artificial Sequence; identical to SEQ ID NO: 132010
  derived and/or modified sequence opt3 from hemagglutinin__InfluenzaA__AHL95200

SEQ ID NO: 133387 - RNA, 1701 nt, Artificial Sequence; identical to SEQ ID NO: 131884
  derived and/or modified sequence opt3 from hemagglutinin__InfluenzaA__AHL95212

SEQ ID NO: 133388 - RNA, 1701 nt, Artificial Sequence; identical to SEQ ID NO: 131874
  derived and/or modified sequence opt3 from hemagglutinin__InfluenzaA__AHL95224

SEQ ID NO: 133389 - RNA, 1701 nt, Artificial Sequence; identical to SEQ ID NO: 131874
  derived and/or modified sequence opt3 from hemagglutinin__InfluenzaA__AHL95236

SEQ ID NO: 133390 - RNA, 1701 nt, Artificial Sequence; identical to SEQ ID NO: 131899
  derived and/or modified sequence opt3 from hemagglutinin__InfluenzaA__AHL95248

SEQ ID NO: 133391 - RNA, 1701 nt, Artificial Sequence
  derived and/or modified sequence opt3 from hemagglutinin__InfluenzaA__AHL95260
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuagugagaucugcgacagcccacaccagauacuagauggugaaaacuguacacucaucgacgcucugcuuggcgauccgcagugcgacggguuucagaauaaaaagugggaucuguucguggagagguccaaagccuauucuaacuguuaccccuaugacgucccugauuacgcaucguugcggucacucguggccagcaguggaacccuggaauuuaauaacgaguccuucaauugggcuggcguuacucaaaacgguacaucuagcgcaugcauucgcggguccaauucaaguuucuuuagccgacugaacuggcucacccauuuaaauuuuaaguauccagcccugaacgugacgaugcccaacaaugagcaguucgacaaguuguacaucuggggaguccaccauccuggcacugauaaagaccagauuuuucuuuaugcucagucuuccggccguaucaccgugucaacaaagagaagccaacaggccguaauaccaaacauugggaguaggccccggauccgcaauauuccuucuagaaucuccaucuacuggacuauuguuaaaccaggagauauacugcuaaucaacagcaccgguaaucucauugcgccgaggggcuacuucaagauccggucggggaaaucuuccauaaugcgcucagacgcacccauuggaaaguguaagagugaaugcaucacaccuaacggcagcaucccaaaugacaaacccuuucagaacgugaaucgaauuaccuauggugccuguccuagauacgucaagcaguccacgcugaaacuugcuacugggaugaggaacgugccagagaagcaaacacggggaaucuucggcgccauugcaggcuuuauagaaaaugggugggagggaaugguggaugguugguauggcuuccgucaccagaacucugaggggcgcggacaggcugccgaccugaaaagcacccaagcggccaucgaucagauuaauggcaaguugaacagacucaucgguaaaacuaaugaaaaguuccaccagaucgagaaggaauuuucagaggucgaagggaggauucaggaccuggagaaauacguugaggauacaaagauagacuuauggaguuauaacgcagaacugcucguggcucuugagaaccaacauaccaucgaucugacggacuccgaaaugaauaaauuguucgagaagaccaaaaagcagcuacgggaaaacgccgaggauaugggcaauggaugcuuuaagauuuaccacaaaugugacaacgcuugcaucggcagcauucgaaaugggacauaugaucaugacguauaccgcgacgaggcccugaacaauagauuccagaucaagggaguggaacucaaaucugguuacaaggauuggauacuguggaucucauuugcaauuaguugcuuccuucugugugucgccuugcucggcuuuaucaugugggcuugccagaaagggaacauuagguguaauaucugcauauga

SEQ ID NO: 133392 - RNA, 1701 nt, Artificial Sequence; identical to SEQ ID NO: 131884
  derived and/or modified sequence opt3 from hemagglutinin__InfluenzaA__AHL95272

SEQ ID NO: 133393 - RNA, 1701 nt, Artificial Sequence; identical to SEQ ID NO: 132010
  derived and/or modified sequence opt3 from hemagglutinin__InfluenzaA__AHL95284

SEQ ID NO: 133394 - RNA, 1701 nt, Artificial Sequence
  derived and/or modified sequence opt3 from hemagglutinin__InfluenzaA__AHL95296
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauguucccgaagacaagcuccuggcccaaccacgacucaaauaagggugucaccgccgcuuguccucaugcaggggccaaaaguuuuuauaagaaccugauuuggcucgugaaaaagggaaauagcuacccaaaauuaucuaaguccuauaucaacgauaagggcaaagaaguacugguucuuuggggcauacaccaccccucaacgacugcugaccaacagagcuuguaccagaaugccgaugcguacguguucgucgggaccaguaaguauucuaaaaaguuuaaaccugagaucgcaauucgcccaaaggugcgagaccaggagggacguaugaacuacuauuggacacugaucgaacccggugauaaaauuacuuucgaggccaccggcaaccuaguggucccuagauacgcuuuugccauggaaaggaaugcaggguccggaaucauaauuagcgacacaccaguucaugauugcaacaccacgugucaaacuccggagggcgcuaucaauacaucgcuccccuuccagaacauucacccuaucaccaucgguaagugcccaaaguaugugaaaucuacuaagcugcggcuugccacagggcugcgcaauguacccuccauucagucaagaggauuguuuggcgcgauagccggcuucaucgaagggggauggaccgguaugguggacggcugguacggguaucaucaccagaacgagcaaggaaguggcuacgcagcugaccucaaaagcacgcagaaugccauugauaagaucaccaacaaagucaauuccgugauagagaagaugaacacacaguuuacugcuguugguaaggaguucaaucaccuggagaaaaggauugaaaacuuaaauaagaaaguggacgauggguuccuggacaucuggaccuacaacgccgagcuccuuguccuguuggaaaaugagcggacacuagauuaucaugacucuaacgugaagaaccuguacgagaaaguacgcaaucagcucaaggauaacgcaaaggaaaucggcaauggauguuuugaguucuaucacaaaugcgacaacacuuguauggaaagcguuaagaauggcaccuacgauuauccuaaauacucagaggaagccaagcugaaccgagagaaaauugacggggugaaacuugagaguacaagaaucuaucaaauucuggcuauauacuccaccgucgcgagcucuuuggugcucgucgugucacugggagcaaucaguuuuuggaugugcagcaaugguuccuuacagugcaggauuuguaucuga

SEQ ID NO: 133395 - RNA, 1701 nt, Artificial Sequence; identical to SEQ ID NO: 131851
  derived and/or modified sequence opt3 from hemagglutinin__InfluenzaA__AHL95307

SEQ ID NO: 133396 - RNA, 1701 nt, Artificial Sequence; identical to SEQ ID NO: 131874
  derived and/or modified sequence opt3 from hemagglutinin__InfluenzaA__AHL95319

SEQ ID NO: 133397 - RNA, 1701 nt, Artificial Sequence
  derived and/or modified sequence opt3 from hemagglutinin__InfluenzaA__AHL95331
augaagaccaucauugcccugagcuacauacucugccuuguguucgcucagaaacugcccggcgacgauaacuccacagcaacuuuguguuuagggcaccaugccgucccuaauggaacgaucguuaagaccauuacaaacgacagaaucgaggugacuaaugcgaccgaacugguacaaaacucuucaauuggugagaucugcgauaguccacaccagauacuagacggcgaaaauuguacacucaucgaugcucugcuuggggacccgcagugcgauggauuucagaacaaaaagugggaccuguucguggagaggagcaaagccuauuccaauuguuaccccuaugaugucccugacuacgcaucuuugcggucgcucguggccucaagcggcacccuggaauuuaacaaugagaguuucaacugggcugguguuacucaaaaugggacauccucugcaugcauucgcggaagcaacuccucauuuuucagucgacugaauuggcucacccauuuaaacuuuaaguauccagcccugaaugugacgaugcccaacaacgagcaguucgauaaguuguacaucuggggcguccaccauccuggcacugacaaagaucagauuuuucuuuaugcucagagcucugggcguaucaccguguccacaaagagaucacaacaggccguaauaccaaauauuggaagcaggccccggauccgcaacauuccuaguagaaucucuaucuacuggacuauuguuaaaccaggugacauacugcuaaucaauuccaccggcaaccucauugcgccgaggggguacuucaagauccggagcggaaaaucgucuauaaugcgcuccgacgcacccauuggcaaguguaagucagaaugcaucacaccuaaugguaguaucccaaacgauaaacccuuucagaaugugaaccgaauuaccuauggggccuguccuagauacgucaagcagagcacgcugaaacuugcuacuggaaugaggaaugugccagagaagcaaacacggggcaucuucggcgccauugcaggguuuauagaaaacggaugggaggguaugguggacggcugguauggguuccgucaccaaaauuccgagggacgcggccaggcugccgaucugaaaucuacccaggcggccaucgaccagauuaacgguaaguugaauagacucaucgggaaaacuaacgaaaaguuccaccagaucgagaaggaauuuagcgaggucgaaggcaggauucaggaucuggagaaauacguugaggacacaaagauagauuuauggucauauaaugcagaacugcucguggcucuugagaaccaacauaccaucgaccugacggauagugaaaugaacaaauuguucgagaagaccaaaaagcagcuacgggaaaaugccgaggacaugggaaacggcugcuuuaagauuuaccacaaaugugauaaugcuugcaucggguccauucgaaacggaacauaugaccaugacguauaccgcgaugaggcccugaauaacagauuccagaucaaggguguggaacucaaaagcggcuacaaggacuggauacuguggaucucuuuugcaauuucaugcuuccuucugugugucgccuugcucggguuuaucaugugggcuugccagaaaggaaauauuagguguaacaucugcauauga

SEQ ID NO: 133398 - RNA, 1701 nt, Artificial Sequence
  derived and/or modified sequence opt3 from hemagglutinin__InfluenzaA__AHL95343
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggauucaggaccuggagaaauacguugaggauacaaagauagacuuauggucauauaacgcagaacugcucguggcucuugagaaccaacauaccaucgaucugacggacagugaaaugaauaaauuguucgagaagaccaaaaagcagcuacgggaaaacgccgaggauaugggaaauggcugcuuuaagauuuaccacaaaugugacaacgcuugcaucggguccauucgaaauggaacauaugaucaugacguauaccgcgacgaggcccugaacaauagauuccagaucagggguguggaacucaagagcggcuacaaagauuggauacuguggaucucuuuugcaauuucaugcuuccuucugugugucgccuugcucggguuuaucaugugggcuugccagaagggaaacauucgguguaauaucugcauauga

SEQ ID NO: 133399 - RNA, 1701 nt, Artificial Sequence; identical to SEQ ID NO: 131874
  derived and/or modified sequence opt3 from hemagglutinin__InfluenzaA__AHL95432

SEQ ID NO: 133400 - RNA, 1701 nt, Artificial Sequence; identical to SEQ ID NO: 132010
  derived and/or modified sequence opt3 from hemagglutinin__InfluenzaA__AHL95444

SEQ ID NO: 133401 - RNA, 1701 nt, Artificial Sequence; identical to SEQ ID NO: 131874
  derived and/or modified sequence opt3 from hemagglutinin__InfluenzaA__AHL95457

SEQ ID NO: 133402 - RNA, 1701 nt, Artificial Sequence
  derived and/or modified sequence opt3 from hemagglutinin__InfluenzaA__AHL95470
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagccuauucuaacuguuaccccuaugaugucccugacuacgcaucguugaggucacucguggccagcaguggcacucuggaauuuaauaacgaguccuucaauuggacagguguuaagcagaacgggaccucuagcgcuugcauccggcgcuccaauucaaguuucuuuagccgacugaacuggcucacgcauuuaaauuuuaaguauccagcacugaacgugacuaugcccaacaaugagcaguucgauaaacuuuacauuuggggaguccaccauccuggcaccgacaaggaucagaucuuuuuguaugcccaaucuuccggccguauuacagugucaacuaaaagaagccagcaggcuguaaucccaaacauagggaguaggccccggauucgcaauaucccuucuagaauuuccaucuacuggaccaucguuaggccaggagacauucugcuaauaaacagcacagguaaucucaucgccccgcggggcuacuucaagauucgcucggggaaaucuuccaucaugcgaucagaugcgcccauaggaaaguguaacagugaaugcauuaccccuaauggcagcaucccaaacgacaagcccuuucagaaugugaacagaaucacguauggugcauguccuagguacgucaaacaauccacucugaagcuggccacagggaugcggaaugugccagagaaacagacccguggaauuuucggcgcuaucgccggcuuuauugaaaacgggugggagggaaugguggacgguugguauggcuuccgccaccaaaauucugaggggagaggacaggcagcugaucuuaagagcacucaggccgcgauagaccagaucaacggcaaauugaauaggcucauugguaagacaaacgaaaaauuccaccagaucgagaaggaauuuucagaggucgaagggcggauccaagaucuggagaaguacguugaggacaccaaaauugauuuauggaguuauaacgccgaacugcucguggcacuugagaaucagcauacgauagaccugaccgauuccgaaaugaacaaguuguucgagaaaacaaagaaacagcuacgagaaaaugcugaggacaugggcaacggaugcuuuaagaucuaccacaagugugauaaugccugcauuggcagcauccgcaacgggacuuauaaucaugacguauacagagaugaggcucugaacaauagguuccagauuaaaggaguggaacucaagucugguuacaaagacuggauccuguggauaucauuugccaucaguugcuuccuucugugugucgcauugcucggcuuuauuaugugggccugccaaaaggggaacauccgguguaauauuugcaucuga

SEQ ID NO: 133403 - RNA, 1701 nt, Artificial Sequence; identical to SEQ ID NO: 132010
  derived and/or modified sequence opt3 from hemagglutinin__InfluenzaA__AHL95482

SEQ ID NO: 133404 - RNA, 1701 nt, Artificial Sequence; identical to SEQ ID NO: 132010
  derived and/or modified sequence opt3 from hemagglutinin__InfluenzaA__AHL95494

SEQ ID NO: 133405 - RNA, 1701 nt, Artificial Sequence
  derived and/or modified sequence opt3 from hemagglutinin__InfluenzaA__AHL95506
augaagaccaucauugcccugagcuacauacucugccuuguguucgcucagaaacugcccggcaacgacaauuccacagcaacuuuguguuuagggcaccaugccgucccuaacggaacgaucguuagaaccauuacaaaugauaggaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaagaaaugggaucuguucguggagcggagcaaggccuauuccaacuguuaccccuaugacgucccugauuacgcaucuuugcgcucgcucguggccucaagcggcacccuggaauuuaauaacgagaguuucaauugggcugguguuacucaaaacgggacauccucugcaugcauucgaggaagcaauuccucauuuuucagucgucugaacuggcucacccauuuaaauuuuaaauauccagcccugaacgugacgaugcccaacaaugagcaguucgacaaguuguacaucuggggcguccaccauccuggcacugauaaggaccagauuuuucuuuaugcucagagcucugggagaaucaccguguccacaaaaaggucacaacaggccguaauaccaaacauuggaagccggccccgcaucagaaauauuccuaguaggaucucuaucuacuggacuauuguuaagccaggugauauacugcuaaucaacuccaccggcaaucucauugcgccgcggggguacuucaaaauccgcagcggaaagucgucuauaaugcgauccgacgcacccauuggcaaauguaagucagaaugcaucacaccuaacgguaguaucccaaaugacaagcccuuucagaacgugaauagaauuaccuauggggccuguccuagguacgucaaacagagcacgcugaaacuugcuacuggaaugcggaacgugccagagaagcaaacacguggcaucuucggcgccauugcaggguuuauagaaaauggaugggaggguaugguggauggcugguauggguuccgccaccagaacuccgagggaagaggccaggcugccgaccugaagucuacccaagcggccaucgaucagauuaaugguaaauugaacaggcucaucgggaagacuaaugaaaaauuccaccagaucgagaaggaauuuagcgaggucgaaggccggauucaggaccuggagaaguacguugaggauacaaaaauagacuuauggucauauaacgcagaacugcucguggcucuugagaaccaacauaccaucgaucugacggacagugaaaugaauaaguuguucgagaaaaccaagaaacagcuacgagaaaacgccgaggauaugggaaauggcugcuuuaagauuuaccacaagugugacaacgcuugcaucggguccauucgcaauggaacauaugaucaugacguauacagagacgaggcccugaacaauagguuccagaucaaagguguggaacucaagagcggcuacaaagauuggauacuguggaucucuuuugcaauuucaugcuuccuucugugugucgccuugcucggguuuaucaugugggcuugccagaagggaaacauucgguguaauaucugcauauga

SEQ ID NO: 133406 - RNA, 1701 nt, Artificial Sequence
  derived and/or modified sequence opt3 from hemagglutinin__InfluenzaA__AHL95518
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauguuccuaguagaauuucuaucuacuggacuaucgugaaaccaggugauauucugcuaauaaacuccaccggcaaucucaucgcgccgaggggguacuucaagauucggagcggaaaaucgucuaucaugcgcuccgacgcacccauaggcaaguguaagucagaaugcauuacaccuaacgguaguaucccaaaugacaaacccuuucagaacgucaaucgaaucaccuauggggccuguccuagauacgugaagcagagcacgcugaaacuugcuacuggaaugaggaacgugccagagaagcaaacacggggcauuuucggcgccaucgcaggguuuauugaaaauggaugggaggguaugauggauggcugguauggguuccgucaccagaacuccgagggacgcggccaggcugccgaccugaaaucuacccaagcggccauagaucagaucaaugguaaguugaacagacucauugggaaaacuaaugaaaaguuccaccagaucgagaaggaauuuagcgaggucgaaggcaggauccaggaccuggagaaauacguugaggauacaaagauugacuuauggucauauaacgcagaacugcucguggcucuugagaaccaacauaccauagaucugacggacagugaaaugaauaaauuguucgagaagaccaaaaagcagcuacgggaaaacgccgaggauaugggaaauggcugcuuuaagaucuaccacaaaugugacaacgcuugcauuggguccauccgaaauggaacauaugaucaugacguauaccgcgacgaggcccugaacaauagauuccagauuaaggguguggaacucaaaagcggcuacaaggauuggauccuguggauaucuuuugcaaucucaugcuuccuucugugugucgccuugcucggguuuauuaugugggcuugccagaaaggaaacaucagguguaauauuugcaucuga

SEQ ID NO: 133407 - RNA, 1701 nt, Artificial Sequence; identical to SEQ ID NO: 131884
  derived and/or modified sequence opt3 from hemagglutinin__InfluenzaA__AHL95530

SEQ ID NO: 133408 - RNA, 1701 nt, Artificial Sequence; identical to SEQ ID NO: 131884
  derived and/or modified sequence opt3 from hemagglutinin__InfluenzaA__AHL95542

SEQ ID NO: 133409 - RNA, 1701 nt, Artificial Sequence
  derived and/or modified sequence opt3 from hemagglutinin__InfluenzaA__AHL95554
augaagaccaucauugcccugagcuacauacucugccuuguguucgcucagaaacugcccggcaacgacaauuccauggcaacauuguguuuagggcaccaugccgucccuaacggaacuaucguuaagacgauuaccaaugauagaaucgaggugacaaacgcgacugaacugguacaaaauucuucaauuggugagaucugcgacaguccacaccagauacuagauggcgaaaacuguacccucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacacuggaauuuaauaacgagaguuucaauuggaccgguguuacucaaaacgggacauccucugcuugcauucgccgaagcaauuccucauuuuucagucgucugaacuggcucacccauuuaaauuuuaaguauccagcacugaacgugacgaugcccaacaaugagcaguucgacaaguuguacaucuggggaguccaccauccuggcacugauaaagaccagauuuuucuuuaugcccagagcucuggcagaaucaccguguccacaaagaggucacaacaggcuguaauaccaaacauugggagccggccccgcaucagaaauauuccuaguaggaucucuaucuacuggacuauuguuaaaccaggagauauacugcuaaucaacuccaccgguaaucucauugccccgcggggcuacuucaagauccgcagcgggaaaucgucuauaaugcgauccgacgcgcccauuggaaaguguaagucagaaugcaucacaccuaacggcaguaucccaaaugacaaacccuuucagaacgugaauagaauuaccuauggugcauguccuagguacgucaagcagagcacgcugaaacuugccacugggaugcggaacgugccagagaagcaaacacguggaaucuucggcgcuauugccggcuuuauagaaaaugggugggagggaaugguggaugguugguauggcuuccgccaccagaacuccgaggggagaggacaggcagcugaccugaaaucuacccaagccgcgaucgaucagauuaauggcaaguugaacaggcucaucgguaaaacuaaugaaaaguuccaccagaucgagaaggaauuuagcgaggucgaagggcggauucaggaccuggagaaauacguugaggauacaaagauagacuuauggucauauaacgccgaacugcucguggcacuugagaaccaacauaccaucgaucugacggacagugaaaugaauaaauuguucgagaagaccaaaaagcagcuacgagaaaacgcugaggauaugggcaauggaugcuuuaagauuuaccacaaaugugacaacgccugcaucggcuccauucgcaaugggacauaugaucauaacguauacagagacgaggcucugaauaacagguuccagaucaagggaguggaacucaaaagcgguuacaaggacuggauacuguggaucucuuuugccauuucaugcuuccuucugugugucgcauugcucggcuuuaucaugugggccugccagaaagggaauauucgguguaacaucugcauauga

SEQ ID NO: 133410 - RNA, 1701 nt, Artificial Sequence
  derived and/or modified sequence opt3 from hemagglutinin__InfluenzaA__AHL95566
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucguagcucugggagaaucaccguguccacaaagaggucacagcaagccguaauaccaaacauuggaagccggccccgcaucagaaauauuccuaguaggaucucuaucuacuggacuauuguuaaaccaggugauauacugcuaaucaacuccaccggcaaucucauugcgccgcggggguacuucaagauccgcagcggaaaaucgucuauaaugcgauccgacgcacccauuggcaaguguaagucagaaugcaucacaccuaacgguaguaucccaaaugacaaacccuuucagaacgugaauagaauuaccuauggggccuguccuagguacgucaagcagagcacgcugaaacuugcuacuggaaugcggaacgugccagagaagcagacacguggcaucuucggcgccauugcaggguuuauagaaaauggaugggaggguaugguggauggcugguauggguuccgccaccaaaacuccgagggaagaggccaggcugccgaccugaaaucuacccaggcggccaucgaucaaauuaaugguaaguugaacaggcucaucgggaaaacuaaugaaaaguuccaccagaucgagaaggaauuuagcgaggucgaaggccggauucaggaccuggagaaauacguugaggauacaaagauagacuuauggucauauaacgcagaacugcucguggcucuugagaaccagcauaccaucgaucugacggacagugaaaugaauaaauuguucgagaagaccaaaaagcaacuacgagaaaacgccgaggauaugggaaauggcugcuuuaagauuuaccacaaaugugacaacgcuugcaucggguccauucgcaauggaacauaugaucaugacguauacagagacgaggcccugaacaauagguuccagaucaaggguguggaacucaaaagcggcuacaaggauuggauacuguggaucucuuuugcaauuucaugcuuccuucugugugucgccuugcucggguuuaucaugugggcuugccagaaaggaaacauucgguguaauaucugcauauga

SEQ ID NO: 133411 - RNA, 1701 nt, Artificial Sequence
  derived and/or modified sequence opt3 from hemagglutinin__InfluenzaA__AHL95578
augaagaccaucauugcccugagcuacauacucugccuuguguucgcucagaaacugcccggcaacgacgauuccacagcaacuuuguguuuagggcaccaugccgucccuaauggaacgaucguuaagaccauuacaaacgacagaaucgaggugacuaaugcgaccgaacugguacaaaacucuucaauuggugagaucugcgauaguccacaccagauacuagacggcgaaaauuguacacucaucgaugcucugcuuggggacccgcagugcgauggauuucagaacaaaaagugggaccuguucguggagaggagcaaagccuauuccaauuguuaccccuaugaugucccugacuacgcaucuuugcggucgcucguggccucaagcggcacccuggaauuuaacaaugagaguuucaacugggcugguguuacucaaaaugggacauccucugcaugcauucgcggaagcaacuccucauuuuucagucgacugaauuggcucacccauuuaaacuuuaaguauccagcccugaaugugacgaugcccaacaacgagcaguucgauaaguuguacaucuggggcguccaccauccuggcacugacaaagaucagauuuuucuuuaugcucagagcucugggcguaucaccguguccacaaagagaucacaacaggccguaauaccaaauauuggaagcaggccccggauccgcaacauuccuaguagaaucucuaucuacuggacuauuguuaaaccaggugacauacugcuaaucaauuccaccggcaaccucauugcgccgaggggguacuucaagauccggagcggaaaaucgucuauaaugcgcuccgacgcacccauuggcaaguguaagucagaaugcaucacaccuaaugguaguaucccaaacgauaaacccuuucagaaugugaaccgaauuaccuauggggccuguccuagauacgucaagcagagcacgcugaaacuugcuacuggaaugaggaaugugccagagaagcaaacacggggcaucuucggcgccauugcaggguuuauagaaaacggaugggaggguaugauggacggcugguauggguuccgucaccaaaauuccgagggacgcggccaggcugccgaucugaaaucuacccaggcggccaucgaccagauuaacgguaaguugaauagacucaucgggaaaacuaacgaaaaguuccaccagaucgagaaggaauuuagcgagguggaaggcaggauucaggaucuggagaaauacgucgaggacacaaagauagauuuauggucauauaaugcagaacugcucguugcucuugagaaccaacauaccaucgaccugacggauagugaaaugaacaaauuguucgagaagaccaaaaagcagcuacgggaaaaugccgaggacaugggaaacggcugcuuuaagauuuaccacaaaugugauaaugcuugcaucggguccauucgaaacggaacauaugaccaugacguguaccgcgaugaggcccugaauaacagauuccagaucaaggguguagaacucaaaagcggcuacaaggacuggauacuguggaucucuuuugcaauuucaugcuuccuucuguguguggccuugcucggguuuaucaugugggcuugccagaaaggaaauauuagguguaacaucugcauauga

SEQ ID NO: 133412 - RNA, 1701 nt, Artificial Sequence
  derived and/or modified sequence opt3 from hemagglutinin__InfluenzaA__AHL95590
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucuagcugcauucgccgauccaauucaaguuucuuuagccgucugaacuggcucacgcauuuaaauuuuaaguauccagcucugaacgugacuaugcccaacaaugagcaguucgacaaacuuuacaucuggggaguccaccauccuggcaccgauaaagaccagaucuuuuuguaugcacagucuuccggcagaauuacagugucaacuaagaggagccaacaggccguaauaccaaacauugggagucggccccgcaucagaaauauuccuucuaggaucuccaucuacuggaccauuguuaaaccaggagauauacugcuaaucaacagcacagguaaucucauugcuccgcggggcuacuucaagauccgcucggggaaaucuuccauaaugcgaucagacgcccccauuggaaaguguaagagugaaugcaucaccccuaacggcagcaucccaaaugacaaacccuuucagaacgugaauagaauuacguauggugcguguccuagguacgucaagcaguccacucugaaacuugcaacagggaugcggaacgugccagagaagcaaacccguggaaucuucggcgccauugcuggcuuuauagaaaaugggugggagggaaugguggaugguugguauggcuuccgccaccagaacucugaggggagaggacaggccgcagaccugaaaagcacucaagcugccaucgaucagauuaauggcaaguugaacaggcucaucgguaaaacaaaugaaaaguuccaccagaucgagaaggaauuuucagaggucgaagggcggauucaggaccuggagaaauacguugaggauaccaagauagacuuauggaguuauaacgcggaacugcucguggcccuugagaaccaacauacgaucgaucugaccgacuccgaaaugaauaaauuguucgagaagacaaagaagcagcuacgagaaaacgcagaggauaugggcaauggaugcuuuaagauuuaccacaaaugugacaacgcuugcaucggcagcauucgcaaugggacuuaugaucauaacguauacagagacgaggcccugaauaacagguuccagaucaagggaguggaacucaaaucugguuacaaggacuggauacuguggaucucauuugcuauuaguugcuuccuucugugugucgccuugcucggcuuuaucaugugggcaugccagaaagggaauauucgguguaacaucugcauauga

SEQ ID NO: 133413 - RNA, 1701 nt, Artificial Sequence; identical to SEQ ID NO: 131884
  derived and/or modified sequence opt3 from hemagglutinin__InfluenzaA__AHL95602

SEQ ID NO: 133414 - RNA, 1701 nt, Artificial Sequence; identical to SEQ ID NO: 131884
  derived and/or modified sequence opt3 from hemagglutinin__InfluenzaA__AHL95614

SEQ ID NO: 133415 - RNA, 1701 nt, Artificial Sequence
  derived and/or modified sequence opt3 from hemagglutinin__InfluenzaA__AHL95626
augaagaccaucauugcccugagcuacgugcucugccuugucuucgcucagaaacugcccggcaacgacaauuccacagcaacuuuguguuuagggcaccaugccguuccuaacggaacgauagugaagaccaucacaaaugauagaauugagguaacuaacgcgaccgaacuggugcaaaauucuucaaucggugagauuugcgacaguccacaccagauccuagauggcgaaaacuguacacucauagacgcucugcuuggggauccgcagugcgacggauuucagaauaaaaagugggaucuguucgucgagaggagcaaagccuauuccaacuguuaccccuaugacgugccugauuacgcaucuuugcggucgcucguugccucaagcggcacccuggaauuuaauaacgagaguuucaauugggcuggugugacucaaaacgggacauccucugcaugcauccgcggaagcaauuccucauuuuucagucgacugaacuggcucacccauuuaaauuuuaaguauccagcccugaacgucacgaugcccaacaaugagcaguucgacaaacuuuacauuuggggcgugcaccauccuggcacugauaaggaccagaucuuuuuguaugcucagagcucugggcguauuaccguauccacaaagagaucacaacaggccguuaucccaaacauaggaagcaggccccggauucgcaauaucccuaguagaauuucuaucuacuggacuaucgugaaaccaggugauauucugcuaauaaacuccaccggcaaucucaucgcgccgaggggguacuucaagauucggagcggaaaaucgucuaucaugcgcuccgacgcacccauaggcaaguguaagucagaaugcauuacaccuaacgguaguaucccaaaugacaaacccuuucagaacgucaaucgaaucaccuauggggccuguccuagauacgugaagcagagcacgcugaaacuugcuacuggaaugaggaacgugccagagaagcaaacacggggcauuuucggcgccaucgcaggguuuauugaaaauggaugggaggguauggucgauggcugguauggguuccgucaccagaacuccgagggacgcggccaggcugccgaccugaaaucuacccaagcggccauagaucagaucaaugguaaguugaacagacucauugggaaaacuaaugaaaaguuccaccagaucgagaaggaauuuagcgagguugaaggcaggauccaggaccuggagaaauacguggaggauacaaagauugacuuauggucauauaacgcagaacugcucguagcucuugagaaccaacauaccauagaucugacggacagugaaaugaauaaauuguucgagaagaccaaaaagcagcuacgggaaaacgccgaggauaugggaaauggcugcuuuaagaucuaccacaaaugugacaacgcuugcauuggguccauccgaaauggaacauaugaucaugacguguaccgcgacgaggcccugaacaauagauuccagauuaagggugucgaacucaaaagcggcuacaaggauuggauccuguggauaucuuuugcaaucucaugcuuccuucuguguguggccuugcucggguuuauuaugugggcuugccagaaaggaaacaucagguguaauauuugcaucuga

SEQ ID NO: 133416 - RNA, 1701 nt, Artificial Sequence; identical to SEQ ID NO: 131884
  derived and/or modified sequence opt3 from hemagglutinin__InfluenzaA__AHL95638

SEQ ID NO: 133417 - RNA, 1701 nt, Artificial Sequence; identical to SEQ ID NO: 131884
  derived and/or modified sequence opt3 from hemagglutinin__InfluenzaA__AHL95650

SEQ ID NO: 133418 - RNA, 1701 nt, Artificial Sequence
  derived and/or modified sequence opt3 from hemagglutinin__InfluenzaA__AHL95662
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaacuuuacaucuggggcguccaccauccuggcacugauaaagaccagaucuuuuuguaugcucagagcucugggcguauuaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugauggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgagguggaaggcaggauucaggaccuggagaaauacgucgaggauacaaagauagacuuauggucauauaacgcagaacugcucguuacccuugagaaccaacauacgaucgaucugaccgacagugaaaugaauaaauuguucgagaagacaaagaagcagcuacgggaaaacgcugaggauaugggaaauggcugcuuuaagauuuaccacaaaugugacaacgccugcaucggguccauucgaaauggaacuuaugaucaugacguguaccgcgacgaggcucugaacaauagauuccagaucaaggguguagaacucaaaagcggcuacaaggauuggauacuguggaucucuuuugccauuucaugcuuccuucuguguguggcauugcucggguuuaucaugugggccugccagaaaggaaacauuagguguaauaucugcauauga

SEQ ID NO: 133419 - RNA, 1701 nt, Artificial Sequence; identical to SEQ ID NO: 132010
  derived and/or modified sequence opt3 from hemagglutinin__InfluenzaA__AHL95686

SEQ ID NO: 133420 - RNA, 1701 nt, Artificial Sequence; identical to SEQ ID NO: 132010
  derived and/or modified sequence opt3 from hemagglutinin__InfluenzaA__AHL95698

SEQ ID NO: 133421 - RNA, 1701 nt, Artificial Sequence; identical to SEQ ID NO: 131884
  derived and/or modified sequence opt3 from hemagglutinin__InfluenzaA__AHL95710

SEQ ID NO: 133422 - RNA, 1701 nt, Artificial Sequence; identical to SEQ ID NO: 133398
  derived and/or modified sequence opt3 from hemagglutinin__InfluenzaA__AHL95722

SEQ ID NO: 133423 - RNA, 1701 nt, Artificial Sequence; identical to SEQ ID NO: 131874
  derived and/or modified sequence opt3 from hemagglutinin__InfluenzaA__AHL95734

SEQ ID NO: 133424 - RNA, 1701 nt, Artificial Sequence; identical to SEQ ID NO: 131874
  derived and/or modified sequence opt3 from hemagglutinin__InfluenzaA__AHL95746

SEQ ID NO: 133425 - RNA, 1701 nt, Artificial Sequence; identical to SEQ ID NO: 132013
  derived and/or modified sequence opt3 from hemagglutinin__InfluenzaA__AHL95758

SEQ ID NO: 133426 - RNA, 1701 nt, Artificial Sequence; identical to SEQ ID NO: 131884
  derived and/or modified sequence opt3 from hemagglutinin__InfluenzaA__AHL95770

SEQ ID NO: 133427 - RNA, 1701 nt, Artificial Sequence
  derived and/or modified sequence opt3 from hemagglutinin__InfluenzaA__AHL95782
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcaacaguccacaccagauacuagacggcgaaaauuguacacucaucgaugcucugcuuggggacccgcagugcgauggauuucagaacaaaaagugggaccuguucguggagaggagcaaagccuauuccaauuguuaccccuaugaugucccugacuacgcaucuuugcggucgcucguggccucaagcggcacccuggaauuuaacaaugagaguuucaacuggacugguguuacacaaaaugggaccuccucugcuugcauucgccgaagcaacuccucauuuuucagucgucugaauuggcucacgcauuuaaacuuuaaguauccagcacugaacgugacuaugcccaauaacgagcaguucgauaaacuuuacaucuggggaguccaccauccuggcaccgacaaagaucagaucuuuuuguaugcccagagcucuggcagaauuacaguguccacuaagaggucacaacaggcuguaauaccaaauauugggagccggccccgcaucagaaacauuccuaguaggaucucuaucuacuggaccauuguuaaaccaggagacauacugcuaaucaauuccacagguaaccucauugccccgcggggcuacuucaagauccgcagcgggaaaucgucuauaaugcgauccgaugcgcccauuggaaaguguaagucagaaugcaucaccccuaauggcaguaucccaaacgacaaacccuuucagaaugugaacagaauuacguauggugcauguccuagguacgucaagcagagcacucugaaacuugccacagggaugcggaaugugccagagaagcaaacccguggaaucuucggcgcuauugccggcuuuauagaaaacgggugggagggaaugguggacgguugguauggcuuccgccaccaaaauuccgaggggagaggacaggcagcugaucugaaaucuacucaggccgcgaucgaccagauuaacggcaaguugaauaggcucaucgguaaaacaaacgaaaaguuccaccagaucgagaaggaauuuagcgaggucgaagggcggauucaggaucuggagaaauacguugaggacaccaagauagauuuauggucauauaacgccgaacugcucguggcacuugagaaucaacauacgaucgaccugaccgauagugaaaugaacaaauuguucgagaagacaaagaagcagcuacgagaaaaugcugaggacaugggcaacggaugcuuuaagauuuaccacaaaugugauaaugccugcaucggcuccauucgcaacgggacuuaugaccaugauguauacagagacgaggcucugaauaacagguuccagaucaagggaguggaacucaaaagcgguuacaaggacuggauacuguggaucucuuuugccauuucaugcuuccuucugugugucgcauugcucggcuuuaucaugugggccugccagaaagggaauauucgguguaacaucugcauauga

SEQ ID NO: 133428 - RNA, 1701 nt, Artificial Sequence
  derived and/or modified sequence opt3 from hemagglutinin__InfluenzaA__AHL95794
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggaacaaagccuauagcaauuguuaccccuaugacgucccugauuacgcauccuugcggucucucguggccucgucaggcacccuggaauuuaacaaugagagcuucaacugggcugguguuacucaaaaugggacaaguuccgcaugcauucgcggaucuaacagcuccuuuuucucacgacugaauuggcucacccauuuaaacuuuaaguauccagcccugaacgugacgaugcccaauaacgagcaguucgacaaguuguacaucuggggcguccaccauccuggcacugauaaagaccagauuuuucuuuaugcucagaguagcgggcguaucaccgugucuacaaagagaucccaacaggccguaauaccaaauauuggaucaaggccccggauccgcaacauuccuagcagaaucaguaucuacuggacuauuguuaaaccaggugauauacugcuaaucaauucuaccggcaaccucauugcgccgaggggguacuucaagauccgguccggaaaaagcucgauaaugcgcucugacgcacccauuggcaaguguaaguccgaaugcaucacaccuaaugguucaaucccaaacgacaaacccuuucagaaugugaaccgaauuaccuauggggccuguccuagauacgucaagcagaguacgcugaaacuugcuacuggaaugaggaaugugccagagaagcaaacacggggcaucuucggcgccauugcaggguuuauagaaaacggaugggaggguaugguggauggcugguauggguuccgucaccagaauagcgagggacgcggccaggcugccgaccugaaauccacccaagcggccaucgaucagauuaacgguaaguugaauagacucaucgggaaaacuaacgaaaaguuccaccagaucgagaaggaauuuucugaggucgaaggcaggauucaggaccuggagaaauacguugaggauacaaagauagacuuauggagcuauaacgcagaacugcucguggcucuugagaaucaacauaccaucgaucugacggacucagaaaugaacaaauuguucgagaagaccaaaaagcagcuacgggaaaaugccgaggauaugggaaacggcugcuuuaagauuuaccacaaaugugacaaugcuugcaucgggaguauucgaaacggaacauaugaucaugacguauaccgcgacgaggcccugaauaacagauuccagaucaaggguguggaacucaaauccggcuacaaggauuggauacuguggaucagcuuugcaauuucuugcuuccuucugugugucgccuugcucggguuuaucaugugggcuugccagaaaggaaauauuagguguaacaucugcauauga

SEQ ID NO: 133429 - RNA, 1701 nt, Artificial Sequence
  derived and/or modified sequence opt3 from hemagglutinin__InfluenzaA__AHL95806
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggauucaggaccuggagaaauacguugaggauacaaagauagacuuauggucauauaacgcagaacugcucguggcucuugagaaccaacauaccaucgaucugacggacagugaaaugaauaaauuguucgagaagaccaaaaagcagcuacgggaaaacgccgaggauaugggaaauggcugcuuuaagauuuaccacaaaugugacaacgcuugcaucggguccauucgaaauggaacauaugaucaugacguauaccgcgacgaggcccugaacaauagauuccagaucaaggguguggaacucaaaagcggcuacaaggauuggauacuguggaucucuuuugcaauuucaugcuuccuucugugugucgccuugcucgggaguaucaugugggcuugccagaaaggaaacauuagguguaauaucugcauauga

SEQ ID NO: 133430 - RNA, 1701 nt, Artificial Sequence; identical to SEQ ID NO: 132010
  derived and/or modified sequence opt3 from hemagglutinin__InfluenzaA__AHL95818

SEQ ID NO: 133431 - RNA, 1701 nt, Artificial Sequence; identical to SEQ ID NO: 131874
  derived and/or modified sequence opt3 from hemagglutinin__InfluenzaA__AHL95830

SEQ ID NO: 133432 - RNA, 1701 nt, Artificial Sequence; identical to SEQ ID NO: 132010
  derived and/or modified sequence opt3 from hemagglutinin__InfluenzaA__AHL95842

SEQ ID NO: 133433 - RNA, 1701 nt, Artificial Sequence; identical to SEQ ID NO: 131874
  derived and/or modified sequence opt3 from hemagglutinin__InfluenzaA__AHL95854

SEQ ID NO: 133434 - RNA, 1701 nt, Artificial Sequence; identical to SEQ ID NO: 131884
  derived and/or modified sequence opt3 from hemagglutinin__InfluenzaA__AHL95866

SEQ ID NO: 133435 - RNA, 1701 nt, Artificial Sequence
  derived and/or modified sequence opt3 from hemagglutinin__InfluenzaA__AHL95878
augaaggccauccuggugauuaugcucuacaccuucgcuacagcaaacgccgacacucuuugcauaggcuaucacgcgaauaacagcacggauaccgucgacacaguucuggagaaaaaugugacuguaacccauuccgugaacuuguuagaagauaagcacaaugggaaacuguguaagcuaagaggagucucuccccuccaucuggguaaaugcaacaucgcuggcuggauucuugggaauccugagugugaaucacugaguacagccagcuccuggucuuacaucguggagaccucgggaucagacaacggcacuugcuauccaggugauuuuauugacuacgaagaguugagggagcagcucagcaguguuuccucuuucgaacgguuugagaucuucccgaagacaagcuccuggcccaaucacgauucaaacaagggggugaccgcagccuguccucaugcuggagcaaaaggcuuuuauaagaaucugauauggcuggucaaaaagggcaacaguuacccaaaacucagcaucucuuauauuaaugacaaggggaaggaaguguuaguacuguggggaauccaccaccccuccacgacugccgaucaacagucacuuuaccagaacgcugacaccuacguuuucguggguacaagccgcuauaguaaaaaguuuaaaccugagauugccauccgaccaaagguccgugaucaggagggcagaaugaauuacuauuggacuuugguggaacccggggacaaaauaaccuucgaggcgacaggaaaccugguggucccuagguacgcauuugccauggaacggaacgcuggcucugguauuaucauuuccgauaccccaguucaugacugcaauacgacuugucaaacaccgaagggggccaucaacaccagccuacccuuccagaauauccacccuauuacuauaggaaaaugcccaaaguaugugaagucgacaaaacuccgccuggcaaccggccuuagaaacguacccucuauccaguccaggggccuguuuggggcuauugccggauucaucgaggguggcuggacggggaugguggacggaugguacggcuaucaucaccagaaugaacaagguucaggguacgcggccgauuugaagaguacccagaacgcaauagacaaaauuacaaauaaggucaacagcgugaucgagaaaaugaauacucaguuuaccgcuguuggcaaggaguucaaccaccucgaaaagcggaucgagaaucugaacaaaaagguggaugacggauucuuagauauuuggacauacaaugccgaacugcucguccuucuggagaacgaacgcacuuuggacuaucaugauuccaaugugaaaaaccuauacgagaagguacgaaaccagcugaaaaauaacgcuaaggagaucggcaauggguguuuugaguucuaucacaagugcgacaacaccuguauggaaucuguuaaaaauggaacauacgauuauccuaaguacagcgaagaggccaaacucaacagagaagagauugacggugugaagcuggagucaaccaggauauaucaaauccuugcaauuuacaguacugccgcuuccagccuggucuugguggucucucucggcgcgaucucauuuuggaugugcaguaaugggagccugcagugccggaucuguauuuga

SEQ ID NO: 133436 - RNA, 1701 nt, Artificial Sequence; identical to SEQ ID NO: 131884
  derived and/or modified sequence opt3 from hemagglutinin__InfluenzaA__AHL95889

SEQ ID NO: 133437 - RNA, 1701 nt, Artificial Sequence; identical to SEQ ID NO: 132010
  derived and/or modified sequence opt3 from hemagglutinin__InfluenzaA__AHL95901

SEQ ID NO: 133438 - RNA, 1701 nt, Artificial Sequence; identical to SEQ ID NO: 132010
  derived and/or modified sequence opt3 from hemagglutinin__InfluenzaA__AHL95913

SEQ ID NO: 133439 - RNA, 1701 nt, Artificial Sequence
  derived and/or modified sequence opt3 from hemagglutinin__InfluenzaA__AHL95937
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaacuuuacaucuggggcguccaccauccuggcacugauaaagaccagaucuuuuuguaugcucagagcucugggcguauuaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggauucaggaccuggagaaauacguugaggauacaaagaccgacuuauggucauauaacgcagaacugcucguggcucuugagaaccaacauacgauagaucugaccgacagugaaaugaauaaauuguucgagaagacaaagaagcagcuacgggaaaacgccgaggauaugggaaauggcugcuuuaagaucuaccacaaaugugacaacgcuugcauuggguccauccgaaauggaacuuaugaucaugacguauaccgcgacgaggcccugaacaauagauuccagauuaaggguguggaacucaaaagcggcuacaaggauuggauccuguggauaucuuuugcaaucucaugcuuccuucugugugucgccuugcucggguuuauuaugugggcuugccagaaaggaaacaucagguguaauauuugcaucuga

SEQ ID NO: 133440 - RNA, 1701 nt, Artificial Sequence
  derived and/or modified sequence opt3 from hemagglutinin__InfluenzaA__AHL95949
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauaacuccuuuuucucacgucugaauuggcucacgcauaguaacuuuaaguauccagcauuaaacaugacuaugcccaauaacgagcaguucgacaagcuguacaucuggggagugcaccauccuggcaccgauaaagaccagauuuuucuuuaugcccagagcucuggcagaaucacagucuccacuaagaggucacaacaggcugugauaccaaauauugggagccggccccgcaucagaaacauuccuaguaggaucucuaucuacuggaccauuguaaaaccaggagauauauugcugaucaauuccacagguaaccuaauugccccgcggggcuacuucaagauccgcagcgggaaaucgucuauaaugcgauccgacgcgcccauuggaaaguguaagucagaaugcaucaccccuaauggcaguaucccaaacgacaaacccuuucagaauguuaacagaauuacguauggugcauguccuagguacgugaagcagagcacucucaaacuggccacagggaugcggaaugucccagagaagcaaacccguggaaucuucggcgcuauugccggcuuuauagaaaacgggugggagggaaugauggaugguugguauggcuuccgccaccaaaauuccgaggggagaggacaggcagcugaccuuaaaucuacucaggccgcgaucgaucagauuaacggcaagcugaauagguugaucgguaaaacaaacgaaaaguuccaccagaucgagaaggaauuuagcgagguggaagggcggauucaggaccucgagaaauacguggaggauaccaagauagaccuguggucauauaacgccgaauuacuggucgcacucgagaaucaacauacgaucgaucuuaccgacagugaaaugaacaaacuguucgagaagacuaaaaagcaguugcgagaaaaugcugaggauaugggcaacggaugcuuuaagauuuaccacaaaugugacaaugccugcaucggcuccauucgcaacgggacauaugaucaugacguuuacagagacgaggcucuaaauaacagguuccagaucaagggaguggaacugaaaagcgguuacaaggauuggauacucuggaucucuuuugccauuucaugcuuccugcuuuguguagcacuguugggcuuuaucaugugggccugccagaaagggaauauucgguguaacaucugcauauga

SEQ ID NO: 133441 - RNA, 1701 nt, Artificial Sequence; identical to SEQ ID NO: 131884
  derived and/or modified sequence opt3 from hemagglutinin__InfluenzaA__AHL95961

SEQ ID NO: 133442 - RNA, 1701 nt, Artificial Sequence; identical to SEQ ID NO: 131884
  derived and/or modified sequence opt3 from hemagglutinin__InfluenzaA__AHL95973

SEQ ID NO: 133443 - RNA, 1701 nt, Artificial Sequence; identical to SEQ ID NO: 131884
  derived and/or modified sequence opt3 from hemagglutinin__InfluenzaA__AHL95985

SEQ ID NO: 133444 - RNA, 1701 nt, Artificial Sequence
  derived and/or modified sequence opt3 from hemagglutinin__InfluenzaA__AHL95997
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucuagcugcauucgcggauccaagucaaguuucuuuagccgacugaauuggcucacccauuuaaacuuuaaguauccagcacugaaugugacgaugcccaacaacgagcaguucgacaaacuuuacaucuggggcguccaccauccuggcacugauaaggaccagauuuuucuuuaugcccagucuuccgggcguaucaccgugucaacaaaaagaagccaacaggcuguaauaccaaauauuggaaguaggccccggauccgcaacauuccuucuagaaucuccaucuacuggacuauuguuaagccaggugauauacugcuaaucaauagcaccggcaaccucauugccccgaggggguacuucaaaauccggucgggaaagucuuccauaaugcgcucagacgcgcccauuggcaaguguaaaagugaaugcaucacaccuaaugguagcaucccaaacgacaagcccuuucagaaugugaaccgaauuaccuauggggcauguccuagauacgucaaacaguccacgcugaaguuggccacuggaaugaggaaugugccagagaaacaaacacggggcaucuucggcgcuauugccggguuuauagaaaacggaugggaggguaugauggauggcugguauggguuccgucaccagaauagcgagggacgcggccaggcagcugaccugaagucuacccaagccgcgaucgaucagauuaacgguaaauugaauagacucaucgggaagacuaacgaaaaguuccaccagaucgagaaagaauuuucagagguggaaggcaggauucaggaccuggagaaguacgucgaggauacaaaaauagacuuauggaguuauaaugccgaacugcucguugcacuugagaaccaacauaccaucgaucugacggacuccgaaaugaacaaguuguucgagaaaaccaagaagcagcuacgggaaaaugcugaggauaugggaaacggcugcuuuaaaauuuaccacaagugugacaaugccugcaucgggagcauucgaaacggaacauaugaucaugacguguaccgcgacgaggcucugaauaacagauuccagaucaaagguguagaacucaagucuggcuacaaagauuggauacuguggaucucauuugccauuaguugcuuccuucuguguguggcauugcucggguuuaucaugugggccugccagaagggaaauauuagguguaacaucugcauauga

SEQ ID NO: 133445 - RNA, 1701 nt, Artificial Sequence
  derived and/or modified sequence opt3 from hemagglutinin__InfluenzaA__AHL96021
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaaguccucauuuuucagucgacugaauuggcucacccauuuaaacuuuaaguauccagcccugaaugugacgaugcccaacaacgagcaguucgacaaacuuuacaucuggggcguccaccauccuggcacugauaaggaccagauuuuucuuuaugcucagagcucugggcguaucaccguguccacaaaaagaucacaacaggccguaauaccaaauauuggaagcaggccccggauccgcaacauuccuaguagaaucucuaucuacuggacuauuguuaagccaggugauauacugcuaaucaauuccaccggcaaccucauugcgccgaggggguacuucaaaauccggagcggaaagucgucuauaaugcgcuccgacgcacccauuggcaaguguaaaucagaaugcaucacaccuaaugguaguaucccaaacgacaagcccuuucagaaugugaaccgaauuaccuauggggccuguccuagauacgucaaacagagcacgcugaaguuggcuacuggaaugaggaaugugccagagaaacaaacacggggcaucuucggcgccauugcaggguuuauagaaaacggaugggaggguaugauggauggcugguauggguuccgucaccaaaauuccgagggacgcggccaggcugccgaccugaagucuacccaggcggccaucgaucagauuaacgguaaauugaauagacucaucgggaagacuaacgaaaaguuccaccagaucgagaaagaauuuagcgagguggaaggcaggauucaggaccuggagaaguacgucgaggauacaaaaauagacuuauggucauauaaugcagaacugcucguugcucuugagaaccaacauaccaucgaucugacggacagugaaaugaacaaguuguucgagaaaaccaagaagcagcuacgggaaaaugccgaggauaugggaaacggcugcuuuaaaauuuaccacaagugugacaaugcuugcaucggguccauucgaaacggaacauaugaucaugacguguaccgcgacgaggcccugaauaacagauuccagaucaaagguguagaacucaagagcggcuacaaagauuggauacuguggaucucuuuugcaauuucaugcuuccuucuguguguggccuugcucggguuuaucaugugggcuugccagaagggaaauauuagguguaacaucugcauauga

SEQ ID NO: 133446 - RNA, 1701 nt, Artificial Sequence; identical to SEQ ID NO: 131884
  derived and/or modified sequence opt3 from hemagglutinin__InfluenzaA__AHL96033

SEQ ID NO: 133447 - RNA, 1701 nt, Artificial Sequence; identical to SEQ ID NO: 132139
  derived and/or modified sequence opt3 from hemagglutinin__InfluenzaA__AHL96045

SEQ ID NO: 133448 - RNA, 1701 nt, Artificial Sequence; identical to SEQ ID NO: 132010
  derived and/or modified sequence opt3 from hemagglutinin__InfluenzaA__AHL96056

SEQ ID NO: 133449 - RNA, 1701 nt, Artificial Sequence; identical to SEQ ID NO: 131874
  derived and/or modified sequence opt3 from hemagglutinin__InfluenzaA__AHL96068

SEQ ID NO: 133450 - RNA, 1701 nt, Artificial Sequence; identical to SEQ ID NO: 131884
  derived and/or modified sequence opt3 from hemagglutinin__InfluenzaA__AHL96080

SEQ ID NO: 133451 - RNA, 1701 nt, Artificial Sequence
  derived and/or modified sequence opt3 from hemagglutinin__InfluenzaA__AHL96092
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucauugagaggagcaaagccuauuccaacuguuaccccuaugacgugccugauuacgcaucuuugcggucgcucgucgccucaagcggcacccuggaauuuaauaacgagaguuucaauugggcuggugugacucaaaacgggacauccucugcaugcauccgcggaagcaauuccucauuuuucagucgacugaacuggcucacccauuuaaauuuuaaguauccagcccugaacguuacgaugcccaacaaugagcaguucgacaaacuuuacauuuggggcgugcaccauccuggcacugauaaggaccagaucuuuuuguaugcucagagcucugggcguauaaccgucuccacaaagagaucacaacaggccgugauuccaaacaucggaagcaggccccggauucgcaauaucccuaguagaaucucuauuuacuggacuauaguaaaaccaggugauauccugcuaauuaacuccaccggcaaucucaucgcgccgaggggguacuucaagauacggagcggaaaaucgucuauuaugcgcuccgacgcacccaucggcaaguguaagucagaaugcaucacaccuaacgguaguauuccaaaugacaaacccuuucagaacguuaaucgaaucaccuauggggccuguccuagauacgugaagcagagcacgcugaaacuugcuacuggaaugaggaacgucccagagaagcaaacacggggcauuuucggcgccauagcaggguuuaucgaaaauggaugggaggguaugguggauggcugguauggguuccgucaccagaacuccgagggacgcggccaggcugccgaccugaaaucuacccaagcggccauugaucagaucaaugguaaguugaacagacucaucgggaaaacuaaugaaaaguuccaccagauugagaaggaauuuagcgagguggaaggcaggauacaggaccuggagaaauacgucgaggauacaaagaucgacuuauggucauauaacgcagaacugcucguugcucuugagaaccaacauaccauugaucugacggacagugaaaugaauaaauuguucgagaagaccaaaaagcagcuacgggaaaacgccgaggauaugggaaauggcugcuuuaagaucuaccacaaaugugacaacgcuugcauuggguccauccgaaauggaacauaugaucaugacguguaccgcgacgaggcccugaacaauagauuccagauaaaggguguagaacucaaaagcggcuacaaggauuggauccuguggauuucuuuugcaaucucaugcuuccuucuguguguggccuugcucggguuuauuaugugggcuugccagaaaggaaacaucagguguaauauaugcauuuga

SEQ ID NO: 133452 - RNA, 1701 nt, Artificial Sequence
  derived and/or modified sequence opt3 from hemagglutinin__InfluenzaA__AHL96104
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaguuguacaucuggggaguccaccauccuggcaccgauaaagaccagauuuuucuuuaugcccagagcucuggcagaaucacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagcgucaaacccgcggaaucuucggcgcuauugccggcuuuauagaaaaugggugggagggaaugguggaugguugguauggcuucagacaccagaacuccgaggggaggggacaggcagcugaccugaagucuacucaagccgcgaucgaucagauuaauggcaaauugaaccggcucaucgguaagacaaaugaaaaauuccaccagaucgagaaggaauuuagcgaggucgaagggcgcauucaggaccuggagaaguacguugaggauaccaaaauagacuuauggucauauaacgccgaacugcucguggcacuugagaaccaacauacgaucgaucugaccgacagugaaaugaauaaguuguucgagaaaacaaagaaacagcuacgagaaaacgcugaggauaugggcaauggaugcuuuaagauuuaccacaagugugacaacgccugcaucggcuccauuagaaaugggacuuaugaucauaacguauacagggacgaggcucugaauaaccgguuccagaucaaaggaguggaacucaagagcgguuacaaagacuggauacuguggaucucuuuugccauuucaugcuuccuucugugugucgcauugcucggcuuuaucaugugggccugccagaaggggaauauucgcuguaacaucugcauauga

SEQ ID NO: 133453 - RNA, 1701 nt, Artificial Sequence; identical to SEQ ID NO: 132498
  derived and/or modified sequence opt3 from hemagglutinin__InfluenzaA__AHL96116

SEQ ID NO: 133454 - RNA, 1701 nt, Artificial Sequence; identical to SEQ ID NO: 131874
  derived and/or modified sequence opt3 from hemagglutinin__InfluenzaA__AHL96128

SEQ ID NO: 133455 - RNA, 1701 nt, Artificial Sequence; identical to SEQ ID NO: 132010
  derived and/or modified sequence opt3 from hemagglutinin__InfluenzaA__AHL96152

SEQ ID NO: 133456 - RNA, 1701 nt, Artificial Sequence
  derived and/or modified sequence opt3 from hemagglutinin__InfluenzaA__AHL96164
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggauucaggaccuggagaaauacguugaggauacaaagauagacuuauggucauauaacgcagaacugcucguggcucuugagaaccaacauaccaucgaucugacggacagugaaaugaauaaauuguucgagaagaccaaaaagcagcuacgggaaaacgccgaggauaugggaaauggcugcuuuaagauuuaccacaaaugugacaacgcuugcaucggguccauucgaaauggaacauaugaucaugacguauaccgcgacgaggcccugaacaauagauuccagaucaaggguguggaacucaaaagcggcuacaagaacuggauacuguggaucucuuuugcaauuucaugcuuccuucugugugucgccuugcucggguuuaucaugugggcuugccagaaaggaaauauuagguguaacaucugcauauga

SEQ ID NO: 133457 - RNA, 1701 nt, Artificial Sequence; identical to SEQ ID NO: 132010
  derived and/or modified sequence opt3 from hemagglutinin__InfluenzaA__AHL96176

SEQ ID NO: 133458 - RNA, 1701 nt, Artificial Sequence; identical to SEQ ID NO: 132010
  derived and/or modified sequence opt3 from hemagglutinin__InfluenzaA__AHL96188

SEQ ID NO: 133459 - RNA, 1701 nt, Artificial Sequence
  derived and/or modified sequence opt3 from hemagglutinin__InfluenzaA__AHL96200
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccaggugcuagauggcgaaaacuguacacucauagacgcucugcuuggggauccgcagugcgacggauuucagaauaaaaagugggaucuguucgucgagaggagcaaagccuauuccaacuguuaccccuaugacgugccugauuacgcaucuuugcggucgcucguugccucaagcggcacccuggaauuuaauaacgagaguuucaauugggcuggugugacucaaaacgggacauccucugcaugcauccgcggaagcaauuccucauuuuucagucgacugaacuggcucacccauuuaaauuuuaaguauccagcccugaacgucacgaugcccaacaaugagcaguucgacaaacuuuacauuuggggcgugcaccauccuggcacugauaaggaccagaucuuuuuguaugcucagagcucugggcguauuaccguauccacaaagagaucacaacaggccguuaucccaaacauaggaagcaggccccggauucgcaauaucccuaguagaauuucuaucuacuggacuaucgugaaaccaggugauauucugcuaauaaacuccaccggcaaucucaucgcgccgaggggguacuucaagauucggagcggaaaaucgucuaucaugcgcuccgacgcacccauaggcaaguguaagucagaaugcauuacaccuaacgguaguaucccaaaugacaaacccuuucagaacgucaaucgaaucaccuauggggccuguccuagauacgugaagcagagcacgcugaaacuugcuacuggaaugaggaacgugccagagaagcaaacacggggcauuuucggcgccaucgcaggguuuauugaaaauggaugggaggguauggucgauggcugguauggguuccgucaccagaacuccgagggacgcggccaggcugccgaccugaaaucuacccaagcggccauagaucagaucaaugguaaguugaacagacucauugggaaaacuaaugaaaaguuccaccagaucgagaaggaauuuagcgagguugaaggcaggauccaggaccuggagaaauacguggaggauacaaagauugacuuauggucauauaacgcagaacugcucguagcucuugagaaccaacauaccauagaucugacggacagugaaaugaauaaauuguucgagaagaccaaaaagcagcuacgggaaaacgccgaggauaugggaaauggcugcuuuaagaucuaccacaaaugugacaacgcuugcauuggguccauccgaaauggaacauaugaucaugacguguaccgcgacgaggcccugaacaauagauuccagauuaagggugucgaacucaaaagcggcuacaaggauuggauccuguggauaucuuuugcaaucucaugcuuccuucuguguguggccuugcucggguuuauuaugugggcuugccagaaaggaaacaucagguguaauauuugcaucuga

SEQ ID NO: 133460 - RNA, 1701 nt, Artificial Sequence; identical to SEQ ID NO: 131874
  derived and/or modified sequence opt3 from hemagglutinin__InfluenzaA__AHL96212

SEQ ID NO: 133461 - RNA, 1701 nt, Artificial Sequence; identical to SEQ ID NO: 132483
  derived and/or modified sequence opt3 from hemagglutinin__InfluenzaA__AHL96224

SEQ ID NO: 133462 - RNA, 1701 nt, Artificial Sequence
  derived and/or modified sequence opt3 from hemagglutinin__InfluenzaA__AHL96236
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaaugggugagauuugcgacaguccacaccagauccuagauggcgaaaacuguacacucauagacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauccgccgaagcaauuccucauuuuucagucgucugaacuggcucacgcauuuaaauuuuaaguauccagcacugaacgugacuaugcccaacaaugagcaguucgacaaacuuuacauuuggggaguccaccauccuggcaccgauaaagaccagaucuuuuuguaugcccagagcucuggcagaauuacaguguccacuaagaggucacaacaggcuguaaucccaaacauagggagccggccccgcauuagaaauaucccuaguaggauuucuaucuacuggaccaucguuaaaccaggagauauucugcuaauaaacuccacagguaaucucaucgccccgcggggcuacuucaagauucgcagcgggaaaucgucuaucaugcgauccgacgcgcccauaggaaaguguaagucagaaugcauuaccccuaacggcaguaucccaaaugacaaacccuuucagaacgugaauagaaucacguauggugcauguccuagguacgucaagcagagcacucugaaacuugccacagggaugcggaacgugccagagaagcaaacccguggaauuuucggcgcuaucgccggcuuuauugaaaaugggugggagggaaugguggaugguugguauggcuuccgccaccagaacuccgaggggagaggacaggcagcugaccugaaaucuacucaagccgcgauagaucagaucaauggcaaguugaacaggcucauugguaaaacaaaugaaaaguuccaccagaucgagaaggaauuuagcgaggucgaagggcggauccaggaccuggagaaauacguugaggauaccaagauugacuuauggucauauaacgccgaacugcucguggcacuugagaaccaacauacgauagaucugaccgacagugaaaugaauaaauuguucgagaagacaaagaagcagcuacgagaaaacgcugaggauaugggcaauggaugcuuuaagaucuaccacaaaugugacaacgccugcauugaguccauccgcaauggcacuuaugaucaugacguauacagagacgaagcucugaacaauagguuccagauuaaggggguggagcucaaaagcggauacaagaacuggauccuguggauaucuuuugccaucucaugcuuccuucugugugucgcauugcucgguuuuauuaugugggccugccagaaaggcaauauccgguguaacauuugcaucuga

SEQ ID NO: 133463 - RNA, 1701 nt, Artificial Sequence
  derived and/or modified sequence opt3 from hemagglutinin__InfluenzaA__AHL96248
augaagaccaucauugcccugggcuacauacucugccuuguguucgcucagaaacugcccgggaacgacaauagcacagcaacuuuguguuuaggacaccaugccgucccuaacgguacgaucguuaagaccauuacaaaugauagaaucgaggugacuaacgcgaccgaacugguacaaaauuccucuauuggcgagaucugcgacucaccacaccagauacuagauggggaaaacuguacacucaucgacgcucugcuuggagauccgcagugcgacggcuuucagaauaaaaagugggaucuguucauugagaggaguaaagccuauagcaacuguuaccccuaugacgugccugauuacgcauccuugcggucucucgucgccucgucagguacccuggaauuuaauaacgagagcuucaauuggacuggggugacacaaaacggaaccaguuccgcuugcauccgccgaucuaauagcuccuuuuucucacgucugaacuggcucacgcauuuaaauuuuaaguauccagcacugaacguuacuaugcccaacaaugagcaguucgacaaacuuuacauuuggggcgugcaccauccuggcaccgauaaagaccagaucuuuuuguaugcccagaguagcgggagaauaacagucucuacuaagaggucccaacaggcugugauuccaaacaucggaucacggccccgcauuagaaauaucccuagcaggaucaguauuuacuggaccauaguaaaaccaggugauauccugcuaauuaacucuacaggcaaucucaucgccccgcggggguacuucaagauacgcuccggaaaaagcucgauuaugcgaucugacgcgcccaucggcaaguguaaguccgaaugcaucaccccuaacgguucaauuccaaaugacaaacccuuucagaacguuaauagaaucacguauggggcauguccuagguacgugaagcagaguacucugaaacuugccacaggaaugcggaacgucccagagaagcaaacccguggcauuuucggcgcuauagccggguuuaucgaaaauggaugggaggguaugguggauggcugguauggguuccgccaccagaacagcgagggaagaggccaggcagcugaccugaaauccacucaagccgcgauugaucagaucaaugguaaguugaacaggcucaucgggaaaacaaaugaaaaguuccaccagauugagaaggaauuuucugagguggaaggccggauacaggaccuggagaaauacgucgaggauaccaagaucgacuuauggagcuauaacgccgaacugcucguugcacuugagaaccaacauacgauugaucugaccgacucagaaaugaauaaauuguucgagaagacaaagaagcagcuacgagaaaacgcugaggauaugggaaauggcugcuuuaagaucuaccacaaaugugacaacgccugcauugggaguauccgcaauggaacuuaugaucaugacguguacagagacgaggcucugaacaauagguuccagauaaaggguguagaacucaaauccggcuacaaggauuggauccuguggauuagcuuugccaucucuugcuuccuucuguguguggcauugcucggguuuauuaugugggccugccagaaaggaaacauccgguguaauauaugcauuuga

SEQ ID NO: 133464 - RNA, 1701 nt, Artificial Sequence; identical to SEQ ID NO: 132010
  derived and/or modified sequence opt3 from hemagglutinin__InfluenzaA__AHL96260

SEQ ID NO: 133465 - RNA, 1701 nt, Artificial Sequence; identical to SEQ ID NO: 131874
  derived and/or modified sequence opt3 from hemagglutinin__InfluenzaA__AHL96274

SEQ ID NO: 133466 - RNA, 1701 nt, Artificial Sequence; identical to SEQ ID NO: 132010
  derived and/or modified sequence opt3 from hemagglutinin__InfluenzaA__AHL96304

SEQ ID NO: 133467 - RNA, 1701 nt, Artificial Sequence; identical to SEQ ID NO: 131851
  derived and/or modified sequence opt3 from hemagglutinin__InfluenzaA__AHL96318

SEQ ID NO: 133468 - RNA, 1701 nt, Artificial Sequence; identical to SEQ ID NO: 132010
  derived and/or modified sequence opt3 from hemagglutinin__InfluenzaA__AHL96330

SEQ ID NO: 133469 - RNA, 1701 nt, Artificial Sequence; identical to SEQ ID NO: 132013
  derived and/or modified sequence opt3 from hemagglutinin__InfluenzaA__AHL96342

SEQ ID NO: 133470 - RNA, 1701 nt, Artificial Sequence
  derived and/or modified sequence opt3 from hemagglutinin__InfluenzaA__AHL96354
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccugaacuccgagggacgcggccaggcugccgacuugaaaucuacccaggcggccaucgaucaaauuaaugguaagcucaacagacugaucgggaaaacuaaugaaaaguuccaccagaucgagaaggaauuuagcgaggucgaaggcaggauucaggacuuagagaaauacguugaggauacaaagauagaccuguggucauauaacgcagaacuccuuguggcucuggagaaccagcauaccaucgauuugacggacagugaaaugaauaaacuauucgagaagaccaaaaagcaacugcgggaaaacgccgaggauaugggaaauggcugcuuuaagauuuaccacaaaugugacaacgcuugcaucggguccauucgaaauggaacauaugaucaugacguauaccgcgacgaggcccucaacaauagauuccagaucaaggguguggaacugaaaagcggcuacaaggauuggauacuuuggaucucuuuugcaauuucaugcuuccuguugugugucgcccuccugggguuuaucaugugggcuugccagaaaggaaacauuagguguaauaucugcauauga

SEQ ID NO: 133471 - RNA, 1701 nt, Artificial Sequence
  derived and/or modified sequence opt3 from hemagglutinin__InfluenzaA__AHL96366
augaagaccaucauugcccugagcuacauacucugccuuguguucgcucagaaacugcccgagaacgacaauuccacagcaacuuuguguuuaggccaccaugccgucccuaacgggacgaucguuaagaccauuacaaaugauagaaucgaagugacuaacgcgaccgagcugguacaaaauucuucaauuggagaaaucugcgacaguccacaccagauacuagauggugagaacuguacacucaucgacgcucugcuuggcgauccgcagugcgacggguuucagaauaaaaagugggaucuguucguggaaaggagcaaagccuauuccaacuguuaccccuaugacgucccugauuacgcaucuuugcggucgcucguggccucaagcggaacccuggaguuuaauaacgagaguuucaauugggcuggcguuacucaaaacgguacauccucugcaugcauucgcgggagcaauuccucauuuuucagucgacugaacuggcucacccauuuaaauuuuaaguauccagcccugaacgugacgaugcccaacaaugaacaguucgacaaguuguacaucuggggaguccaccauccuggcacugauaaagaccagauuuuucuuuaugcucagagcucuggccguaucaccguguccacaaagagaucacaacaggccguaauaccaaacauugggagcaggccccggauccgcaauauuccuaguagaaucucuaucuacuggacuauuguuaaaccaggagauauacugcuaaucaacuccaccgguaaucucauugcgccgaggggcuacuucaagauccggagcgggaaaucgucuauaaugcgcuccgacgcacccauuggaaaguguaagucagagugcaucacaccuaacggcaguaucccaaaugacaaacccuuucagaacgugaaucgaauuaccuauggugccuguccuagauacgucaagcagagcacgcugaaacuugcuacugggaugaggaacgugccagaaaagcaaacacggggaaucuucggcgccauugcaggcuuuauagagaaugggugggagggaaugguggaugguugguauggcuuccgucaccagaacuccgaagggcgcggacaggcugccgaccugaaaucuacccaagcggccaucgaucagauuaauggcaaguugaacagacucaucgguaaaacuaaugagaaguuccaccagaucgaaaaggaguuuagcgaagucgaggggaggauucaggaccuggagaaauacguugaagauacaaagauagacuuauggucauauaacgcagagcugcucguggcucuugaaaaccaacauaccaucgaucugacggacagugagaugaauaaauuguucgaaaagaccaaaaagcagcuacgggagaacgccgaggauaugggcaauggaugcuuuaagauuuaccacaaaugugacaacgcuugcaucggcuccauucgaaaugggacauaugaucaugacguauaccgcgacgaagcccugaacaauagauuccagaucaagggaguggagcucaaaagcgguuacaaggauuggauacuguggaucucuuuugcaauuucaugcuuccuucugugugucgccuugcucggcuuuaucaugugggcuugccagaaagggaacauuagguguaauaucugcauauga

SEQ ID NO: 133472 - RNA, 1701 nt, Artificial Sequence; identical to SEQ ID NO: 131884
  derived and/or modified sequence opt3 from hemagglutinin__InfluenzaA__AHL96378

SEQ ID NO: 133473 - RNA, 1701 nt, Artificial Sequence; identical to SEQ ID NO: 131874
  derived and/or modified sequence opt3 from hemagglutinin__InfluenzaA__AHL96390

SEQ ID NO: 133474 - RNA, 1701 nt, Artificial Sequence
  derived and/or modified sequence opt3 from hemagglutinin__InfluenzaA__AHL96402
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcggaagcaauuccucauuuuucagucgacugaacuggcugacgcaucucaauuuuaaguauccagcauuaaacgugacuaugcccaacaaugagcaguucgacaagcuguacauuuggggcguccaccauccuggcaccgauaaagaccagaucuuucuuuaugcccagagcucugggcguauaacaguguccacuaagagaucacaacaggcuguaauuccaaacaucggaagcaggccccggauucgcaauaucccuaguagaaucucuauuuacuggaccauaguuaaaccaggugauaucuugcugauuaacuccacaggcaaucuaaucgccccgaggggguacuucaagauacggagcggaaaaucgucuauuaugcgcuccgacgcgcccaucggcaaguguaagucagaaugcaucaccccuaacgguaguauuccaaaugacaaacccuuucagaacgugaaucgaaucacguauggggcauguccuagauacgucaagcagagcacucucaaacuggccacaggaaugaggaacgugccagagaagcaaacccggggcauuuucggcgcuauagccggguuuaucgaaaauggaugggaggguaugguggauggcugguauggguuccgucaccagaacuccgagggacgcggccaggcagcugaccuuaaaucuacucaagccgcgauugaucagaucaaugguaagcugaacagauugaucgggaaaacaaauaagaaguuccaccagauugaaaaagaguuuagcgaagucgagggcaggauacaggaccucgaaaaguacguugaggauaccaaaaucgaccuguggucauauaacgccgaguuacugguggcacucgaaaaccaacauacgauugaucuuaccgacagugagaugaauaagcuguucgaaaagacaaagaagcaguugcgggagaacgcugaagauaugggaaauggcugcuuuaaaaucuaccacaagugugacaacgccugcauuggguccauccgaaauggaacuuaugaucaugacguauaccgcgacgaggcucuaaacaauagauuccagauaaaagguguggagcugaaaagcggcuacaaagauuggauccucuggauuucuuuugccaucucaugcuuccugcuuugugucgcacuguugggguuuauuaugugggccugccagaagggaaacaucagguguaauauaugcauuuga

SEQ ID NO: 133475 - RNA, 1701 nt, Artificial Sequence; identical to SEQ ID NO: 131884
  derived and/or modified sequence opt3 from hemagglutinin__InfluenzaA__AHL96414

SEQ ID NO: 133476 - RNA, 1701 nt, Artificial Sequence; identical to SEQ ID NO: 132010
  derived and/or modified sequence opt3 from hemagglutinin__InfluenzaA__AHL96426

SEQ ID NO: 133477 - RNA, 1701 nt, Artificial Sequence
  derived and/or modified sequence opt3 from hemagglutinin__InfluenzaA__AHL96438
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgaccaaaucgaagugacuaaugcgaccgagcugguacagucuucaaguacaggugaaauuugcaacagcccacaccagauccuagauggcgagaauuguacccucauagacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacucuggaguuuaacaaugaguccuucaacuggacagguguuacccagaaugggacgucuagcgcuugcauccggcgcuccaacaauucauuuuucagucgacugaacuggcucacucacuuaaauuuuaaauacccagcacugaacgugaccaugcccaacaaugaacaguucgacaaacuuuauauuuggggaguccaucacccuggcacagauaaggaccagaucuuuuuguacgcccaagcuagcggccguauuacugugucuaccaagagaucccagcaggccguaaucccaaacauagggucaaggccccggguucgcaauauuccuagcagagugaguaucuauuggacaauugucaagccaggagauauccugcuaaucaacucuaccgguaaucucauugcgccgaggggcuacuucaaaauacgguccggaaagagcucgaucaugcgcucugacgcacccauugggaaauguuccucagccugcaucacgccuaacggcaguauaccaaaugacaagcccuuucagaacgugaaucgaauuacuuacggugcuuguccuagauaugugaagcaaaacacacugaaacuugccaccgggaugaggaaugucccagagaagcagacucggggaaucuucggcgcaaucgcuggcuuuauugaaaacgggugggagggaaugguugaugguugguacggcuuccgucaccagaauagcgaggggcgcggacaagccgcggaccugaaauccacacaggccgcaaucgaucagauuaacggcaaguugaauagacucauagguaaaaccaacgaaaaguuccaucagaucgagaaagaauuuucugagguggaagggaggauucaagaccuggagaaguauguagaggauacgaagaucgacuuauggagcuacaacgcugaacugcucguggcccuugagaaucagcacaccaucgaucugacagacucagaaaugaacaaauuguucgagaagacuaaaaagcagcuacgggaaaaugcugaggauaugggcaacggaugcuuuaaaauuuaucauaagugugacaaugccugcauaggcaguauccgaaacgggaccuacgaucacgacgucuaucgcgacgaggcacugaauaacagauuccagauuaagggaguggaacucaaauccgguuacaaggauuggauccuguggauuagcuuugccaucucuugcuuccuucuguguguugcuuugcucggcuuuauaaugugggcgugccaaaaagggaauaucagguguaacauuugcaucuga

SEQ ID NO: 133478 - RNA, 1701 nt, Artificial Sequence; identical to SEQ ID NO: 131884
  derived and/or modified sequence opt3 from hemagglutinin__InfluenzaA__AHL96450

SEQ ID NO: 133479 - RNA, 1701 nt, Artificial Sequence; identical to SEQ ID NO: 132010
  derived and/or modified sequence opt3 from hemagglutinin__InfluenzaA__AHL96462

SEQ ID NO: 133480 - RNA, 1701 nt, Artificial Sequence
  derived and/or modified sequence opt3 from hemagglutinin__InfluenzaA__AHL96474
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggagugucuccccuccaucuggguaaaugcaacauagcuggcuggauccuugggaauccugagugugaaucacugaguacagccagcuccuggucuuacauuguugagaccucgggaucagacaacggcacuugcuauccaggugauuuuaucgacuacgaagaguugagggagcagcucagcaguguguccucuuucgaacgguuugagauuuucccgaagacaagcuccuggcccaaucacgauucaaacaagggggucaccgcagccuguccucaugcuggagcaaaaggcuuuuauaagaaucugaucuggcuggugaaaaagggcaacaguuacccaaaacucagcauaucuuauaucaaugacaaggggaaggaaguauuaguucugugggguauucaccaccccuccacgacugccgaucaacagucacuuuaccagaacgcugacaccuacguguucgucggaacaagccgcuauaguaaaaaguuuaaaccugagaucgccauucgaccaaaggugcgugaucaggagggcagaaugaauuacuauuggacuuugguggaacccggggacaaaaucaccuucgaggcgacaggaaaccuggucguuccuagguacgcauuugccauggaacggaacgcuggcucugguauaauuaucuccgauaccccagugcaugacugcaauacgacuugucaaacaccgaagggggccauuaacaccagccuacccuuccagaauauccacccuaucacuauuggaaaaugcccaaaguauguaaagucgacaaaacuccgccuggcaaccggccuuagaaacgugcccucuauacaguccaggggccuguuuggggcuaucgccggauucauugaggguggcuggacggggauggucgacggaugguacggcuaucaucaccagaaugaacaagguucaggguacgcggccgauuugaagaguacccagaacgcaaucgacaaaauaacaaauaaggugaacagcguuauugagaaaaugaauacucaguuuaccgcugugggcaaggaguucaaccaccucgaaaagcggaucgagaaucugaacaaaaaggucgaugacggauucuuagauaucuggacauacaaugccgaacugcucgugcuucuggagaacgaacgcacuuuggacuaucaugauuccaauguuaaaaaccuauacgagaagguacgaaaccagcugaaaaauaacgcuaaggagauuggcaauggguguuuugaguucuaucacaagugcgacaacaccuguauggaaucugugaaaaauggaacauacgauuauccuaaguacagcgaagaggccaaacucaacagagaagagaucgacggugucaagcuggagucaaccaggauuuaucaaauacuugcaaucuacaguacugccgcuuccagccugguguuggucgugucucucggcgcgauuucauuuuggaugugcaguaaugggagccugcagugccggaucuguaucuga

SEQ ID NO: 133481 - RNA, 1701 nt, Artificial Sequence
  derived and/or modified sequence opt3 from hemagglutinin__InfluenzaA__AHL96485
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaguuguacaucuggggaguccaccauccuggcaccgauaaagaccagauuuuucuuuaugcccagagcucuggcagaaucacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugaaguccgacgcgcccauuggaaaguguaaaucagaaugcaucaccccuaacggcaguaucccaaaugacaagcccuuucagaacgugaaucgaauuacguauggugcauguccuagauacgucaaacagagcacucugaaacuugccacagggaugaggaacgugccagagaagcaaacccggggaaucuucggcgcuauugccggcuuuauagaaaaugggugggagggaaugguggaugguugguauggcuuccgucaccagaacuccgaggggcgcggacaggcagcugaccugaagucuacucaagccgcgaucgaucagauuaauggcaaauugaacagacucaucgguaagacaaaugaaaaguuccaccagaucgagaaagaauuuagcgaggucgaagggaggauucaggaccuggagaaguacguugaggauaccaaaauagacuuauggucauauaacgccgaacugcucguggcacuugagaaccaacauacgaucgaucugaccgacagugaaaugaauaaguuguucgagaaaacaaagaagcagcuacgggaaaacgcugaggauaugggcaauggaugcuuuaaaauuuaccacaagugugacaacgccugcaucggcuccauucgaaaugggacuuaugaucauaacguauaccgcgacgaggcucugaauaacagauuccagaucaaaggaguggaacucaagagcgguuacaaagacuggauacuguggaucucuuuugccauuucaugcuuccuucugugugucgcauugcucggcuuuaucaugugggccugccagaaggggaauauuagguguaacaucugcauauga

SEQ ID NO: 133482 - RNA, 1701 nt, Artificial Sequence; identical to SEQ ID NO: 132010
  derived and/or modified sequence opt3 from hemagglutinin__InfluenzaA__AHL96497

SEQ ID NO: 133483 - RNA, 1701 nt, Artificial Sequence; identical to SEQ ID NO: 131884
  derived and/or modified sequence opt3 from hemagglutinin__InfluenzaA__AHL96509

SEQ ID NO: 133484 - RNA, 1701 nt, Artificial Sequence; identical to SEQ ID NO: 131851
  derived and/or modified sequence opt3 from hemagglutinin__InfluenzaA__AHL96521

SEQ ID NO: 133485 - RNA, 1701 nt, Artificial Sequence; identical to SEQ ID NO: 132010
  derived and/or modified sequence opt3 from hemagglutinin__InfluenzaA__AHL96533

SEQ ID NO: 133486 - RNA, 1701 nt, Artificial Sequence; identical to SEQ ID NO: 131874
  derived and/or modified sequence opt3 from hemagglutinin__InfluenzaA__AHL96545

SEQ ID NO: 133487 - RNA, 1701 nt, Artificial Sequence
  derived and/or modified sequence opt3 from hemagglutinin__InfluenzaA__AHL96569
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagagugacaguauccacuaagaggucacaacaggcuguuauuccaaacauagggagccggccccgcauuagaaauaucccuaguaggauuucuaucuacuggaccaucgugaaaccaggagauauucugcuaauaaacuccacagguaaucucaucgccccgcggggcuacuucaagauucgcagcgggaaaucgucuaucaugcgauccgacgcgcccauaggaaaguguaagucagaaugcauuaccccuaacggcaguaucccaaaugacaaacccuuucagaacgucaauagaaucacguauggugcauguccuagguacgugaagcagagcacucugaaacuugccacagggaugcggaacgugccagagaagcaaacccguggaauuuucggcgcuaucgccggcuuuauugaaaaugggugggagggaauggucgaugguugguauggcuuccgccaccagaacuccgaggggagaggacaggcagcugaccugaaaucuacucaagccgcgauagaucagaucaauggcaaguugaacaggcucauugguaaaacaaaugaaaaguuccaccagaucgagaaggaauuuagcgagguugaagggcggauccaggaccuggagaaauacguggaggauaccaagauugacuuauggucauauaacgccgaacugcucguagcacuugagaaccaacauacgauagaucugaccgacagugaaaugaauaaauuguucgagaagacaaagaagcagcuacgagaaaacgcugaggauaugggcaauggaugcuuuaagaucuaccacaaaugugacaacgccugcauuggcuccauccgcaaugggacuuaugaucaugacguguacagagacgaggcucugaacaauagguuccagauuaagggagucgaacucaaaagcgguuacaaggauuggauccuguggauaucuuuugccaucucaugcuuccuucuguguguggcauugcucggcuuuauuaugugggccugccagaaagggaacauccgguguaauauuugcaucuga

SEQ ID NO: 133488 - RNA, 1701 nt, Artificial Sequence; identical to SEQ ID NO: 133480
  derived and/or modified sequence opt3 from hemagglutinin__InfluenzaA__AHL96581

SEQ ID NO: 133489 - RNA, 1701 nt, Artificial Sequence
  derived and/or modified sequence opt3 from hemagglutinin__InfluenzaA__AHL96592
augaagaccaucauugcccugggcuacauacucugccuuguguucgcucagaaaauccccgggaacgacaauagcacagcaacucuguguuugggacaccaugccgucccuaacgguacgauuguuaagaccaucacaaaugauagaauugaggugacuaacgcgaccgaauuaguacaaaauuccucuaucggcgagauaugcgacucaccacaccagauccuggauggggaaaacuguacacuaauugacgcucuccugggagauccgcagugcgacggcuuucagaauaaaaagugggaucuuuucaucgagaggaguaaagccuauagcaacuguuaccccuaugacgugccugauuacgcaucccugcggucuuuggucgccucgucagguacccucgaauuuaauaacgagagcuucaauuggacuggggugacacaaaacggaaccaguuccgcuugcauucgccgaucuaauagcuccuuuuucucacgucugaacuggcugacgcaucucaauuuuaaguauccagcauuaaacguuacuaugcccaacaaugagcaguucgacaagcuguacaucuggggcgugcaccauccuggcaccgauaaagaccagauauuucuuuaugcccagaguagcgggagaauuacagucucuacuaagaggucccaacaggcugugaucccaaacauuggaucacggccccgcaucagaaauaucccuagcaggauuaguauauacuggaccaucguaaaaccaggugauauuuugcugaucaacucuacaggcaaucuaauagccccgcggggguacuucaagauucgcuccggaaaaagcucgaucaugcgaucugacgcgcccaucggcaaguguaaguccgaaugcauuaccccuaacgguucaaucccaaaugacaaacccuuucagaacguuaauagaauuacguauggggcauguccuagguacgugaagcagaguacucucaaacuggccacaggaaugcggaacgucccagagaagcaaacccguggcauauucggcgcuaucgccggguuuauugaaaauggaugggaggguaugguggauggcugguauggguuccgccaccagaacagcgagggaagaggccaggcagcugaccuuaaauccacucaagccgcgaucgaucagaucaaugguaagcugaacagguugauugggaaaacaaaugaaaaguuccaccagauagagaaggaauuuucugagguggaaggccggauccaggaccucgagaaauacgucgaggauaccaagauugaccuguggagcuauaacgccgaauuacugguugcacucgagaaccaacauacgaucgaucuuaccgacucagaaaugaauaaacuguucgagaagacuaaaaagcaguugcgagaaaacgcugaggauaugggaaauggcugcuuuaagauuuaccacaaaugugacaacgccugcaucgggaguauacgcaauggaacauaugaucaugacguguacagagacgaggcucuaaacaauagguuccagaucaaggguguagaacugaaauccggcuacaaggauuggauucucuggaucagcuuugccauuucuugcuuccugcuuuguguggcacuguugggguuuaucaugugggccugccagaaaggaaacauacgguguaauauuugcaucuga

SEQ ID NO: 133490 - RNA, 1701 nt, Artificial Sequence; identical to SEQ ID NO: 132010
  derived and/or modified sequence opt3 from hemagglutinin__InfluenzaA__AHL96604

SEQ ID NO: 133491 - RNA, 1701 nt, Artificial Sequence; identical to SEQ ID NO: 132010
  derived and/or modified sequence opt3 from hemagglutinin__InfluenzaA__AHL96616

SEQ ID NO: 133492 - RNA, 1701 nt, Artificial Sequence
  derived and/or modified sequence opt3 from hemagglutinin__InfluenzaA__AHL96628
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaauggguggggagguaugguggauggcugguauggguuccgccaccagaacuccgagggaagaggccaggcagcugaccugaaaucuacucaagccgcgaucgaucagauuaaugguaaguugaacaggcucaucgggaaaacaaaugagaaguuccaccagaucgaaaaggaguuuagcgaagucgagggccggauucaggaccuggaaaaauacguugaggauaccaagauagacuuauggucauauaacgccgagcugcucguggcacuugaaaaccaacauacgaucgaucugaccgacagugagaugaauaaauuguucgaaaagacaaagaagcagcuacgagagaacgcugaagauaugggaaauggcugcuuuaagauuuaccacaaaugugacaacgccugcaucggguccauucgcaauggaacuuaugaucauaacguauacagagacgaggcucugaauaacagguuccagaucaaggguguggagcucaaaagcggcuacaaggacuggauacuguggaucucuuuugccauuucaugcuuccuucugugugucgcauugcucggguuuaucaugugggccugccagaaaggaaauauucgguguaacaucugcauauga

SEQ ID NO: 133493 - RNA, 1701 nt, Artificial Sequence; identical to SEQ ID NO: 133481
  derived and/or modified sequence opt3 from hemagglutinin__InfluenzaA__AHL96640

SEQ ID NO: 133494 - RNA, 1701 nt, Artificial Sequence
  derived and/or modified sequence opt3 from hemagglutinin__InfluenzaA__AHL96652
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaagacucuucaauuggugagaucugcgauaguccacaccagauacuagacggcgaaaauuguacacucaucgaugcucugcuuggggacccgcagugcgauggauuucagaacaaaaagugggaccuguucguggagaggagcaaagccuauuccaauuguuaccccuaugaugucccugacuacgcaucuuugcggucgcucguggccucaagcggcacccuggaauuuaacaaugagaguuucaacugggcugguguuacucaaaaugggacauccucugcaugcauucgcggaagcaacuccucauuuuucagucgacugaauuggcucacccauuuaaacuuuaaguauccagcccugaaugugacgaugcccaacaacgagcaguucgauaaguuguacaucuggggcguccaccauccuggcacugacaaagaucagauuuuucuuuaugcucagagcucugggcguaucaccguguccacaaagagaucacaacaggccguaauaccaaauauuggaagcaggccccggauccgcaacauuccuaguagaaucucuaucuacuggacuauuguuaaaccaggugacauacugcuaaucaauuccaccggcaaccucauugcgccgaggggguacuucaagauccggagcggaaaaucgucuauaaugcgcuccgacgcacccauuggcaaguguaagucagaaugcaucacaccuaaugguaguaucccaaacgauaaacccuuucagaaugugaaccgaauuaccuauggggccuguccuagauacgucaagcagagcacgcugaaacuugcuacuggaaugaggaaugugccagagaagcaaacacggggcaucuucggcgccauugcaggguuuauagaaaacggaugggaggguaugguggacggcugguauggguuccgucaccaaaauuccgagggacgcggccaggcugccgaucugaaaucuacccaggcggccaucgaccagauuaacgguaaguugaauagacucaucgggaaaacuaacgaaaaguuccaccagaucgagaaggaauuuagcgaggucgaaggcaggauucaggaucuggagaaauacguugaggacacaaagauagauuuauggucauauaaugcagaacugcucguggcucuugagaaccaacauaccaucgaccugacggauagugaaaugaacaaauuguucgagaagaccaaaaagcagcuacgggaaaaugccgaggacaugggaaacggcugcuuuaagauuuaccacaaaugugauaaugcuugcaucggguccauucgaaacggaacauaugaccaugacguauaccgcgaugaggcccugaauaacagauuccagaucaaggguguggaacucaaaagcggcuacaaggacuggauacuguggaucucuuuugcaauuucaugcuuccuucugugugucgccuugcucggguuuaucaugugggcuugccagaaaggaaauauuagguguaacaucugcauauga

SEQ ID NO: 133495 - RNA, 1701 nt, Artificial Sequence; identical to SEQ ID NO: 132483
  derived and/or modified sequence opt3 from hemagglutinin__InfluenzaA__AHL96664

SEQ ID NO: 133496 - RNA, 1701 nt, Artificial Sequence
  derived and/or modified sequence opt3 from hemagglutinin__InfluenzaA__AHL96676
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaauugacaaacccuuucagaaugugaacagaaucacguauggugcauguccuagguacgucaagcagagcacucugaaacuugccacagggaugcggaaugugccagagaagcaaacccguggaauuuucggcgcuauagccggcuuuaucgaaaacgggugggagggaaugguggaugguugguauggcuuccgccaccaaaauuccgaggggagaggacaggcagcugaccugaaaucuacucaggccgcgauugaucagaucaacggcaaguugaauaggcucaucgguaaaacaaacgaaaaguuccaccagauugagaaggaauuuagcgaggucgaagggcggauacaggaccuggagaaauacguugaggauaccaagaucgacuuauggucauauaaugccgaacugcucguggcacuugagaaccaacauacgauugaucugaccgacagugaaaugaacaaauuguucgagaagacaaagaagcagcuacgagaaaaugcugaggauaugggcaacggaugcuuuaagaucuaccacaaaugugacaaugccugcauuggcuccauccgcaacgggacuuaugaucaugacguauacagagacgaggcucugaauaacagguuccagauaaagggaguggaacucaaaagcgguuacaaggauuggauccuguggauuucuuuugccaucucaugcuuccuucugugugucgcauugcucggcuuuauuaugugggccugccagaaagggaauauccgguguaacauaugcauuuga

SEQ ID NO: 133497 - RNA, 1701 nt, Artificial Sequence; identical to SEQ ID NO: 132010
  derived and/or modified sequence opt3 from hemagglutinin__InfluenzaA__AHL96688

SEQ ID NO: 133498 - RNA, 1701 nt, Artificial Sequence; identical to SEQ ID NO: 132010
  derived and/or modified sequence opt3 from hemagglutinin__InfluenzaA__AHL96700

SEQ ID NO: 133499 - RNA, 1701 nt, Artificial Sequence; identical to SEQ ID NO: 132010
  derived and/or modified sequence opt3 from hemagglutinin__InfluenzaA__AHL96712

SEQ ID NO: 133500 - RNA, 1701 nt, Artificial Sequence; identical to SEQ ID NO: 131884
  derived and/or modified sequence opt3 from hemagglutinin__InfluenzaA__AHL96724

SEQ ID NO: 133501 - RNA, 1701 nt, Artificial Sequence; identical to SEQ ID NO: 131874
  derived and/or modified sequence opt3 from hemagglutinin__InfluenzaA__AHL96748

SEQ ID NO: 133502 - RNA, 1701 nt, Artificial Sequence; identical to SEQ ID NO: 131884
  derived and/or modified sequence opt3 from hemagglutinin__InfluenzaA__AHL96784

SEQ ID NO: 133503 - RNA, 1701 nt, Artificial Sequence
  derived and/or modified sequence opt3 from hemagglutinin__InfluenzaA__AHL96796
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucauugagaggagcaaagccuauuccaacuguuaccccuaugacgugccugauuacgcaucuuugcggucgcucgucgccucaagcggcacccuggaauuuaauaacgagaguuucaauuggacuggugugacacaaaacgggaccuccucugcuugcauccgccgaagcaauuccucauuuuucagucgucugaacuggcucacgcauuuaaauuuuaaguauccagcacugaacguuacuaugcccaacaaugagcaguucgacaaacuuuacauuuggggagugcaccauccuggcaccgauaaagaccagaucuuuuuguaugcccagagcucuggcagaauaacagucuccacuaagaggucacaacaggcugugauuccaaacaucgggagccggccccgcauuagaaauaucccuaguaggaucucuauuuacuggaccauaguaaaaccaggagauauccugcuaauuaacuccacagguaaucucaucgccccgcggggcuacuucaagauacgcagcgggaaaucgucuauuaugcgauccgacgcgcccaucggaaaguguaagucagaaugcaucaccccuaacggcaguauuccaaaugacaaacccuuucagaacguuaauagaaucacguauggugcauguccuagguacgugaagcagagcacucugaaacuugccacagggaugcggaacgucccagagaagcaaacccguggaauuuucggcgcuauagccggcuuuaucgaaaaugggugggagggaaugguggaugguugguauggcuuccgccaccagaacuccgaggggagaggacaggcagcugaccugaaaucuacucaagccgcgauugaucagaucaauggcaaguugaacaggcucaucgguaaaacaaaugaaaaguuccaccagauugagaaggaauuuagcgagguggaagggcggauacaggaccuggagaaauacgucgaggauaccaagaucgacuuauggucauauaacgccgaacugcucguugcacuugagaaccaacauacgauugaucugaccgacagugaaaugaauaaauuguucgagaagacaaagaagcagcuacgagaaaacgcugaggauaugggcaauggaugcuuuaagaucuaccacaaaugugacaacgccugcauuggcuccauccgcaaugggacuuaugaucaugacguguacagagacgaggcucugaacaauagguuccagauaaagggaguagaacucaaaagcgguuacaaggauuggauccuguggauuucuuuugccaucucaugcuuccuucuguguguggcauugcucggcuuuauuaugugggccugccagaaagggaacauccgguguaauauaugcauuuga

SEQ ID NO: 133504 - RNA, 1701 nt, Artificial Sequence; identical to SEQ ID NO: 131874
  derived and/or modified sequence opt3 from hemagglutinin__InfluenzaA__AHL96808

SEQ ID NO: 133505 - RNA, 1701 nt, Artificial Sequence; identical to SEQ ID NO: 131874
  derived and/or modified sequence opt3 from hemagglutinin__InfluenzaA__AHL96820

SEQ ID NO: 133506 - RNA, 1701 nt, Artificial Sequence; identical to SEQ ID NO: 131884
  derived and/or modified sequence opt3 from hemagglutinin__InfluenzaA__AHL96832

SEQ ID NO: 133507 - RNA, 1701 nt, Artificial Sequence; identical to SEQ ID NO: 131884
  derived and/or modified sequence opt3 from hemagglutinin__InfluenzaA__AHL96844

SEQ ID NO: 133508 - RNA, 1701 nt, Artificial Sequence; identical to SEQ ID NO: 131884
  derived and/or modified sequence opt3 from hemagglutinin__InfluenzaA__AHL96856

SEQ ID NO: 133509 - RNA, 1701 nt, Artificial Sequence
  derived and/or modified sequence opt3 from hemagglutinin__InfluenzaA__AHL96868
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgggaacuguacacucaucgacgcucugcuuggagauccgcagugcgacggcuuucagaauaaaaagugggaucuguucguggaaaggagcaaagccuauuccaacuguuaccccuaugacgucccugauuacgcaucuuugcggucgcucguggccucaagcgguacccuggaguuuaauaacgaaaguuucaauuggacugggguuacacaaaacggaaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggcguccaccauccuggcaccgauaaagaccagaucuuuuuguaugcccagagcucugggagaauuacaguguccacuaagaggucacaacaggcuguaguuccaaacauaggaagccggccccgcauuagaaauaucccuaguaggauuucuaucuacuggaccaucgugaaaccaggugauauucugcuaauaaacuccacaggcaaucucaucgccccgcggggguacuucaagauucgcagcggaaaaucgucuaucaugcgauccgacgcgcccauaggcaaguguaagucagagugcauuaccccuaacgguaguaucccaaaugacaaacccuuucagaacgucaauagaaucacguauggggcauguccuagguacgugaagcagagcacucugaaacuugccacaggaaugcggaacgugccagaaaagcaaacccguggcauuuucggcgcuaucgccggguuuauugagaauggaugggaagguaugauggauggcugguauggguuccgccaccagaacuccgagggaagaggccaggcagcugaccugaaaucuacucaagccgcgauagaucagaucaaugguaaguugaacaggcucauugggaaaacaaaugagaaguuccaccagaucgaaaaggaguuuagcgaagucgagggccggauccaggaccuggaaaaauacguugaggauaccaagauugacuuauggucauauaacgccgagcugcucguggcacuugaaaaccaacauacgauagaucugaccgacagugagaugaauaaauuguucgaaaagacaaagaagcagcuacgagagaacgcugaagauaugggaaauggcugcuuuaagaucuaccacaaaugugacaacgccugcauuggguccauccgcaauggaacuuaugaucaugacguauacagagacgaggcucugaacaauagguuccagauuaaggguguggagcucaaaagcggcuacaaggauuggauccuguggauaucuuuugccaugucaugcuuccuucugugugucgcauugcucggguuuaucaugugggccugccagaaaggaaacauucgguguaauaucugcauuuga

SEQ ID NO: 133510 - RNA, 1701 nt, Artificial Sequence; identical to SEQ ID NO: 131874
  derived and/or modified sequence opt3 from hemagglutinin__InfluenzaA__AHL96880

SEQ ID NO: 133511 - RNA, 1701 nt, Artificial Sequence
  derived and/or modified sequence opt3 from hemagglutinin__InfluenzaA__AHL96892
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggguucaggaccuggagaaauacguggaggauacaaagauugacuuauggucauauaacgcagaacugcucguagcucuugagaaccaacauaccauagaucugacggacagugaaaugaauaaauuguucgagaagaccaaaaagcagcuacgggaaaacgccgaggauaugggaaauggcugcuuuaagaucuaccacaaaugugacaacgcuugcauuggguccauccgaaauggaacauaugaucaugacguguaccgcgacgaggcccugaacaauagauuccagauuaagggugucgaacucaaaagcggcuacaaggauuggauccuguggauaucuuuugcaaucucaugcuuccuucuguguguggccuugcucggguuuauuaugugggcuugccagaaaggaaacaucagguguaauauuugcaucuga

SEQ ID NO: 133512 - RNA, 1701 nt, Artificial Sequence
  derived and/or modified sequence opt3 from hemagglutinin__InfluenzaA__AHL96904
augaagaccaucauugcccugagcuacauacucugccuuguguucgcucagaaacugcccggcaacgacaauuccacagcaacuuuguguuuagggcaccaugccgucccuaacggaaugaucguuaagacgauuaccaaugauagaaucgaggugacaaacgcgacugaacugguacaaaauucuucaauuggugagaucugcgacaguccacaccagauacuagauggcgaaaacuguacccucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacacuggaauuuaauaacgagaguuucaauuggaccgguguuacucaaaacgggacauccucugcuugcauucgccgaagcaauuccucauuuuucagucgucugaacuggcucacccauuuaaauuuuaaguauccagcacugaacgugacgaugcccaacaaugagcaguucgacaaguuguacaucuggggaguccaccauccuggcacugauaaagaccagauuuuucuuuaugcccagagcucuggcagaaucaccguguccacaaagaggucacaacaggcuguaguuccaaacauagggagccggccccgcauuagaaauaucccuaguaggauuucuaucuacuggacuaucgugaaaccaggagauauucugcuaauaaacuccaccgguaaucucaucgccccgcggggcuacuucaagauucgcagcgggaaaucgucuaucaugcgauccgacgcgcccauaggaaaguguaagucagaaugcauuacaccuaacggcaguaucccaaaugacaaacccuuucagaacgucaauagaaucaccuauggugcauguccuagguacgugaagcagagcacgcugaaacuugccacugggaugcggaacgugccagagaagcaaacacguggaauuuucggcgcuaucgccggcuuuauugaaaaugggugggagggaauggucgaugguugguauggcuuccgccaccagaacuccgaggggagaggacaggcagcugaccugaaaucuacccaagccgcgauagaucagaucaauggcaaguugaacaggcucauugguaaaacuaaugaaaaguuccaccagaucgagaaggaauuuagcgagguugaagggcggauccaggaccuggagaaauacguggaggauacaaagauugacuuauggucauauaacgccgaacugcucguagcacuugagaaccaacauaccauagaucugacggacagugaaaugaauaaauuguucgagaagaccaaaaagcagcuacgagaaaacgcugaggauaugggcaauggaugcuuuaagaucuaccacaaaugugacaacgccugcauuggcuccauccgcaaugggacauaugaucaugacguguacagagacgaggcucugaacaauagguuccagauuaagggagucgaacucaaaagcgguuacaaggauuggauccuguggauaucuuuugccaugucaugcuuccuucuguguguggcauugcucggcaguaucaugugggccugccagaaagggaacauucgguguaauaucugcauuuga

SEQ ID NO: 133513 - RNA, 1701 nt, Artificial Sequence; identical to SEQ ID NO: 131874
  derived and/or modified sequence opt3 from hemagglutinin__InfluenzaA__AHL96916

SEQ ID NO: 133514 - RNA, 1701 nt, Artificial Sequence; identical to SEQ ID NO: 131874
  derived and/or modified sequence opt3 from hemagglutinin__InfluenzaA__AHL96928

SEQ ID NO: 133515 - RNA, 1701 nt, Artificial Sequence; identical to SEQ ID NO: 131874
  derived and/or modified sequence opt3 from hemagglutinin__InfluenzaA__AHL96940

SEQ ID NO: 133516 - RNA, 1701 nt, Artificial Sequence; identical to SEQ ID NO: 131884
  derived and/or modified sequence opt3 from hemagglutinin__InfluenzaA__AHL96952

SEQ ID NO: 133517 - RNA, 1701 nt, Artificial Sequence; identical to SEQ ID NO: 131884
  derived and/or modified sequence opt3 from hemagglutinin__InfluenzaA__AHL96964

SEQ ID NO: 133518 - RNA, 1701 nt, Artificial Sequence; identical to SEQ ID NO: 132042
  derived and/or modified sequence opt3 from hemagglutinin__InfluenzaA__AHL96976

SEQ ID NO: 133519 - RNA, 1701 nt, Artificial Sequence
  derived and/or modified sequence opt3 from hemagglutinin__InfluenzaA__AHL96988
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaguuguacaucuggggaguccaccauccuggcaccgauaaagaccagauuuuucuuuaugcccagagcucuggcagaaucacaguguccacuaagaggucacaacaggcuguaauaccaaacauugggagccggccccgcaucagaaauauuccuaguaggaucucuaucuacuggaccauuguucggccaggagauauacugcuaaucaacuccacagguaaucucauugccccgcgcggcuacuucaaaauccgaagcgggaagucgucuauaaugagauccgacgcgcccauuggaaaauguaagucagaaugcaucaccccuaacggcaguaucccaaaugacaagcccuuucagaacgugaauaggauuacguauggugcauguccucgguacgucaaacagagcacucugaaacuugccacagggaugcguaacgugccagagaagcaaacccgcggaaucuucggcgcuauugccggcuuuauagaaaaugggugggagggaaugguggaugguugguauggcuucagacaccagaacuccgaggggaggggacaggcagcugaccugaagucuacucaagccgcgaucgaucagauuaauggcaaauugaaccggcucaucgguaagacaaaugaaaaauuccaccagaucgagaaggaauuuagcgaggucgaagggcgcauucaggaccuggagaaguacguugaggauaccaaaauagacuuauggucauauaacgccgaacugcucguggcacuugagaaccaacauacgaucgaucugaccgacagugaaaugaauaaguuguucgagaaaacaaagaaacagcuacgagaaaacgcugaggauaugggcaauggaugcuuuaagauuuaccacaagugugacaacgccugcaucggcuccauuagaaaugggacuuaugaucauaacguauacagggacgaggcucugaauaaccgguuccagaucaaaggaguggaacucaagagcgguuacaaagacuggauacuguggaucucuuuugccauuucaugcuuccuucugugugucgcauugcucggcuuuaucaugugggccugccagaaggggaauauucgcuguaacaucugcauauga

SEQ ID NO: 133520 - RNA, 1701 nt, Artificial Sequence; identical to SEQ ID NO: 131884
  derived and/or modified sequence opt3 from hemagglutinin__InfluenzaA__AHL97000

SEQ ID NO: 133521 - RNA, 1701 nt, Artificial Sequence; identical to SEQ ID NO: 132010
  derived and/or modified sequence opt3 from hemagglutinin__InfluenzaA__AHL97012

SEQ ID NO: 133522 - RNA, 1701 nt, Artificial Sequence
  derived and/or modified sequence opt3 from hemagglutinin__InfluenzaA__AHL97024
augaagaccaucauugcccugagcuacauacucugccuuguguucgcucagaaacugcccggcaacgacaauuccacagcaacuuuguguuuagggcaccaugccgucccuaacggaacgaucguuaagaccauuaugaaugauagaaucgaggugacaaacgcgacugaacugguacaaaauucuucaauuggugagaucugcgacaguccacaccagauacuagauggcgaaaacuguacccucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacacuggaauuuaauaacgagaguuucaauugggcugguguuacccaaaacgggacuuccucugcaugcauucgcggaagcaauuccucauuuuucagucgacugaacuggcucacacauuuaaauuuuaaguauccagcccugaacgugaccaugcccaacaaugagcaguucgacaaguuguacaucuggggcguccaccauccuggcacggauaaagaccagauuuuucuuuaugcucagagcucugggcguaucacuguguccaccaagagaucacaacaggccguaauaccaaacauuggaagcaggccccggauccgcaauauuccuaguagaaucucuaucuacuggacaauuguuaaaccaggugauauacugcuaaucaacuccacuggcaaucucauugcgccgaggggguacuucaagauccggagcggaaaaucgucuauaaugcgcuccgacgcacccauuggcaaguguaagucagaaugcaucaccccuaacgguaguaucccaaaugacaaacccuuucagaacgugaaucgaauuacauauggggccuguccuagauacgucaagcagagcacccugaaacuugcuacgggaaugaggaacgugccagagaagcaaacucggggcaucuucggcgccauugcaggguuuauagaaaauggaugggaggguaugauggauggcugguauggguuccgucaccagaacuccgagggacgcggccaggcugccgaccugaaaucuacacaagcggccaucgaucagauuaaugguaaguugaacagacucaucgggaaaaccaaugaaaaguuccaccagaucgagaaggaauuuagcgagguggaaggcaggauucaggaccuggagaaauacgucgaggauacuaagauagacuuauggucauauaacgcagaacugcucguugcucuugagaaccaacauacaaucgaucugaccgacagugaaaugaauaaauuguucgagaagacgaaaaagcagcuacgggaaaacgccgaggauaugggaaauggcugcuuuaagauuuaccacaaaugugacaacgcuugcaucggguccauucgaaauggaaccuaugaucaugacguguaccgcgacgaggcccugaacaauagauuccagaucaaggguguagaacucaaaagcggcuacaaggauuggauacuguggaucucuuuugcaauuucaugcuuccuucuguguguggccuugcucggguuuaucaugugggcuugccagaaaggaaacauuagguguaauaucugcauauga

SEQ ID NO: 133523 - RNA, 1701 nt, Artificial Sequence
  derived and/or modified sequence opt3 from hemagglutinin__InfluenzaA__AHL97036
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgaggucgaagggcggauucaggaccuggagaaauacguugaggauaccaagauagacuuauggucauauaacgccgaacugcucguggcacuugagaaccaacauacgaucgaucugaccgacagugaaaugaauaaauuguucgagaagacaaagaagcagcuacgagaaaacgcugaggauaugggcaauggaugcuuuaagauuuaccacaaaugugacaacacuugcaucggcuccauucgcaaugggaccuaugaucaugacguauacagagacgaggcccugaacaauagguuccagaucaagggaguggaacucaaaagcgguuacaaggauuggauacuguggaucucuuuugcuauuucaugcuuccuucugugugucgccuugcucggcuuuaucaugugggcaugccagaaagggaacauucgguguaauaucugcauauga

SEQ ID NO: 133524 - RNA, 1701 nt, Artificial Sequence; identical to SEQ ID NO: 131899
  derived and/or modified sequence opt3 from hemagglutinin__InfluenzaA__AHL97048

SEQ ID NO: 133525 - RNA, 1701 nt, Artificial Sequence
  derived and/or modified sequence opt3 from hemagglutinin__InfluenzaA__AHL97060
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcaauuccucauuuuucagucgucugaacuggcugacgcaucucaauuuuaaguauccagcauuaaacgugacuaugcccaacaaugagcaguucgacaagcuguacauuuggggaguccaccauccuggcaccgauaaagaccagaucuuucuuuaugcccagagcucuggcagaauaacaguguccacuaagaggucacaacaggcuguaauuccaaacaucgggagccggccccgcauuagaaauaucccuaguaggaucucuauuuacuggaccauaguuaaaccaggagauaucuugcugauuaacuccacagguaaucuaaucgccccgcggggcuacuucaagauacgcagcgggaaaucgucuauuaugcgauccgacgcgcccaucggaaaguguaagucagaaugcaucaccccuaacggcaguauuccaaaugacaaacccuuucagaacgugaauagaaucacguauggugcauguccuagguacgucaagcagagcacucucaaacuggccacagggaugcggaacgugccagagaagcaaacccguggaauuuucggcgcuauagccggcuuuaucgaaaaugggugggagggaaugguggaugguugguauggcuuccgccaccagaacuccgaggggagaggacaggcagcugaccuuaaaucuacucaagccgcgauugaucagaucaauggcaagcugaacagguugaucgguaaaacaaaugaaaaguuccaccagauugagaaggaauuuagcgaggucgaagggcggauacaggaccucgagaaauacguugaggauaccaagaucgaccuguggucauauaacgccgaauuacugguggcacucgagaaccaacauacgauugaucuuaccgacagugaaaugaauaaacuguucgagaagacuaaaaagcaguugcgagaaaacgcugaggauaugggcaauggaugcuuuaagaucuaccacaaaugugacaacgccugcauuggcuccauccgcaaugggacauaugagcaugauguauacagagacgaagcucuaaacaauagguuccagauaaagggaguggagcugaaaagcgguuacaaggacuggauccucuggauuucuuuugccaucucaugcuuccugcuuugugucgcacuguugggcuuuauuaugugggccugccagaaagggaacauccgguguaauauaugcauuuga

SEQ ID NO: 133526 - RNA, 1701 nt, Artificial Sequence; identical to SEQ ID NO: 132010
  derived and/or modified sequence opt3 from hemagglutinin__InfluenzaA__AHL97072

SEQ ID NO: 133527 - RNA, 1701 nt, Artificial Sequence; identical to SEQ ID NO: 132010
  derived and/or modified sequence opt3 from hemagglutinin__InfluenzaA__AHL97084

SEQ ID NO: 133528 - RNA, 1701 nt, Artificial Sequence; identical to SEQ ID NO: 131851
  derived and/or modified sequence opt3 from hemagglutinin__InfluenzaA__AHL97096

SEQ ID NO: 133529 - RNA, 1701 nt, Artificial Sequence; identical to SEQ ID NO: 132013
  derived and/or modified sequence opt3 from hemagglutinin__InfluenzaA__AHL97108

SEQ ID NO: 133530 - RNA, 1701 nt, Artificial Sequence
  derived and/or modified sequence opt3 from hemagglutinin__InfluenzaA__AHL97120
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgagucaccuauggggccuguccuagauacgugaagcagagcacgcugaaacuugcuacuggaaugaggaacgugccagagaagcaaacacggggcauuuucggcgccaucgcaggguuuauugaaaauggaugggaggguauggucgauggcugguauggguuccgucaccagaacuccgagggacgcggccaggcugccgaccugaaaucuacccaagcggccauagaucagaucaaugguaaguugaacagacucauugggaaaacuaaugaaaaguuccaccagaucgagaaggaauuuagcgagguugaaggcaggauccaggaccuggagaaauacguggaggauacaaagauugacuuauggucauauaacgcagaacugcucguagcucuugagaaccaacauaccauagaucugacggacagugaaaugaauaaauuguucgagaagaccaaaaagcagcuacgggaaaacgccgaggauaugggaaauggcugcuuuaagaucuaccacaaaugugacaacgcuugcauuggguccaucauuaauggaacauaugaucaugacguguaccgagacgaggcccugaacaaucgcuuccagaucaagggugucgaacucaaaagcggcuacaaggauuggauacuguggaucucuuuugcaauuucaugcuuccuucuguguguggccuugcucggguuuaucaugugggcuugccagaaaggaaacauuagauguaauaucugcauauga

SEQ ID NO: 133531 - RNA, 1701 nt, Artificial Sequence
  derived and/or modified sequence opt3 from hemagglutinin__InfluenzaA__AHL97132
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacccuggaauuuaauaacgagaguuucaauugggcugguguuacucagaacgggacauccucugcaugcauucggggaagcaauuccucauuuuucagucgccugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucaaagcucugggcgaaucaccguguccacaaagcguucacagcaggccguaauaccaaacauuggaagcagacccaggauccggaauauuccuagucgcaucucuaucuacuggacuauuguuaaaccaggugauauacugcuaaucaacuccaccggcaaucucauugcgccgagaggguacuucaagaucaggagcggaaaaucgucuauaaugcgguccgacgcacccauuggcaaguguaagucagaaugcaucacaccuaacgguaguaucccaaaugacaaacccuuucagaacgugaaucgcauuaccuauggggccuguccucgauacgucaagcaaagcacgcugaaacuugcuacuggaaugagaaacgugccaggcaagcagacaaggggcaucuucggggccauugcaggauuuauagagaaugguugggaaggcaugguggaugggugguauggauuccggcaccagaacuccgagggccguggucaagcugccgaccugaaaucuacccaggcggccaucgaucagauuaaugggaaguugaaccgccucaucggcaaaacuaaugagaaguuccaccagaucgaaaaggaguuuagcgaagucgagggaaggauucaagaccuggaaaaauacguugaggauacaaagauagacuuauggucauauaacgcagagcugcucguggcucuugaaaaccagcauaccaucgaucugacggacagugagaugaauaaauuguucgaaaagaccaaaaagcagcuaagagagaacgccgaagauaugggcaaugggugcuuuaagauuuaccacaaaugugacaacgcuugcaucggauccauucggaaugguacauaugaucaugacguauaccgagacgaggcccugaacaaucgcuuccagaucaagggcguggagcucaaaagcggguacaaggauuggauacuguggaucucuuuugcaauuucaugcuuccuucugugugucgccuugcucggauuuaucaugugggcuugccaaaaaggcaacauuagauguaauaucugcauauga

SEQ ID NO: 133532 - RNA, 1701 nt, Artificial Sequence; identical to SEQ ID NO: 132010
  derived and/or modified sequence opt3 from hemagglutinin__InfluenzaA__AHL97144

SEQ ID NO: 133533 - RNA, 1701 nt, Artificial Sequence; identical to SEQ ID NO: 132010
  derived and/or modified sequence opt3 from hemagglutinin__InfluenzaA__AHL97156

SEQ ID NO: 133534 - RNA, 1701 nt, Artificial Sequence; identical to SEQ ID NO: 132010
  derived and/or modified sequence opt3 from hemagglutinin__InfluenzaA__AHL97168

SEQ ID NO: 133535 - RNA, 1701 nt, Artificial Sequence; identical to SEQ ID NO: 131884
  derived and/or modified sequence opt3 from hemagglutinin__InfluenzaA__AHL97180

SEQ ID NO: 133536 - RNA, 1701 nt, Artificial Sequence; identical to SEQ ID NO: 132010
  derived and/or modified sequence opt3 from hemagglutinin__InfluenzaA__AHL97192

SEQ ID NO: 133537 - RNA, 1701 nt, Artificial Sequence; identical to SEQ ID NO: 132010
  derived and/or modified sequence opt3 from hemagglutinin__InfluenzaA__AHL97204

SEQ ID NO: 133538 - RNA, 1701 nt, Artificial Sequence; identical to SEQ ID NO: 132010
  derived and/or modified sequence opt3 from hemagglutinin__InfluenzaA__AHL97216

SEQ ID NO: 133539 - RNA, 1701 nt, Artificial Sequence
  derived and/or modified sequence opt3 from hemagglutinin__InfluenzaA__AHL97228
augaagaccaucauugcccugagcuacauacucugccuuguguucgcucagaaacugcccggcaacgacaauuccacagcaacuuuguguuuagggcaccaugccgucccuaacggaacgguugugaagaccaucacaaaugauagaauugagguaacuaacgcgaccgaacuggugcaaaauucuucaaucggugagauuugcgacaguccacaccagauccuagauggcgaaaacuguacacucauagacgcucugcuuggggauccgcagugcgacggauuucagaauaaaaagugggaucuguucgucgagaggagcaaagccuauuccaacuguuaccccuaugacgugccugauuacgcaucuuugcggucgcucguugccucaagcggcacccuggaauuuaauaacgagaguuucaauuggacuggugugacacaaaacgggaccuccucugcuugcauccgccgaagcaauaacuccuuuuucucacgucugaauuggcucacgcauuuaaacuuuaaguauccagcacugaacgucacuaugcccaauaacgagcaguucgacaaacuuuacauuuggggagugcaccauccuggcaccgauaaagaccagaucuuuuuguaugcccagaguagcggcagaauuacaguaucuacuaagaggucccaacaggcuguuaucccaaauauagggucacggccccgcauuagaaacaucccuagcaggauuaguaucuacuggaccaucgugaaaccaggagauauucugcuaauaaauucuacagguaaccucaucgccccgcggggcuacuucaagauucgcuccgggaaaagcucgaucaugcgaucugacgcgcccauaggaaaguguaaguccgaaugcauuaccccuaauggcucaaucccaaacgacaaacccuuucagaaugucaacagaaucacguauggugcauguccuagguacgugaagcagaguacucugaaacuugccacagggaugcggaaugugccagagaagcaaacccguggaauuuucggcgcuaucgccggcuuuauugaaaacgggugggagggaauggucgaugguugguauggcuuccgccaccagaauagcgaggggagaggacaggcagcugaccugaaauccacucaagccgcgauagaucagaucaacggcaaguugaauaggcucauugguaaaacaaacgaaaaguuccaccagaucgagaaggaauuuucugagguugaagggcggauccaggaccuggagaaauacguggaggauaccaagauugacuuauggagcuauaacgccgaacugcucguagcacuugagaaucaacauacgauagaucugaccgacucagaaaugaacaaauuguucgagaagacaaagaagcagcuacgagaaaaugcugaggauaugggcaacggaugcuuuaagaucuaccacaaaugugacaaugccugcauuggcaguauccgcaacgggacuuaugaucaugacguguacagagacgaggcucugaauaacagguuccagauuaagggagucgaacucaaauccgguuacaaggauuggauccuguggaucagcuuugccauaucuugcuuccuucugugugugguuuugcucggcuuuauuaugugggcaugccagaaagggaauauccgguguaacauuugcaucuga

SEQ ID NO: 133540 - RNA, 1701 nt, Artificial Sequence; identical to SEQ ID NO: 132010
  derived and/or modified sequence opt3 from hemagglutinin__InfluenzaA__AHL97240

SEQ ID NO: 133541 - RNA, 1701 nt, Artificial Sequence
  derived and/or modified sequence opt3 from hemagglutinin__InfluenzaA__AHL97252
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgaccaaaucgaagugacuaaugcgaccgagcugguacagucuucaaguacaggugaaauuugcaacagcccacaccagauccuagauggcgagaauuguacccucauagacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacucuggaguuuaacaaugagaacuucaauuggacagguguuacccagaacgggacguccucugcuugcauccggcgcagcaauaacuccuuuuucucacgacugaauuggcucacucacuuaaacuuuaaauacccagcacugaacgugaccaugcccaauaacgaacaguucgacaaacuuuauauuuggggaguccaucacccuggcacagauaaggaccagaucuuuuuguacgcccaagcuaguggccguauuacugugagcaccaagagaucucagcaggccguaaucccaaauauaggguccaggccccggguucgcaacauuccuucaagagugagcaucuauuggacaauugucaagccaggagauauccugcuaaucaauaguaccgguaaccucauugcgccgaggggcuacuucaaaauacggucugggaaguccagcaucaugcgcucggacgcacccauuggaaaauguaauucugccugcaucacgccuaacggcuccauaccaaaugacaagcccuuucagaacgugaaucgaauuacuuacggugcuuguccuagauaugugaagcaaaacacacugaaacuugccaccgggaugaggaaugucccagagaagcagacucggggaaucuucggcgcaaucgcuggcuuuauugaaaacgggugggagggaaugguugaugguugguacggcuuccgucaccaaaauucagaggggcgcggacaggccgcggaccugaaaaguacacaggccgcaaucgaucagauuaacggcaaguugaacagacucauagguaaaaccaaugaaaaguuccaucagaucgagaaagaauuuagcgagguggaagggaggauucaagaccuggagaaguauguagaggauacgaagaucgacuuaugguccuacaacgcugaacugcucguggcccuugagaaucagcacaccaucgaucugacagacucugaaaugaacaaauuguucgagaagacuaaaaagcagcuacgggaaaaugcugaggauaugggcaacggaugcuuuaaaauuuaucauaagugugacaaugccugcauaggcagcauccgaaacgggaccuacgaucacgacgucuaucgcgacgaggcacugaauaacagauuccagauuaagggaguggaacucaaaucagguuacaaggauuggauccuguggauuaguuuugccaucuccugcuuccuucuguguguugcuuugcucggcuuuauaaugugggcgugccaaaaagggaauaucagguguaacauuugcaucuga

SEQ ID NO: 133542 - RNA, 1701 nt, Artificial Sequence; identical to SEQ ID NO: 131874
  derived and/or modified sequence opt3 from hemagglutinin__InfluenzaA__AHL97264

SEQ ID NO: 133543 - RNA, 1701 nt, Artificial Sequence; identical to SEQ ID NO: 132010
  derived and/or modified sequence opt3 from hemagglutinin__InfluenzaA__AHL97276

SEQ ID NO: 133544 - RNA, 1701 nt, Artificial Sequence
  derived and/or modified sequence opt3 from hemagglutinin__InfluenzaA__AHL97288
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcaacaguccacaccagauacuagacggcgaaaauuguacacucaucgaugcucugcuuggggacccgcagugcgauggauuucagaacaaaaagugggaccuguucguggagaggagcaaagccuauuccaauuguuaccccuaugaugucccugacuacgcaucuuugcggucgcucguggccucaagcggcacccuggaauuuaacaaugagaguuucaacuggacugguguuacacaaaaugggaccuccucugcuugcauucgccgaagcaacuccucauuuuucagucgucugaauuggcucacgcauuuaaacuuuaaguauccagcacugaacgugacuaugcccaauaacgagcaguucgauaaguuguacaucuggggaguccaccauccuggcaccgacaaagaucagauuuuucuuuaugcccagagcucuggcagaaucacaguguccacuaagaggucacaacaggcuguaauaccaaauauugggagccggccccgcaucagaaacauuccuaguaggaucucuaucuacuggaccauuguuaaaccaggagacauacugcuaaucaauuccacagguaaccucauugccccgcggggcuacuucaagauccgcagcgggaaaucgucuauaaugcgauccgaugcgcccauuggaaaguguaagucagaaugcaucaccccuaauggcaguaucccaaacgacaaacccuuucagaaugugaacagaauuacguauggugcauguccuagguacgucaagcagagcacucugaaacuugccacagggaugcggaaugugccagagaagcaaacccguggaaucuucggcgcuauugccggcuuuauagaaaacgggugggagggaaugguggacgguugguauggcuuccgccaccaaaauuccgaggggagaggacaggcagcugaucugaaaucuacucaggccgcgaucgaccagauuaacggcaaguugaauaggcucaucgguaaaacaaacgaaaaguuccaccagaucgagaaggaauuuagcgaggucgaagggcggauucaggaucuggagaaauacguugaggacaccaagauagauuuauggucauauaacgccgaacugcucguggcacuugagaaucaacauacgaucgaccugaccgauagugaaaugaacaaauuguucgagaagauuaaaaagcagcuacgagaaaaugcugaggacaugggcaacggaugcuuuaagaucuaccacaaaugugauaaugccugcauuggcuccauccgcaacgggacauaugaccauaauguauacagagaugaggcucugaacaauagguuccagauaaagggaguggaacucaaaagcgguuacaaggacuggauccuguggauuucuuuugccaucucaugcuuccuucugugugucgcauugcucggcuuuauuaugugggccugccagaaagggaacauccgguguaauauaugcauuuga

SEQ ID NO: 133545 - RNA, 1701 nt, Artificial Sequence; identical to SEQ ID NO: 131884
  derived and/or modified sequence opt3 from hemagglutinin__InfluenzaA__AHL97300

SEQ ID NO: 133546 - RNA, 1701 nt, Artificial Sequence; identical to SEQ ID NO: 132010
  derived and/or modified sequence opt3 from hemagglutinin__InfluenzaA__AHL97312

SEQ ID NO: 133547 - RNA, 1701 nt, Artificial Sequence; identical to SEQ ID NO: 132010
  derived and/or modified sequence opt3 from hemagglutinin__InfluenzaA__AHL97336

SEQ ID NO: 133548 - RNA, 1701 nt, Artificial Sequence; identical to SEQ ID NO: 132010
  derived and/or modified sequence opt3 from hemagglutinin__InfluenzaA__AHL97348

SEQ ID NO: 133549 - RNA, 1701 nt, Artificial Sequence
  derived and/or modified sequence opt3 from hemagglutinin__InfluenzaA__AHL97372
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaacgccuauuccaauuguuaccccuaugacgucccugauuacgcaucuuugcggucgcucguggccucaagcggcacccuggaauuuaacaaugagaguuucaacugggcugguguuacucaaaaugggacauccucugcaugcauucgcggaagcaacuccucauuuuucagucgacugaauuggcucacccauuuaaacuuuaaauauccagcccugaacgugacgaugcccaauaacgagcaguucgacaaguuguacaucuggggcguccaccauccuggcacugauaaggaccagauuuuucuuuaugcucagagcucugggcguaucaccguguccacaaaaagaucacaacaggccguaauaccaaauauuggaagcaggccccggauccgcaacauuccuaguagaaucucuaucuacuggacuauuguuaagccaggugauauacugcuaaucaauuccaccggcaaccucauugcgccgaggggguacuucaaaauccggagcggaaagucgucuauaaugcgcuccgacgcacccauuggcaaauguaagucagaaugcaucacaccuaaugguaguaucccaaacgacaagcccuuucagaaugugaaccgaauuaccuauggggccuguccuagauacgucaaacagagcacgcugaaacuugcuacuggaaugaggaaugugccagagaagcaaacacggggcaucuucggcgccauugcaggguuuauagaaaacggaugggaggguaugguggauggcugguauggguuccgucaccaaaauuccgagggacgcggccaggcugccgaccugaagucuacccaggcggccaucgaucagauuaacgguaaauugaauagacucaucgggaagacuaacgaaaaauuccaccagaucgagaaggaauuuagcgaggucgaaggcaggauucaggaccuggagaaguacguugaggauacaaaaauagacuuauggucauauaacgcagaacugcucguggcucuugagaaucaacauaccaucgaucugacggacagugaaaugaacaaguuguucgagaaaaccaagaaacagcuacgggaaaaugccgaggauaugggaaacggcugcuuuaagauuuaccacaagugugacaaugcuugcaucggguccauucgaaacggaacauaugaucaugacguauaccgcgacgaggcccugaauaacagauuccagaucaaagguguggaacucaagagcggcuacaaagauuggauacuguggaucucuuuugcaauuucaugcuuccuucugugugucgccuugcucggguuuaucaugugggcuugccagaagggaaauauuagguguaacaucugcauauga

SEQ ID NO: 133550 - RNA, 1701 nt, Artificial Sequence; identical to SEQ ID NO: 132010
  derived and/or modified sequence opt3 from hemagglutinin__InfluenzaA__AHL97384

SEQ ID NO: 133551 - RNA, 1701 nt, Artificial Sequence; identical to SEQ ID NO: 131874
  derived and/or modified sequence opt3 from hemagglutinin__InfluenzaA__AHL97396

SEQ ID NO: 133552 - RNA, 1701 nt, Artificial Sequence; identical to SEQ ID NO: 131851
  derived and/or modified sequence opt3 from hemagglutinin__InfluenzaA__AHL97408

SEQ ID NO: 133553 - RNA, 1701 nt, Artificial Sequence; identical to SEQ ID NO: 133522
  derived and/or modified sequence opt3 from hemagglutinin__InfluenzaA__AHL97420

SEQ ID NO: 133554 - RNA, 1701 nt, Artificial Sequence
  derived and/or modified sequence opt3 from hemagglutinin__InfluenzaA__AHL97444
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaacuuuacaucuggggcguccaccauccuggcacugauaaagaccagaucuuuuuguaugcucagagcucugggcguauuaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuaugggacguguccuagauacgucaagcagagcacucugaaacuugccacaggaaugaggaacgugccagagaagcaaacccggggcaucuucggcgcuauugccggguuuauagaaaauggaugggaggguaugguggauggcugguauggguuccgucaccagaacuccgagggacgcggccaggcagcugaccugaaaucuacucaagccgcgaucgaucagauuaaugguaaguugaacagacucaucgggaaaacaaaugaaaaguuccaccagaucgagaaggaauuuagcgaggucgaaggcaggauucaggaccuggagaaauacguugaggauaccaagauagacuuauggucauauaacgccgaacugcucguggcacuugagaaccaacauacgaucgaucugaccgacagugaaaugaauaaauuguucgagaagacaaagaagcagcuacgggaaaacgcugaggauaugggaaauggcugcuuuaagauuuaccacaaaugugacaacgccugcaucggguccauucgaaauggaacuuaugaucaugacguauaccgcgacgaggcucugaacaauagauuccagaucaaggguguggaacucaaaagcggcuacaaggauuggauacuguggaucucuuuugccauuucaugcuuccuucugugugucgcauugcucggguuuaucaugugggccugccagaaaggaaacauuagguguaauaucugcauauga

SEQ ID NO: 133555 - RNA, 1701 nt, Artificial Sequence; identical to SEQ ID NO: 131884
  derived and/or modified sequence opt3 from hemagglutinin__InfluenzaA__AHL97456

SEQ ID NO: 133556 - RNA, 1701 nt, Artificial Sequence
  derived and/or modified sequence opt3 from hemagglutinin__InfluenzaA__AHL97468
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugauggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgagguggaagggcggauucaggaccuggagaaauacgucgaggauaccaagauagacuuauggucauauaacgccgaacugcucguugcacuugagaaccaacauacgaucgaucugaccgacagugaaaugaauaaauuguucgagaagacaaagaagcagcuacgagaaaacgcugaggauaugggcaauggaugcuuuaagauuuaccacaaaugugacaacgccugcaucggcuccauucgcaaugggacuuaugaucauaacguguacagagacgaggcucugaauaacagguuccagaucaagggaguagaacucaaaagcgguuacaaggacuggauacuguggaucucuuuugccauuucaugcuuccuucuguguguggcauugcucggcuuuaucaugugggccugccagaaagggaauauucgguguaacaucugcauauga

SEQ ID NO: 133557 - RNA, 1701 nt, Artificial Sequence; identical to SEQ ID NO: 132010
  derived and/or modified sequence opt3 from hemagglutinin__InfluenzaA__AHL97480

SEQ ID NO: 133558 - RNA, 1701 nt, Artificial Sequence; identical to SEQ ID NO: 132010
  derived and/or modified sequence opt3 from hemagglutinin__InfluenzaA__AHL97493

SEQ ID NO: 133559 - RNA, 1701 nt, Artificial Sequence; identical to SEQ ID NO: 133522
  derived and/or modified sequence opt3 from hemagglutinin__InfluenzaA__AHL97505

SEQ ID NO: 133560 - RNA, 1701 nt, Artificial Sequence
  derived and/or modified sequence opt3 from hemagglutinin__InfluenzaA__AHL97517
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaguuguacaucuggggaguccaccauccuggcaccgauaaagaccagauuuuucuuuaugcccagagcucuggcagaaucacaguguccacucaaaggucacagcaggcuguaauaccaaacauugggagccggccccgcaucagaaauauuccuaguaggaucucuaucuacuggaccauuguuaagccaggagauauacugcuaaucaacuccacagguaaucucauugccccgcggggcuacuucaaaauccgcagcgggaagucgucuauaaugcgauccgacgcgcccauuggaaaauguaagucagaaugcaucaccccuaacggcaguaucccaaaugacaagcccuuucagaacgugaauagaauuacguauggugcauguccuagguacgucaaacaaagcacucugaaacuugccacagggaugcggaacgugccagagaagcagacccguggaaucuucggcgcuauugccggcuuuauagaaaaugggugggagggaaugguggaugguugguauggcuuccgccaccagaacuccgaggggagaggacaagcagcugaccugaagucuacucaggccgcgaucgaucagauuaauggcaaauugaacaggcucaucgguaagacaaaugaaaaauuccaccagaucgagaaggaauuuagcgaggucgaagggcggauucaagaccuggagaaguacguugaggauaccaaaauagacuuauggucauauaacgccgaacugcucguggcacuugagaaccagcauacgaucgaucugaccgacagugaaaugaauaaguuguucgagaaaacaaagaaacagcuacgagaaaacgcugaggauaugggcaauggaugcuuuaagauuuaccacaagugugacaacgccugcaucggcuccauucgcaaugggacuuaugaucauaacguauacagagacgaggcucugaauaacagguuccagaucaaaggaguggaacucaagagcgguuacaaagacuggauacuguggaucucuuuugccauuucaugcuuccuucugugugucgcauugcucggcuuuaucaugugggccugccaaaaggggaauauucgguguaacaucugcauauga

SEQ ID NO: 133561 - RNA, 1701 nt, Artificial Sequence; identical to SEQ ID NO: 131899
  derived and/or modified sequence opt3 from hemagglutinin__InfluenzaA__AHL97529

SEQ ID NO: 133562 - RNA, 1701 nt, Artificial Sequence; identical to SEQ ID NO: 131884
  derived and/or modified sequence opt3 from hemagglutinin__InfluenzaA__AHL97541

SEQ ID NO: 133563 - RNA, 1701 nt, Artificial Sequence; identical to SEQ ID NO: 132010
  derived and/or modified sequence opt3 from hemagglutinin__InfluenzaA__AHL97553

SEQ ID NO: 133564 - RNA, 1701 nt, Artificial Sequence; identical to SEQ ID NO: 131851
  derived and/or modified sequence opt3 from hemagglutinin__InfluenzaA__AHL97565

SEQ ID NO: 133565 - RNA, 1701 nt, Artificial Sequence
  derived and/or modified sequence opt3 from hemagglutinin__InfluenzaA__AHL97577
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcggaagcaauuccucauuuuucagucgacugaacuggcugacgcaucucaauuuuaaguauccagcauuaaacgugacuaugcccaacaaugagcaguucgacaagcuguacauuuggggcguccaccauccuggcaccgauaaagaccagaucuuucuuuaugcccagagcucugggcguauaacaguguccacuaagagaucacaacaggcuguaauuccaaacaucggaagcaggccccggauucgcaauaucccuaguagaaucucuauuuacuggaccauaguuaaaccaggugauaucuugcugauuaacuccacaggcaaucuaaucgccccgaggggguacuucaagauacggagcggaaaaucgucuauuaugcgcuccgacgcgcccaucggcaaguguaagucagaaugcaucaccccuaacgguaguauuccaaaugacaaacccuuucagaacgugaaucgaaucacguauggggcauguccuagauacgucaagcagagcacucucaaacuggccacaggaaugaggaacgugccagagaagcaaacccggggcauuuucggcgcuauagccggguuuaucgaaaauggaugggaggguaugguggauggcugguauggguuccgucaccagaacuccgagggacgcggccaggcagcugaccuuaaaucuacucaagccgcgauugaucagaucaaugguaagcugaacagauugaucgggaaaacaaaugaaaaguuccaccagauugagaaggaauuuagcgaggucgaaggcaggauacaggaccucgagaaauacguugaggauaccaagaucgaccuguggucauauaacgccgaauuacugguggcacucgagaaccaacauacgauugaucuuaccgacagugaaaugaauaaacuguucgagcggacaaagaaacaguugcgagaaaacgcugaggauaugggaaauggcugcuuuaagaucuaccacaagugugacaacgccugcauuggguccauccgcaauggaacuuaugaucaugacguauacagagacgaggcucuaaacaauagguuccagauaaaagguguggaacugaagcccggcuacaaagauuggauccucuggauuagcuuugccaucucuugcuuccugcuuugugucgcacuguugggguuuauuaugugggccugccagaagggaaacauccgguguaauauaugcauuuga

SEQ ID NO: 133566 - RNA, 1701 nt, Artificial Sequence; identical to SEQ ID NO: 132039
  derived and/or modified sequence opt3 from hemagglutinin__InfluenzaA__AHL97589

SEQ ID NO: 133567 - RNA, 1701 nt, Artificial Sequence; identical to SEQ ID NO: 132010
  derived and/or modified sequence opt3 from hemagglutinin__InfluenzaA__AHL97601

SEQ ID NO: 133568 - RNA, 1701 nt, Artificial Sequence; identical to SEQ ID NO: 131874
  derived and/or modified sequence opt3 from hemagglutinin__InfluenzaA__AHL97613

SEQ ID NO: 133569 - RNA, 1701 nt, Artificial Sequence; identical to SEQ ID NO: 133556
  derived and/or modified sequence opt3 from hemagglutinin__InfluenzaA__AHL97625

SEQ ID NO: 133570 - RNA, 1701 nt, Artificial Sequence; identical to SEQ ID NO: 131884
  derived and/or modified sequence opt3 from hemagglutinin__InfluenzaA__AHL97637

SEQ ID NO: 133571 - RNA, 1701 nt, Artificial Sequence
  derived and/or modified sequence opt3 from hemagglutinin__InfluenzaA__AHL97661
augaagaccaucauugcccugggcuacauacucugccuuguguucgcucagaaacugcccgggaacgacaauagcacagcaacuuuguguuuaggacaccaugccgucccuaacgguacgaucguuaagaccauuacaaaugauagaaucgaggugacuaacgcgaccgaacugguacaaaauuccucuauuggcgagaucugcgacucaccacaccagauacuagauggggaaaacuguacacucaucgacgcucugcuuggagauccgcagugcgacggcuuucagaauaaaaagugggaucuguucguggagaggaguaaagccuauagcaacuguuaccccuaugacgucccugauuacgcauccuugcggucucucguggccucgucagguacccuggaauuuaauaacgagagcuucaauuggacugggguuacacaaaacggaaccaguuccgcuugcauucgccgaucuaauagcuccuuuuucucacgucugaacuggcucacgcauuuaaauuuuaaguauccagcacugaacgugacuaugcccaacaaugagcaguucgacaaacuuuacaucuggggcguccaccauccuggcaccgauaaagaccagaucuuuuuguaugcccagaguagcgggagaauuacagugucuacuaagaggucccaacaggcuguaauaccaaacauuggaucacggccccgcaucagaaauauuccuagcaggaucaguaucuacuggaccauuguuaaaccaggugauauacugcuaaucaacucuacaggcaaucucauugccccgcggggguacuucaagauccgcuccggaaaaagcucgauaaugcgaucugacgcgcccauuggcaaguguaaguccgaaugcaucaccccuaacgguucaaucccaaaugacaaacccuuucagaacgugaauagaauuacguauggggcauguccuagguacgucaagcagaguacucugaaacuugccacaggaaugcggaacgugccagagaagcaaacccguggcaucuucggcgcuauugccggguuuauagaaaauggaugggaggguaugguggauggcugguauggguuccgccaccagaacagcgagggaagaggccaggcagcugaccugaaauccacucaagccgcgaucgaucagauuaaugguaaguugaacaggcucaucgggaaaacaaaugaaaaguuccaccagaucgagaaggaauuuucugaggucgaaggccggauucaggaccuggagaaauacguugaggauaccaagauagacuuauggagcuauaacgccgaacugcucguggcacuugagaaccaacauacgaucgaucugaccgacucagaaaugaauaaauuguucgagaagacaaagaagcagcuacgagaaaacgcugaggauaugggaaauggcugcuuuaagauuuaccacaaaugugacaacgccugcaucgggaguauucgcaauggaacuuaugaucauaacguauacagagacgaggcucugaauaacagguuccagaucaaggguguggaacucaaauccggcuacaaggacuggauacuguggaucagcuuugccauuucuugcuuccuucugugugucgcauugcucggguuuaucaugugggccugccagaaaggaaauauucgguguaacaucugcauauga

SEQ ID NO: 133572 - RNA, 1701 nt, Artificial Sequence
  derived and/or modified sequence opt3 from hemagglutinin__InfluenzaA__AHL97673
augaagaccacaaucgcccugagcuacauucucugccuuguguucgcucaggagcugcccggcaacgacgauuccacugcaacguuguguuuagggcaccaugccgucccuaauggaaccauaguuaaaacaaucacuaacgaccaaauugaagugaccaaugcgacagagcugguacagucuucaaguaccggugaaaucugcaacagcccacaccagauucuagauggcgagaauuguacucucaucgacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacacuggaguuuaacaaugaguccuucaacuggaccgguguuacgcagaaugggacuucuagcgcuugcauacggcgcuccaacaauucauuuuucagucgacugaacuggcucacccacuuaaauuuuaaauacccagcacugaacgugacaaugcccaacaaugaacaguucgacaaguuguauaucuggggaguccaucacccuggcacugauaaggaccagauuuuucuuuacgcccaagcuagcggccguaucaccgugucuacaaaaagaucccagcaggccguaauuccaaacaucgggucaaggccccggguucgcaauauaccuagcagagugaguauuuauuggaccaucgucaagccaggagauauucugcuaaucaacucuacggguaaucucaucgcgccgaggggcuacuucaaaauucgguccggaaagagcucgauaaugcgcucugacgcacccaucgggaaauguaacuccgccugcauuacuccuaauggcucaaucccaaacgacaagcccuuucagaaugugaaccgaauaacauacggugcuuguccuagauaugugaagcaaaauacccugaaacuugccacugggaugaggaacgucccagagaagcagacacggggaauuuucggcgcaaucgcuggcuuuaucgaaaaugggugggagggaaugguugaugguugguacggcuuccgucaccagaacagugaggggcgcggacaagccgcggaccugaaaagcacccaggccgcaauugaucagaucaauggcaaguugaacagacucauugguaaaacgaacgaaaaguuccaucagauagagaaagaauuuuccgagguggaagggaggauccaagaccuggagaaguauguagaggauaccaagauugacuuauggucuuacaaugcugaacugcucguggcccuugagaaccagcacacaaucgaucugacugacagcgaaaugaauaaauuguucgagaagaccaaaaagcagcuacgggaaaacgcugaggauaugggcaauggaugcuuuaaaaucuaucauaagugugacaacgccugcauuggcucaauacgaaaugggacauacgaucacgacgucuaucgcgacgaggcacugaacaauagauuccagaucaagggaguggaacucaaaagugguuacaaggauuggauucuguggaucuccuuugccauuagcugcuuccuucuguguguugcuuugcucggcuuuaucaugugggcgugccaaaaagggaacauaagguguaauaucugcauuuga

SEQ ID NO: 133573 - RNA, 1701 nt, Artificial Sequence; identical to SEQ ID NO: 132010
  derived and/or modified sequence opt3 from hemagglutinin__InfluenzaA__AHL97685

SEQ ID NO: 133574 - RNA, 1701 nt, Artificial Sequence
  derived and/or modified sequence opt3 from hemagglutinin__InfluenzaA__AHL97697
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggggcaaagccuauagcaacuguuaccccuaugacgucccugauuacgcauccuugcggucucucguggccucgucagguacccuggaauuuaauaacgagagcuucaauugggcugggguuacucaaaacggaacaaguuccgcaugcauucgcggcucuaauagcuccuuuuucucacgacugaacuggcucacccauuuaaauuuuaaguauccagcccugaacgugacgaugcccaacaaugagcaguucgacaaguuguacaucuggggcguccaccauccugggacugauaaagaccagauuuuucuuuaugcucagaguagcggacguaucaccgugucuacaaagagaucccaacaggccguaauaccaaacauugguucaaggccccggauccgcaauauuccuagcagaaucaguaucuacuggacuauuguuaaaccaggcgauauacugcuaaucaacucuaccgggaaucucauugcgccgaggggauacuucaagauccgguccggcaaaagcucgauaaugcgcucugacgcacccauugguaaguguaaguccgaaugcaucacaccuaacgggucaaucccaaaugacaaacccuuucagaacgugaaucgaauuaccuauggagccuguccuagauacgucaagcagaguacgcugaaacuugcuacuggcaugaggaacgugccagagaagcaaacacggggcaucuucggggccauugcaggauuuauagaaaaugguugggagggcaugguggaugggugguauggauuccgucaccagaacagcgagggccgcggucaggcugccgaccugaaauccacccaagcggccaucgaucagauuaaugggaaguugaacagacucaucggcaaaacuaaugaaaaguuccaccagaucgagaaggaauuuucugaggucgaaggaaggauucaggaccuggagaaauacguugaggauacaaagauagacuuauggagcuauaacgcagaacugcucguggcucuugagaaccaacauaccaucgaucugacggacucagaaaugaauaaauuguucgagaagaccaaaaagcagcuacgggaaaacgccgaggauaugggcaaugggugcuuuaagauuuaccacaaaugugacaacgcuugcaucggaaguauucgaaaugguacauaugaucaugacguauaccgcgacgaggcccugaacaauagauuccagaucaagggcguggaacucaaauccggguacaaggauuggauacuguggaucagcuuugcaauuucuugcuuccuucugugugucgccuugcucggauuuaucaugugggcuugccagaaaggcaacauuagguguaauaucugcauauga

SEQ ID NO: 133575 - RNA, 1701 nt, Artificial Sequence; identical to SEQ ID NO: 131884
  derived and/or modified sequence opt3 from hemagglutinin__InfluenzaA__AHL97709

SEQ ID NO: 133576 - RNA, 1701 nt, Artificial Sequence; identical to SEQ ID NO: 132010
  derived and/or modified sequence opt3 from hemagglutinin__InfluenzaA__AHL97721

SEQ ID NO: 133577 - RNA, 1701 nt, Artificial Sequence; identical to SEQ ID NO: 131884
  derived and/or modified sequence opt3 from hemagglutinin__InfluenzaA__AHL97733

SEQ ID NO: 133578 - RNA, 1701 nt, Artificial Sequence; identical to SEQ ID NO: 131874
  derived and/or modified sequence opt3 from hemagglutinin__InfluenzaA__AHL97745

SEQ ID NO: 133579 - RNA, 1701 nt, Artificial Sequence; identical to SEQ ID NO: 132010
  derived and/or modified sequence opt3 from hemagglutinin__InfluenzaA__AHL97757

SEQ ID NO: 133580 - RNA, 1701 nt, Artificial Sequence; identical to SEQ ID NO: 132010
  derived and/or modified sequence opt3 from hemagglutinin__InfluenzaA__AHL97769

SEQ ID NO: 133581 - RNA, 1701 nt, Artificial Sequence
  derived and/or modified sequence opt3 from hemagglutinin__InfluenzaA__AHL97781
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgaccaaaucgaagugacuaaugcgaccgagcugguacagucuucaaguacaggugaaauuugcaacagcccacaccagauccuagauggcgagaauuguacccucauagacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacucuggaguuuaacaaugaguccuucaacuggacagguguuacccagaaugggacgucuagcgcuugcauccggcgcuccaacaauucauuuuucagucgacugaacuggcucacucacuuaaauuuuaaauacccagcacugaacgugaccaugcccaacaaugaacaguucgacaagcuguauauuuggggaguccaucacccuggcacagauaaggaccagaucuuuuuguacgcccaagcuagcggccguauuacugugucuaccaaaagaucccagcaggccguaaucccaaacauagggucaaggccccggguucgcaauauuccuagcagagugaguaucuauuggacaauugucaagccaggagauauccugcuaaucaacucuaccgguaaucucauugcgccgaggggcuacuucaaaauacgguccgggaacagcucgaucaugcgcucugacgcacccauuggaaaguguaauuccacgugcaucacuccuaacggcucaauaccaaaugacaaacccuuucagaacgugaaucgaauuacauacggugccuguccuagauaugugaagcaaaacacccugaaacuugcuacugggaugaggaaugucccagagaagcagacacggggaaucuucggcgccaucgcaggcuuuauugaaaacgggugggagggaaugguugaugguugguacggcuuccgucaccagaauagugaggggcgcggacaagcugccgaccuuaagagcacccaggcggccaucgaucagauuaacggcaaauugaacagacucauagguaagacgaaugaaaaauuccaucagaucgagaaggaauuuuccgagguggaagggaggauucaagaccuggagaaauauguagaggauaccaagaucgacuuauggucuuacaacgcagaacugcucguggcucuugagaaucagcacacaaucgaucugacugacagcgaaaugaacaaguuguucgagaaaaccaagaaacagcuacgggaaaaugccgaggauaugggcaacggaugcuuuaagauuuaucauaaaugugacaaugcuugcauaggcucaauccgaaacgggacauacgaucacgacgucuaucgcgacgaggcccugaauaacagauuccagauuaagggaguggaacucaagagugguuacaaagauuggauccuguggauuuccuuugcaaucagcugcuuccuucuguguguugccuugcucggcuuuauaaugugggcuugccaaaaggggaauaucagguguaacauuugcaucuga

SEQ ID NO: 133582 - RNA, 1701 nt, Artificial Sequence; identical to SEQ ID NO: 132010
  derived and/or modified sequence opt3 from hemagglutinin__InfluenzaA__AHL97793

SEQ ID NO: 133583 - RNA, 1701 nt, Artificial Sequence
  derived and/or modified sequence opt3 from hemagglutinin__InfluenzaA__AHL97805
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuacgagggacgcggccaggcugccgaccugaaauccacccaagcggccaucgaucagauuaaugguaaguugaacagacucaucgggaaaacuaaugaaaaguuccaccagaucgagaaggaauuuucugaggucgaaggcaggauucaggaccuggagaaauauguugaggauacaaagauagacuuauggagcuacaacgcagaacugcucguggcucuugagaaccaacauaccaucgaucugacggacucagaaaugaauaaauuguucgagaagaccaaaaagcagcuacgggaaaacgccgaggauaugggaaauggcugcuuuaagauuuaucacaaaugugacaacgcuugcaucgggaguauucgaaauggaacauacgaucaugacguauaccgcgacgaggcccugaacaauagauuccagaucaaggguguggaacucaaauccggcuauaaggauuggauacuguggaucagcuuugcaauuucuugcuuccuucugugugucgccuugcucggguuuaucaugugggcuugccagaaaggaaacauuagguguaauaucugcauauga

SEQ ID NO: 133584 - RNA, 1701 nt, Artificial Sequence; identical to SEQ ID NO: 131884
  derived and/or modified sequence opt3 from hemagglutinin__InfluenzaA__AHL97817

SEQ ID NO: 133585 - RNA, 1701 nt, Artificial Sequence; identical to SEQ ID NO: 133574
  derived and/or modified sequence opt3 from hemagglutinin__InfluenzaA__AHL97829

SEQ ID NO: 133586 - RNA, 1701 nt, Artificial Sequence; identical to SEQ ID NO: 132010
  derived and/or modified sequence opt3 from hemagglutinin__InfluenzaA__AHL97841

SEQ ID NO: 133587 - RNA, 1701 nt, Artificial Sequence; identical to SEQ ID NO: 132010
  derived and/or modified sequence opt3 from hemagglutinin__InfluenzaA__AHL97853

SEQ ID NO: 133588 - RNA, 1701 nt, Artificial Sequence; identical to SEQ ID NO: 132010
  derived and/or modified sequence opt3 from hemagglutinin__InfluenzaA__AHL97865

SEQ ID NO: 133589 - RNA, 1701 nt, Artificial Sequence; identical to SEQ ID NO: 132010
  derived and/or modified sequence opt3 from hemagglutinin__InfluenzaA__AHL97877

SEQ ID NO: 133590 - RNA, 1701 nt, Artificial Sequence; identical to SEQ ID NO: 131884
  derived and/or modified sequence opt3 from hemagglutinin__InfluenzaA__AHL97889

SEQ ID NO: 133591 - RNA, 1701 nt, Artificial Sequence; identical to SEQ ID NO: 131884
  derived and/or modified sequence opt3 from hemagglutinin__InfluenzaA__AHL97901

SEQ ID NO: 133592 - RNA, 1701 nt, Artificial Sequence; identical to SEQ ID NO: 131874
  derived and/or modified sequence opt3 from hemagglutinin__InfluenzaA__AHL97913

SEQ ID NO: 133593 - RNA, 1701 nt, Artificial Sequence
  derived and/or modified sequence opt3 from hemagglutinin__InfluenzaA__AHL97925
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauaacuccuuuuucucacgucugaauuggcucacgcauaguaacuuuaaguauccagcauuaaacgugacuaugcccaauaacgagcaguucgacaagcuguacaucuggggaguccaccauccuggcaccgauaaagaccagauuuuucuuuaugcccagagcucuggcagaaucacaguguccacuaagaggucacaacaggcuguaauaccaaauauugggagccggccccgcaucagaaacauuccuaguaggaucucuaucuacuggaccauuguuaaaccaggagauauauugcugaucaauuccacagguaaccuaauugccccgcggggcuacuucaagauccgcagcgggaaaucgucuauaaugcgauccgacgcgcccauuggaaaguguaagucagaaugcaucaccccuaauggcaguaucccaaacgacaaacccuuucagaaugugaacagaauuacguauggugcauguccuagguacgucaagcagagcacucucaaacuggccacagggaugcggaaugugccagagaagcaaacccguggaaucuucggcgcuauugccggcuuuauagaaaacgggugggagggaaugauggaugguugguauggcuuccgccaccaaaauuccgaggggagaggacaggcagcugaccuuaaaucuacucaggccgcgaucgaucagauuaacggcaagcugaauagguugaucgguaaaacaaacgaaaaguuccaccagaucgagaaggaauuuagcgagguggaagggcggauucaggaccucgagaaauacgucgaggauaccaagauagaccuguggucauauaacgccgaauuacugguugcacucgagaaucaacauacgaucgaucuuaccgacagugaaaugaacaaacuguucgagaagacuaaaaaguugcuacgagaaaaugcugaggauaugggcaacggaugcuuuaagauuuaccacaaaugugacaaugccugcaucggcuccauucgcaacgggacauaugaucaugacguguacagagacgaggcucugaauaacagguuccagaucaagggaguagaacucaaaagcgguuacaaggauuggauacuguggaucucuuuugccauuucaugcuuccuucuguguguggcauugcucggcuuuaucaugugggccugccagaaagggaauauucgguguaacaucugcauauga

SEQ ID NO: 133594 - RNA, 1701 nt, Artificial Sequence; identical to SEQ ID NO: 131874
  derived and/or modified sequence opt3 from hemagglutinin__InfluenzaA__AHL97937

SEQ ID NO: 133595 - RNA, 1701 nt, Artificial Sequence; identical to SEQ ID NO: 133554
  derived and/or modified sequence opt3 from hemagglutinin__InfluenzaA__AHL97949

SEQ ID NO: 133596 - RNA, 1701 nt, Artificial Sequence; identical to SEQ ID NO: 131884
  derived and/or modified sequence opt3 from hemagglutinin__InfluenzaA__AHL97961

SEQ ID NO: 133597 - RNA, 1701 nt, Artificial Sequence; identical to SEQ ID NO: 131884
  derived and/or modified sequence opt3 from hemagglutinin__InfluenzaA__AHL97973

SEQ ID NO: 133598 - RNA, 1701 nt, Artificial Sequence; identical to SEQ ID NO: 131884
  derived and/or modified sequence opt3 from hemagglutinin__InfluenzaA__AHL97985

SEQ ID NO: 133599 - RNA, 1701 nt, Artificial Sequence
  derived and/or modified sequence opt3 from hemagglutinin__InfluenzaA__AHL97997
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgaggucgaagggcggauucaggaccuggagaaauacguugaggauaccaagauagacuuauggucauauaacgccgaacugcucguggcacuugagaaccaacauacgaucgaucugaccgacagugaaaugaauaaauuguucgagaagacaaagaagcagcuacgagaaaacgcugaggauaugggcaauggaugcuuuaagauuuaccacaaaugugacaacgccugcaucggcuccauucgcaaugggacuuaugaucaugacguauacagagacgaggcucugaacaauagguuccagauccggggaguggaacucaagagcgguuacaaagauuggauacuguggaucucuuuugccauuucaugcuuccuucugugugucgcauugcucggcuuuaucaugugggccugccagaaggggaacauucgcuguaauaucugcauauga

SEQ ID NO: 133600 - RNA, 1701 nt, Artificial Sequence; identical to SEQ ID NO: 132010
  derived and/or modified sequence opt3 from hemagglutinin__InfluenzaA__AHL98009

SEQ ID NO: 133601 - RNA, 1701 nt, Artificial Sequence
  derived and/or modified sequence opt3 from hemagglutinin__InfluenzaA__AHL98021
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauugguaaaaucugcgacaguccacaccagauacuagauggcgagaacuguacacucauggacgcucugcuuggggauccgcagugcgacggauuucagaauaagaaaugggaucuguucguggaaaggagcaaggccuauuccaacuguuaccccuaugacgucccugauuacgcaucuuugcggucgcucguggccucaagcggcacccuggaguuuaauaacgaaaguuucaauugggcugguguuacucaaaacgggacauccucugcaugcauccgccgaagcaauuccucauuuuucagucgucugaacuggcucacccauuuaaauuuuaaguauccagcccugaacgugacgaugcccaacaaugagcaguucgacaaacuuuacauuuggggaguccaccauccuggcacugauaaggaccagaucuuuuuguaugcucagagcucuggcagaauuaccguguccacaaaaaggucacaacaggccguaaucccaaacauagggagccggccccgcauuagaaauaucccuaguaggauuucuaucuacuggacuaucguuaagccaggagauauucugcuaauaaacuccaccgguaaucucaucgcgccgcggggcuacuucaaaauucgcagcgggaagucgucuaucaugcgauccgacgcacccauaggaaaguguaaaucagagugcauuacaccuaacggcaguaucccaaaugacaagcccuuucagaacgugaauagaaucaccuauggugccuguccuagguacgucaaacagagcacgcugaaacuugcuacugggaugcggaacgugccagaaaaacaaacacguggaauuuucggcgccaucgcaggcuuuauugagaaugggugggaaggaaugauggaugguugguauggcuuccgccaccagaacuccgaggggagaggacaggcugccgaccugaagucuacccaagcggccauagaucagaucaauggcaaauugaacaggcucauugguaagacuaaugagaaguuccaccagaucgaaaaagaguuuagcgaaguggaggggcggauccaggaccuggaaaaguacgucgaggauacaaaaauugacuuauggucauauaacgcagagcugcucguugcucuugaaaaccaacauaccauagaucugacggacagugagaugaauaaguuguucgaaaagaccaagaagcagcuacgagagaacgccgaagauaugggcaauggaugcuuuaaaaucuaccacaagugugacaacgcuugcauuggcuccauccgcaaugggacauaugaucauaacguguacagagacgaggcccugaauaacagguuccagauuaaaggaguagagcucaagagcgguuacaaagacuggauccuguggauaucuuuugcaaucucaugcuuccuucuguguguggccuugcucggcuuuauuaugugggcuugccagaaggggaauauccgguguaacauuugcaucuga

SEQ ID NO: 133602 - RNA, 1701 nt, Artificial Sequence; identical to SEQ ID NO: 131884
  derived and/or modified sequence opt3 from hemagglutinin__InfluenzaA__AHL98033

SEQ ID NO: 133603 - RNA, 1701 nt, Artificial Sequence; identical to SEQ ID NO: 133481
  derived and/or modified sequence opt3 from hemagglutinin__InfluenzaA__AHL98045

SEQ ID NO: 133604 - RNA, 1701 nt, Artificial Sequence; identical to SEQ ID NO: 133481
  derived and/or modified sequence opt3 from hemagglutinin__InfluenzaA__AHL98057

SEQ ID NO: 133605 - RNA, 1701 nt, Artificial Sequence; identical to SEQ ID NO: 133481
  derived and/or modified sequence opt3 from hemagglutinin__InfluenzaA__AHL98069

SEQ ID NO: 133606 - RNA, 1701 nt, Artificial Sequence
  derived and/or modified sequence opt3 from hemagglutinin__InfluenzaA__AHL98081
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgcaagagcaauuccucauuuuucagucgacugaacuggcucacgcauuuaaauuuuaaguauccagcacugaacgugacuaugcccaacaaugagcaguucgacaaacuuuacaucuggggaguccaccauccuggcaccgauaaggaccagaucuuuuuguaugcccagagcucuggccguauuacaguguccacucaaagaucacagcaggcuguaauaccaaacauugggagcaggccccggauccgcaauauuccuaguagaaucucuaucuacuggaccauuguuaaaccaggagauauacugcuaaucaacuccacagguaaucucauugccccgaggggcuacuucaagauccggagcgggaaaucgucuauaaugcgcuccgacgcgcccauuggaaaguguaagucagaaugcaucaccccuaacggcaguaucccaaaugacaaacccuuucagaacgugaaucgaauuacguauggugcauguccuagauacgucaagcaaagcacucugaaacuugccacagggaugaggaacgugccagagaagcagacccggggaaucuucggcgcuauugccggcuuuauagaaaaugggugggagggaaugguggaugguugguauggcuuccgucaccagaacuccgaggggcgcggacaagcagcugaccugaaaucuacucaggccgcgaucgaucagauuaauggcaaguugaacagacucgucgguaaaacaaaugaaaaguuccaccagaucgagaaggaauuuagcgagguugaagggaggauccaagaccuggagaaauacguggaggauaccaagauugacuuauggucauauaacgccgaacugcucguagcacuugagaaccagcauacgauagaucugaccgacagugaaaugaauaaauuguucgagaagacuaaaaagcagcuacgggaaaacgcugaggauaugggcaauggaugcuuuaagaucuaccacaaaugugacaacgccugcauuggcuccauccgaaaugggacauaugaucaugacguguaccgcgacgaggcucugaacaauagauuccagauuaagggagucgaacucaaaagcgguuacaaggauuggauccuguggauaucuuuugccaucucaugcuuccuucuguguguggcauugcucggcuuuauuaugugggccugccaaaaagggaacaucagguguaauauuugcaucuga

SEQ ID NO: 133607 - RNA, 1701 nt, Artificial Sequence; identical to SEQ ID NO: 131874
  derived and/or modified sequence opt3 from hemagglutinin__InfluenzaA__AHL98093

SEQ ID NO: 133608 - RNA, 1701 nt, Artificial Sequence
  derived and/or modified sequence opt3 from hemagglutinin__InfluenzaA__AHL98105
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuggaucggacaacggcacuugcuauccaggugauuuuaucgacuacgaagaguugagggagcagcucucaagcgugaguuccuucgaacgguuugagauuuucccgaagacaucuagcuggcccaaucacgauuccaacaagggggucaccgccgcuuguccucaugcaggagccaaaggcuuuuauaagaaucugaucuggcuggugaaaaagggcaacucauacccaaaacucaguauaagcuauaucaaugacaaggggaaggaaguauuaguucugugggguauucaccaccccucuacgacugcugaucaacagucccuuuaccagaacgccgacaccuacguguucgucggagcgucacgcuauagcaaaaaguuuaaaccugagaucgcaauucgaccaaaggugcgugaucaggagggcagaaugaauuacuauuggacauugguggaacccggggacaaaaucacuuucgaggccaccggaaaccuggucguuccuagguacgcuuuugccauggaacggaacgcaggcagugguauaauuaucucugauacaccagugcaugacugcaauaccacgugucaaacuccgaagggggcuauuaacacaucccuacccuuccagaauauccacccuaucaccauuggaaaaugcccaaaguauguaaagagcacuaaacuccgccuggccacaggccuuagaaacgugcccucgauacagucuaggggccuguuuggggcgaucgccggauucauugaggguggcuggaccgggauggucgacggaugguacggcuaucaucaccagaaugaacaagguuccggguacgcagcugauuugaagucaacgcagaacgccaucgacaaaauaaccaauaaggugaacaguguuauugagaaaaugaauacacaguuuacugcugugggcaaggaguucaaccaccucgaaaagcggaucgagaaucugaacaaaaaggucgaugacggauucuuagauaucuggaccuacaaugccgaacugcucgugcuucuggagaacgaacgcacauuggacuaucaugauagcaauguuaaaaaccuauacgagaagguacgaaaccagcugaaaaauaacgcaaaggagauuggcaauggguguuuugaguucuaucacaagugcgacaacacuuguauggaauccgugaaaaauggaaccuacgauuauccuaaguacucugaagaggccaaacucaacagagaagagaucgacggugucaagcuggagagcacaaggauuuaucaaauacuugcuaucuacucaaccgcggcaaguucccugguguuggucgugagccucggcgccauuucuuuuuggaugugcucaaaugggagucugcagugccggaucuguaucuga

SEQ ID NO: 133609 - RNA, 1701 nt, Artificial Sequence; identical to SEQ ID NO: 131874
  derived and/or modified sequence opt3 from hemagglutinin__InfluenzaA__AHL98116

SEQ ID NO: 133610 - RNA, 1701 nt, Artificial Sequence; identical to SEQ ID NO: 131884
  derived and/or modified sequence opt3 from hemagglutinin__InfluenzaA__AHL98128

SEQ ID NO: 133611 - RNA, 1701 nt, Artificial Sequence; identical to SEQ ID NO: 131874
  derived and/or modified sequence opt3 from hemagglutinin__InfluenzaA__AHL98140

SEQ ID NO: 133612 - RNA, 1701 nt, Artificial Sequence; identical to SEQ ID NO: 131874
  derived and/or modified sequence opt3 from hemagglutinin__InfluenzaA__AHL98152

SEQ ID NO: 133613 - RNA, 1701 nt, Artificial Sequence; identical to SEQ ID NO: 131884
  derived and/or modified sequence opt3 from hemagglutinin__InfluenzaA__AHL98164

SEQ ID NO: 133614 - RNA, 1701 nt, Artificial Sequence; identical to SEQ ID NO: 131884
  derived and/or modified sequence opt3 from hemagglutinin__InfluenzaA__AHL98176

SEQ ID NO: 133615 - RNA, 1701 nt, Artificial Sequence; identical to SEQ ID NO: 131874
  derived and/or modified sequence opt3 from hemagglutinin__InfluenzaA__AHL98188

SEQ ID NO: 133616 - RNA, 1701 nt, Artificial Sequence; identical to SEQ ID NO: 132039
  derived and/or modified sequence opt3 from hemagglutinin__InfluenzaA__AHL98200

SEQ ID NO: 133617 - RNA, 1701 nt, Artificial Sequence; identical to SEQ ID NO: 131874
  derived and/or modified sequence opt3 from hemagglutinin__InfluenzaA__AHL98212

SEQ ID NO: 133618 - RNA, 1701 nt, Artificial Sequence; identical to SEQ ID NO: 131874
  derived and/or modified sequence opt3 from hemagglutinin__InfluenzaA__AHL98224

SEQ ID NO: 133619 - RNA, 1701 nt, Artificial Sequence; identical to SEQ ID NO: 132010
  derived and/or modified sequence opt3 from hemagglutinin__InfluenzaA__AHL98236

SEQ ID NO: 133620 - RNA, 1701 nt, Artificial Sequence; identical to SEQ ID NO: 131884
  derived and/or modified sequence opt3 from hemagglutinin__InfluenzaA__AHL98248

SEQ ID NO: 133621 - RNA, 1701 nt, Artificial Sequence; identical to SEQ ID NO: 131874
  derived and/or modified sequence opt3 from hemagglutinin__InfluenzaA__AHL98260

SEQ ID NO: 133622 - RNA, 1701 nt, Artificial Sequence; identical to SEQ ID NO: 131884
  derived and/or modified sequence opt3 from hemagglutinin__InfluenzaA__AHL98272

SEQ ID NO: 133623 - RNA, 1701 nt, Artificial Sequence; identical to SEQ ID NO: 133480
  derived and/or modified sequence opt3 from hemagglutinin__InfluenzaA__AHL98284

SEQ ID NO: 133624 - RNA, 1701 nt, Artificial Sequence
  derived and/or modified sequence opt3 from hemagglutinin__InfluenzaA__AHL98295
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauugggcugguguuacucaaaacgggacauccucugcaugcauccgcggaagcaauuccucauuuuucagucgacugaacuggcugacccaucucaauuuuaaguauccagccuuaaacgugacgaugcccaacaaugagcaguucgacaagcuguacauuuggggcguccaccauccuggcacugauaaagaccagaucuuucuuuaugcucagagcucugggcguauaaccguguccacaaagagaucacaacaggccguaauuccaaacaucggaagcaggccccggauucgcaauaucccuaguagaaucucuauuuacuggacuauaguuaaaccaggugauaucuugcugauuaacuccaccggcaaucuaaucgcgccgaggggguacuucaagauacggagcggaaaaucgucuauuaugcgcuccgacgcacccaucggcaaguguaagucagaaugcaucacaccuaacgguaguauuccaaaugacaaacccuuucagaacgugaaucgaaucaccuauggggccuguccuagauacgucaagcagagcacgcucaaacuggcuacuggaaugaggaacgugccagagaagcaaacacggggcauuuucggcgccauagcaggguuuaucgaaaauggaugggaggguaugauggauggcugguauggguuccgucaccagaacuccgagggacgcggccaggcugccgaccuuaaaucuacccaagcggccauugaucagaucaaugguaagcugaacagauugaucgggaaaacuaaugaaaaguuccaccagauugagaaggaauuuagcgagguggaaggcaggauacaggaccucgagaaauacgucgaggauacaaagaucgaccuguggucauauaacgcagaauuacugguugcucucgagaaccaacauaccauugaucuuacggacagugaaaugaauaaacuguucgagaagaccaaaaagcaguugcgggaaaacgccgaggauaugggaaauggcugcuuuaagaucuaccacaaaugugacaacgcuugcauuggguccauccgaaauggaacauaugaucaugacguguaccgcgacgaggcccuaaacaauagauuccagauaaaggguguagaacugaaaagcggcuacaaggauuggauccucuggauuucuuuugcaaucucaugcuuccugcuuuguguggcccuguugggguuuauuaugugggcuugccagaaaggaaacaucagguguaauauaugcauuuga

SEQ ID NO: 133625 - RNA, 1701 nt, Artificial Sequence; identical to SEQ ID NO: 133522
  derived and/or modified sequence opt3 from hemagglutinin__InfluenzaA__AHL98307

SEQ ID NO: 133626 - RNA, 1701 nt, Artificial Sequence; identical to SEQ ID NO: 131884
  derived and/or modified sequence opt3 from hemagglutinin__InfluenzaA__AHL98319

SEQ ID NO: 133627 - RNA, 1701 nt, Artificial Sequence; identical to SEQ ID NO: 131884
  derived and/or modified sequence opt3 from hemagglutinin__InfluenzaA__AHL98331

SEQ ID NO: 133628 - RNA, 1701 nt, Artificial Sequence; identical to SEQ ID NO: 132010
  derived and/or modified sequence opt3 from hemagglutinin__InfluenzaA__AHL98343

SEQ ID NO: 133629 - RNA, 1701 nt, Artificial Sequence; identical to SEQ ID NO: 133522
  derived and/or modified sequence opt3 from hemagglutinin__InfluenzaA__AHL98354

SEQ ID NO: 133630 - RNA, 1701 nt, Artificial Sequence; identical to SEQ ID NO: 131874
  derived and/or modified sequence opt3 from hemagglutinin__InfluenzaA__AHL98366

SEQ ID NO: 133631 - RNA, 1701 nt, Artificial Sequence; identical to SEQ ID NO: 131874
  derived and/or modified sequence opt3 from hemagglutinin__InfluenzaA__AHL98378

SEQ ID NO: 133632 - RNA, 1701 nt, Artificial Sequence; identical to SEQ ID NO: 131874
  derived and/or modified sequence opt3 from hemagglutinin__InfluenzaA__AHL98390

SEQ ID NO: 133633 - RNA, 1701 nt, Artificial Sequence; identical to SEQ ID NO: 131874
  derived and/or modified sequence opt3 from hemagglutinin__InfluenzaA__AHL98402

SEQ ID NO: 133634 - RNA, 1701 nt, Artificial Sequence; identical to SEQ ID NO: 131884
  derived and/or modified sequence opt3 from hemagglutinin__InfluenzaA__AHL98414

SEQ ID NO: 133635 - RNA, 1701 nt, Artificial Sequence
  derived and/or modified sequence opt3 from hemagglutinin__InfluenzaA__AHL98426
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauaacuccuuuuucucacgucugaauuggcucacgcauaguaacuuuaaguauccagcauuaaacgugacuaugcccaauaacgagcaguucgacaagcuguacaucuggggaguccaccauccuggcaccgauaaagaccagauuuuucuuuaugcccagagcucuggcagaaucacaguguccacuaagaggucacaacaggcuguaauaccaaauauugggagccggccccgcaucagaaacauuccuaguaggaucucuaucuacuggaccauuguuaaaccaggagauauauugcugaucaauuccacagguaaccuaauugccccgcggggcuacuucaagauccgcagcgggaaaucgucuauaaugcgauccgacgcgcccauuggaaaguguaagucagaaugcaucaccccuaauggcaguaucccaaacgacaaacccuuucagaaugugaacagaauuacguauggugcauguccuagguacgucaagcagagcacucucaaacuggccacagggaugcggaaugugccagagaagcaaacccguggaaucuucggcgcuauugccggcuuuauagaaaacgggugggagggaaugauggaugguugguauggcuuccgccaccaaaauuccgaggggagaggacaggcagcugaccuuaaaucuacucaggccgcgaucgaucagauuaacggcaagcugaauagguugaucgguaaaacaaacgaaaaguuccaccagaucgagaaggaauuuagcgagguggaagggcggauucaggaccucgagaaauacgucgaggauaccaagauagaccuguggucauauaacgccgaauuacugguugcacucgagaaucaacauacgaucgaucuuaccgacagugaaaugaacaaacuguucgagaagacuaaaaagcaguugcgagaaaaugcugaggauaugggcaacggaugcuuuaagauuuaccacaaaugugacaaugccugcaucggcuccauucgcaacgggacauaugaucaugacguguacagagacgaggcucuaaauaacagguuccagguaaagggaguggaacugaaaagcgguuacaaggauuggauccucuggauaucuuuugccaucucaugcuuccugcuuugugucgcacuguugggcuuuauuaugugggccugccagaaagggaauauccgguguaacauuugcaucuga

SEQ ID NO: 133636 - RNA, 1701 nt, Artificial Sequence; identical to SEQ ID NO: 132056
  derived and/or modified sequence opt3 from hemagglutinin__InfluenzaA__AHL98438

SEQ ID NO: 133637 - RNA, 1701 nt, Artificial Sequence; identical to SEQ ID NO: 132056
  derived and/or modified sequence opt3 from hemagglutinin__InfluenzaA__AHL98449

SEQ ID NO: 133638 - RNA, 1701 nt, Artificial Sequence
  derived and/or modified sequence opt3 from hemagglutinin__InfluenzaA__AHL98471
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaaaaguuugagauuuucccgaagacaagcuccuggcccaaccacgacucaaauaaaggugucaccgccgcuuguccucaugcaggggccaagaguuuuuauaaaaaccugaucuggcucgugaagaaaggaaauagcuacccaaaguuacgggaaucuuauauaaacgauaagggcaaagagguacugguucuuuggggcauccaccaccccuccacgacugcugaccaacagucauuguaccagaaugccgaugcguacguguucgucgggaccagccgcuauaguaagaaauuuaagccugagauugcaauccgaccaaaagugcgugaccaggaaggaagaaugaacuacuauuggacacugauugagcccggugauaagaucacuuucgaagccaccggcaaccuaguggucccuagguacgcuuuugccauggagcggaaugcagggucuggaauaauuaucuccgacacaccaguucaugauugcaacaccacgugucaaacuccggaaggcgcuauuaauacaagccuccccuuccagaacauccacccuaucaccauugguaaaugcccaaaguaugugaagucgacuaaacugcgccuugccacagggcugagaaauguacccucuauacaguccaggggauuguuuggcgcgaucgccggcuucauugaagggggauggaccgguaugguggacggcugguacggguaucaucaccagaacgagcaaggaucaggcuacgcagcugaccucaagaguacgcagaaugccaucgauaaaauaaccaacaaggucaauagcgugauugagaaaaugaacacacaguuuacugcuguugguaaggaguucaaucaccuggaaaagcggaucgagaacuuaaauaaaaagguggacgauggguuccuggacaucuggaccuacaacgccgaacuccuuguccuguuggagaaugagcgcacacuagauuaucaugacuccaacgugaaaaaccuguacgaaaagguacgaaaucagcucaaaaacaaugcaaaggagauuggcaacggauguuuugaguucuaucacaagugcgauaauacuuguauggagucuguuaaaaacggcaccuacgacuauccuaaguacagcgaagaggccaaacugaauagagagaagaucgauggggugaaacuugaaucaacaaggauuuaucaaauacuggcuaucuacaguaccgucgcguccagcuuggugcucgucgugucucugggagcaauuucauuuuggaugugcaguaacgguagcuuacagugccggaucuguaucuga

SEQ ID NO: 133639 - RNA, 1701 nt, Artificial Sequence; identical to SEQ ID NO: 132010
  derived and/or modified sequence opt3 from hemagglutinin__InfluenzaA__AHL98482

SEQ ID NO: 133640 - RNA, 1701 nt, Artificial Sequence; identical to SEQ ID NO: 131851
  derived and/or modified sequence opt3 from hemagglutinin__InfluenzaA__AHL98494

SEQ ID NO: 133641 - RNA, 1701 nt, Artificial Sequence; identical to SEQ ID NO: 132010
  derived and/or modified sequence opt3 from hemagglutinin__InfluenzaA__AHL98506

SEQ ID NO: 133642 - RNA, 1701 nt, Artificial Sequence; identical to SEQ ID NO: 132010
  derived and/or modified sequence opt3 from hemagglutinin__InfluenzaA__AHL98518

SEQ ID NO: 133643 - RNA, 1701 nt, Artificial Sequence; identical to SEQ ID NO: 131851
  derived and/or modified sequence opt3 from hemagglutinin__InfluenzaA__AHL98530

SEQ ID NO: 133644 - RNA, 1701 nt, Artificial Sequence; identical to SEQ ID NO: 132010
  derived and/or modified sequence opt3 from hemagglutinin__InfluenzaA__AHL98542

SEQ ID NO: 133645 - RNA, 1701 nt, Artificial Sequence; identical to SEQ ID NO: 132010
  derived and/or modified sequence opt3 from hemagglutinin__InfluenzaA__AHL98554

SEQ ID NO: 133646 - RNA, 1701 nt, Artificial Sequence; identical to SEQ ID NO: 131884
  derived and/or modified sequence opt3 from hemagglutinin__InfluenzaA__AHL98566

SEQ ID NO: 133647 - RNA, 1701 nt, Artificial Sequence; identical to SEQ ID NO: 131884
  derived and/or modified sequence opt3 from hemagglutinin__InfluenzaA__AHL98578

SEQ ID NO: 133648 - RNA, 1701 nt, Artificial Sequence; identical to SEQ ID NO: 132010
  derived and/or modified sequence opt3 from hemagglutinin__InfluenzaA__AHL98590

SEQ ID NO: 133649 - RNA, 1701 nt, Artificial Sequence; identical to SEQ ID NO: 131874
  derived and/or modified sequence opt3 from hemagglutinin__InfluenzaA__AHL98602

SEQ ID NO: 133650 - RNA, 1701 nt, Artificial Sequence; identical to SEQ ID NO: 131851
  derived and/or modified sequence opt3 from hemagglutinin__InfluenzaA__AHL98614

SEQ ID NO: 133651 - RNA, 1701 nt, Artificial Sequence
  derived and/or modified sequence opt3 from hemagglutinin__InfluenzaA__AHL98626
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgaccaaaucgaagugacuaaugcgaccgagcugguacagucuucaaguacaggugaaauuugcaacagcccacaccagauccuagauggcgagaauuguacccucauagacgcucugcuuggggauccgcagugcgacggauuucaaaacaagagaugggaucuguucguggaaagguccaaagcccauucuaauuguuaucccuacgacgucccugauuaugcaucguugcggucacucguggccagcaguggcacucuggaguuuaacaaugaguccuucaacuggacagguguuacccagaaugggacgucuagcgcuugcauccgccgauccaacaauucauuuuucagucgucugaacuggcucacucacuuaaauuuuaaguacccagcacugaacgugaccaugcccaacaaugaacaguucgacaaacuuuauauuuggggaguccaucacccuggcacagauaaggaccagaucuuuuuguacgcccaagcuagcggcagaauuacugugucuaccaagaggucccagcaggccguaaucccaaacauagggucacggccccgcguuagaaauauuccuagcagggugaguaucuauuggacaauugucaaaccaggagauauccugcuaaucaacucuaccgguaaucucauugcgccgcggggcuacuucaagauacgcuccgggaaaagcucgaucaugcgaucugacgcacccauuggaaaguguaacuccgccugcaucacgccuaauggcucaauaccaaacgacaaacccuuucagaaugugaacagaauuacuuacggugcuuguccuagguaugugaagcaaaauacacugaagcuggccaccgggaugcggaacgucccagagaaacagacucguggaaucuucggcgcaaucgcuggcuuuauugaaaaugggugggagggaaugguugaugguugguacggcuuccgccaccagaacagugaggggagaggacaagccgcggaccuuaagagcacacaggccgcaaucgaucagauuaauggcaaauugaacaggcucauagguaagaccaacgaaaaauuccaucagaucgagaaggaauuuuccgagguggaagggcggauucaagaccuggagaaauauguagaggauacgaagaucgacuuauggucuuacaaugcugaacugcucguggcccuugagaaccagcacaccaucgaucugacagacagcgaaaugaauaaguuguucgagaaaacuaagaaacagcuacgagaaaacgcugaggauaugggcaauggaugcuuuaagauuuaucauaaaugugacaacgccugcauaggcucaauccgcaaugggaccuacgaucacgacgucuauagagacgaggcacugaacaauagguuccagauuaagggaguggaacucaagagugguuacaaagauuggauccuguggauuuccuuugccaucagcugcuuccuucuguguguugcuuugcucggcuuuauaaugugggcgugccaaaaggggaacauccgguguaauauuugcaucuga

SEQ ID NO: 133652 - RNA, 1701 nt, Artificial Sequence; identical to SEQ ID NO: 131874
  derived and/or modified sequence opt3 from hemagglutinin__InfluenzaA__AHL98638

SEQ ID NO: 133653 - RNA, 1701 nt, Artificial Sequence; identical to SEQ ID NO: 131884
  derived and/or modified sequence opt3 from hemagglutinin__InfluenzaA__AHL98650

SEQ ID NO: 133654 - RNA, 1701 nt, Artificial Sequence
  derived and/or modified sequence opt3 from hemagglutinin__InfluenzaA__AHL98662
augaagaccaucauugcccugagcuacauacucugccuuguguucgcucagaaacugcccggcaacgacaauuccacagcaacuuuguguuuagggcaccaugccgucccuaacggaacgaugguuaagaccaucacaaaugauagaauugaggugacuaacgcgaccgaacugguacaaaauucuucaaucggugagauuugcgacaguccacaccagauccuagauggcgaaaacuguacacucauagacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauccgccgaagcaauaacuccuuuuucucacgucugaauuggcucacgcauaguaacuuuaaguauccagcauuaaacgugacuaugcccaauaacgagcaguucgacaagcuguacauuuggggaguccaccauccuggcaccgauaaagaccagaucuuucuuuaugcccagagcucuggcagaauuacaguguccacuaagaggucacaacaggcuguaaucccaaauauagggagccggccccgcauuagaaacaucccuaguaggauuucuaucuacuggaccaucguuaaaccaggagauauuuugcugauaaauuccacagguaaccuaaucgccccgcggggcuacuucaagauucgcagcgggaaaucgucuaucaugcgauccgacgcgcccauaggaaaguguaagucagaaugcauuaccccuaauggcaguaucccaaacgacaaacccuuucagaaugugaacagaaucacguauggugcauguccuagguacgucaagcagagcacucucaaacuggccacagggaugcggaaugugccagagaagcaaacccguggaauuuucggcgcuaucgccggcuuuauugaaaacgggugggagggaaugauggaugguugguauggcuuccgccaccaaaauuccgaggggagaggacaggcagcugaccuuaaaucuacucaggccgcgauagaucagaucaacggcaagcugaauagguugauugguaaaacaaacgaaaaguuccaccagaucgagaaggaauuuagcgagguggaagggcggauccaggaccucgagaaauacgucgaggauaccaagauugaccuguggucauauaacgccgaauuacugguugcacucgagaaucaacauacgauagaucuuaccgacagugaaaugaacaaacuguucgagaagacuaaaaagcaguugcgagaaaaugcugaggauaugggcaacggaugcuuuaagaucuaccacaaaugugacaaugccugcauuggcuccauccgcaacgggacauaugaucaugacguguacagagacgaggcucuaaauaacagguuccagauuaagggaguagaacugaaaagcgguuacaaggauuggauccucuggauaucuuuugccaucucaugcuuccugcuuuguguggcacuguugggcuuuauuaugugggccugccagaaagggaauauccgguguaacauuugcaucuga

SEQ ID NO: 133655 - RNA, 1701 nt, Artificial Sequence; identical to SEQ ID NO: 133522
  derived and/or modified sequence opt3 from hemagglutinin__InfluenzaA__AHL98674

SEQ ID NO: 133656 - RNA, 1701 nt, Artificial Sequence; identical to SEQ ID NO: 131874
  derived and/or modified sequence opt3 from hemagglutinin__InfluenzaA__AHL98686

SEQ ID NO: 133657 - RNA, 1701 nt, Artificial Sequence; identical to SEQ ID NO: 132010
  derived and/or modified sequence opt3 from hemagglutinin__InfluenzaA__AHL98699

SEQ ID NO: 133658 - RNA, 1701 nt, Artificial Sequence; identical to SEQ ID NO: 132139
  derived and/or modified sequence opt3 from hemagglutinin__InfluenzaA__AHL98711

SEQ ID NO: 133659 - RNA, 1701 nt, Artificial Sequence; identical to SEQ ID NO: 132483
  derived and/or modified sequence opt3 from hemagglutinin__InfluenzaA__AHL98722

SEQ ID NO: 133660 - RNA, 1701 nt, Artificial Sequence; identical to SEQ ID NO: 131884
  derived and/or modified sequence opt3 from hemagglutinin__InfluenzaA__AHL98734

SEQ ID NO: 133661 - RNA, 1701 nt, Artificial Sequence; identical to SEQ ID NO: 132010
  derived and/or modified sequence opt3 from hemagglutinin__InfluenzaA__AHL98746

SEQ ID NO: 133662 - RNA, 1701 nt, Artificial Sequence; identical to SEQ ID NO: 131884
  derived and/or modified sequence opt3 from hemagglutinin__InfluenzaA__AHL98758

SEQ ID NO: 133663 - RNA, 1701 nt, Artificial Sequence; identical to SEQ ID NO: 131874
  derived and/or modified sequence opt3 from hemagglutinin__InfluenzaA__AHL98770

SEQ ID NO: 133664 - RNA, 1701 nt, Artificial Sequence; identical to SEQ ID NO: 132013
  derived and/or modified sequence opt3 from hemagglutinin__InfluenzaA__AHL98782

SEQ ID NO: 133665 - RNA, 1701 nt, Artificial Sequence
  derived and/or modified sequence opt3 from hemagglutinin__InfluenzaA__AHL98794
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaagugucgaucagaaugcaucacaccuaacgguaguaucccaaaugacaagcccuuucagaacgugaauagaauuaccuauggggccuguccuagguacgucaaacagagcacgcugaaacuugcuacuggaaugcggaacgugccagagaagcaaacacguggcaucuucggcgccauugcaggguuuauagaaaauggaugggaggguaugguggauggcugguauggguuccgccaccagaacuccgagggaagaggccaggcugccgaccugaagucuacccaagcggccaucgaucagauuaaugguaaauugaacaggcucaucgggaagacuaaugaaaaauuccaccagaucgagaaggaauuuagcgaggucgaaggccggauucaggaccuggagaaguacguugaggauacaaaaauagacuuauggucauauaacgcagaacugcucguggcucuugagaaccaacauaccaucgaucugacggacagugaaaugaauaaguuguucgagaaaaccaagaaacagcuacgagaaaacgccgaggauaugggaaauggcugcuuuaagauuuaccacaagugugacaacgcuugcaucggguccauucgcaauggaacauaugaucaugacguauacagagacgaggcccugaacaauagguuccagaucaaagguguggaacucaagagcggcuacaaagauuggauacuguggaucucuuuugcaauuucaugcuuccuucugugugucgccuugcucggguuuaucaugugggcuugccagaagggaaacauucgguguaauaucugcauauga

SEQ ID NO: 133666 - RNA, 1701 nt, Artificial Sequence
  derived and/or modified sequence opt3 from hemagglutinin__InfluenzaA__AHL98806
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaacuuuacaucuggggcguccaccauccuggcacugauaaagaccagaucuuuuuguaugcucagagcucugggcguauuaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaaacugcgaucgaucagauuaaugguaaguugaacagacucaucgggaaaacaaaugaaaaguuccaccagaucgagaaggaauuuagcgaggucgaaggcaggauucaggaccuggagaaauacguugaggauaccaagauagacuuauggucauauaacgccgaacugcucguggcacuugagaaccaacauacgaucgaucugaccgacagugaaaugaauaaauuguucgagaagacaaagaagcagcuacgggaaaacgcugaggauaugggaaauggcugcuuuaagauuuaccacaaaugugacaacgccugcaucggguccauucgaaauggaacuuaugaucaugacguauaccgcgacgaggcucugaacaauagauuccagaucaaggguguggaacucaaaagcggcuacaaggauuggauacuguggaucucuuuugccauuucaugcuuccuucugugugucgcauugcucggguuuaucaugugggccugccagaaaggaaacauuagguguaauaucugcauauga

SEQ ID NO: 133667 - RNA, 1701 nt, Artificial Sequence; identical to SEQ ID NO: 131874
  derived and/or modified sequence opt3 from hemagglutinin__InfluenzaA__AHL98818

SEQ ID NO: 133668 - RNA, 1701 nt, Artificial Sequence; identical to SEQ ID NO: 131884
  derived and/or modified sequence opt3 from hemagglutinin__InfluenzaA__AHL98830

SEQ ID NO: 133669 - RNA, 1701 nt, Artificial Sequence; identical to SEQ ID NO: 131874
  derived and/or modified sequence opt3 from hemagglutinin__InfluenzaA__AHL98842

SEQ ID NO: 133670 - RNA, 1701 nt, Artificial Sequence; identical to SEQ ID NO: 131874
  derived and/or modified sequence opt3 from hemagglutinin__InfluenzaA__AHL98854

SEQ ID NO: 133671 - RNA, 1701 nt, Artificial Sequence
  derived and/or modified sequence opt3 from hemagglutinin__InfluenzaA__AHL98878
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugauagaaucgaggugaccaacgccacagaacugguacaaaauucuucaauuggugagaucugcgacaguccacaccagauacuagauggcgaaaacuguacccucaucgacgcgcugcuuggggauccgcagugcgacggauuucagaauaaaaagugggaucuguucguggagaggagcaaggcuuauuccaacuguuaccccuaugacgucccugauuacgccucuuugcggucgcucguggcaucaagcggcacucuggaauuuaauaacgagaguuucaauuggacagguguuacccaaaacgggacguccucugccugcauucgccgaagcaauuccucauuuuucagucgucugaacuggcucacucauuuaaauuuuaaguauccagcucugaacgugaccaugcccaacaaugagcaguucgacaaacuuuacaucuggggaguccaccauccuggcacagauaaagaccagaucuuuuuguaugcacagagcucuggcagaauuacuguguccaccaagaggucacaacaggccguaauaccaaacauugggagccggccccgcaucagaaauauuccuaguaggaucucuaucuacuggacaauuguuaaaccaggagauauacugcuaaucaacuccaccgguaaucucauugcuccgcggggcuacuucaagauccgcagcgggaaaucgucuauaaugcgauccgacgcccccauuggaaaguguaagucagaaugcaucacgccuaacggcaguaucccaaaugacaaacccuuucagaacgugaauagaauuacuuauggugcguguccuagguacgucaagcagagcacacugaaacuugcaaccgggaugcggaacgugccagagaagcaaacucguggaaucuucggcgccauugcuggcuuuauagaaaaugggugggagggaaugguggaugguugguauggcuuccgccaccagaacuccgaggggagaggacaggccgcagaccugaaaucuacacaagcugccaucgaucagauuaauggcaaguugaacaggcucaucgguaaaaccaaugaaaaguuccaccagaucgagaaggaauuuagcgaggucgaagggcggauucaggaccuggagaaauacguugaggauacgaagauagacuuauggucauauaacgcggaacugcucguggcccuugagaaccaacauaccaucgaucugacagacagugaaaugaauaaauuguucgagaagacuaaaaagcagcuacgagaaaacgcagaggauaugggcaauggaugcuuuaagauuuaccacaaaugugacaacgcuugcaucggcuccauucgcaaugggaccuaugaucauaacguauacagagacgaggcccugaauaacagguuccagaucaagggaguggaacucaaaagcgguuacaaggacuggauacuguggaucucuuuugcuauuucaugcuuccuucugugugucgccuugcucggcuuuaucaugugggcaugccagaaagggaauauucgguguaacaucugcauauga

SEQ ID NO: 133672 - RNA, 1701 nt, Artificial Sequence
  derived and/or modified sequence opt3 from hemagglutinin__InfluenzaA__AHL98890
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggauucaggaccuggagaaauacguugaggauacaaagauagacuuauggucauauaacgcagaacugcucguggcucuugagaaccaacauaccaucgaucugacggacagugaaaugaauaaauuguucgagaagaccaaaaagcagcuacgggaaaacgccgaggauaugggaaauggcugcuuuaagauuuaccacaaaugugacaacgcuugcaucggguccauucgaaauggaacauaugaucaugacguauaccgcgacgaggcccugaacaauagauuccagaucaaggguguggaacucaaaagcggcuacaaggauuggauacuguggaucucuuuugcaauuucaugccuucuguugugugucgcccuccugggguucaucaugugggcuugccagaaaggaaacauuagguguaauaucugcauauga

SEQ ID NO: 133673 - RNA, 1701 nt, Artificial Sequence
  derived and/or modified sequence opt3 from hemagglutinin__InfluenzaA__AHL98902
augaagaccaucauugcccugagcuacauacucugccuuguguucgcucagaaacugcccggcaacgacaauuccacagcaacuuuguguuuagggcaccaugccgucccuaacggaacgguugugaagaccaucacaaaugauagaauugagguaacuaacgcgaccgaacuggugcaaaauucuucaaucggugagauuugcgacaguccacaccagauccuagauggcgaaaacuguacacucauagacgcucugcuuggggauccgcagugcgacggauuucagaauaaaaagugggaucuguucgucgagaggagcaaagccuauuccaacuguuaccccuaugacgugccugauuacgcaucuuugcggucgcucguugccucaagcggcacccuggaauuuaauaacgagaguuucaauugggcuggugugacucaaaacgggacauccucugcaugcauccgcggaagcaauuccucauuuuucagucgacugaacuggcucacccauuuaaauuuuaaguauccagcccugaacgucacgaugcccaacaaugagcaguucgacaaacuuuacauuuggggcgugcaccauccuggcacugauaaggaccagaucuuuuuguaugcucagagcucugggcguauuaccguauccacaaagagaucacaacaggccguuaucccaaacauaggaagcaggccccggauucgcaauaucccuaguagaauuucuaucuacuggacuaucgugaaaccaggugauauucugcuaauaaacuccaccggcaaucucaucgcgccgaggggguacuucaagauucggagcggaaaaucgucuaucaugcgcuccgacgcacccauaggcaaguguaagucagaaugcauuacaccuaacgguaguaucccaaaugacaaacccuuucagaacgucaaucgaaucaccuauggggccuguccuagauacgugaagcagagcacgcugaaacuugcuacuggaaugaggaacgugccagagaagcaaacacggggcauuuucggcgccaucgcaggguuuauugaaaauggaugggaggguauggucgauggcugguauggguuccgucaccagaacuccgagggacgcggccaggcugccgaccugaaaucuacccaagcggccauagaucagaucaaugguaaguugaacagacucauugggaaaacuaaugaaaaguuccaccagaucgagaaggaauuuagcgagguugaaggcaggauccaggaccuggagaaauacguggaggauacaaagauugacuuauggucauauaacgcagaacugcucguagcucuugagaaccaacauaccauagaucugacggacagugaaaugaauaaauuguucgagaagaccaaaaagcagcuacgggaaaacgccgaggauaugggaaauggcugcuuuaagaucuaccacaaaugugacaacgcuugcauuggguccauccgaaauggaacauaugaucaugacguguaccgcgacgaggcccugaacaauagauuccagauuaagggugucgaacucaaaagcggcuacaaggauuggauccuguggauaucuuuugcaaucucaugcuuccuucuguguguggccuugcucggguuuauuaugugggcuugccagaaaggaaacaucagguguaauauuugcaucuga

SEQ ID NO: 133674 - RNA, 1701 nt, Artificial Sequence; identical to SEQ ID NO: 131884
  derived and/or modified sequence opt3 from hemagglutinin__InfluenzaA__AHL98913

SEQ ID NO: 133675 - RNA, 1701 nt, Artificial Sequence; identical to SEQ ID NO: 131874
  derived and/or modified sequence opt3 from hemagglutinin__InfluenzaA__AHL98925

SEQ ID NO: 133676 - RNA, 1701 nt, Artificial Sequence; identical to SEQ ID NO: 132013
  derived and/or modified sequence opt3 from hemagglutinin__InfluenzaA__AHL98937

SEQ ID NO: 133677 - RNA, 1701 nt, Artificial Sequence; identical to SEQ ID NO: 132010
  derived and/or modified sequence opt3 from hemagglutinin__InfluenzaA__AHL98961

SEQ ID NO: 133678 - RNA, 1701 nt, Artificial Sequence
  derived and/or modified sequence opt3 from hemagglutinin__InfluenzaA__AHL98973
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaguuccaaacauagggagccggccccgcauuagaaauaucccuaguaggauuucuaucuacuggaccaucgugaaaccaggagauauucugcuaauaaacuccacagguaaucucaucgccccgcggggcuacuucaagauucgcagcgggaaaucgucuaucaugcgauccgacgcgcccauaggaaaguguaagucagaaugcauuaccccuaacggcaguaucccaaaugacaaacccuuucagaacgucaauagaaucacguauggugcauguccuagguacgugaagcagagcacucugaaacuugccacagggaugcggaacgugccagagaagcaaacccguggaauuuucggcgcuaucgccggcuuuauugaaaaugggugggagggaauggucgaugguugguauggcuuccgccaccagaacuccgaggggagaggacaggcagcugaccugaaaucuacucaagccgcgauagaucagaucaauggcaaguugaacaggcucauugguaaaacaaaugaaaaguuccaccagaucgagaaggaauuuagcgagguugaagggcggauccaggaccuggagaaauacguggaggauaccaagauugacuuauggucauauaacgccgaacugcucguagcacuugagaaccaacauacgauagaucugaccgacagugaaaugaauaaauuguucgagaagacaaagaagcagcuacgagaaaacgcugaggauaugggcaauggaugcuuuaagaucuaccacaaaugugacaacgccugcauuggcuccauccgcaaugggacuuaugaucaugacguguacagagacgaggcucugaacaauagguuccagauuaagggagucgaacucaaaagcgguuacaaggauuggauccuguggauaucuuuugccaugucaugcuuccuucuguguguggcauugcucggcuuuaucaugugggccugccagaaagggaacauucgguguaauaucugcauuuga

SEQ ID NO: 133679 - RNA, 1701 nt, Artificial Sequence
  derived and/or modified sequence opt3 from hemagglutinin__InfluenzaA__AHL98985
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacaaucauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauugggcugguguuacucaaaacgggacauccucugcaugcauccgcggaagcaauuccucauuuuucagucgacugaacuggcugacccaucucaauuuuaaguauccagccuuaaacgugacgaugcccaacaaugagcaguucgacaagcuguacauuuggggcguccaccauccuggcacugauaaagaccagaucuuucuuuaugcucagagcucugggcguauaaccguguccacaaagagaucacaacaggccguaauuccaaacaucggaagcaggccccggauucgcaauaucccuaguagaaucucuauuuacuggacuauaguuaaaccaggugauaucuugcugauuaacuccaccggcaaucuaaucgcgccgaggggguacuucaagauacggagcggaaaaucgucuauuaugcgcuccgacgcacccaucggcaaguguaagucagaaugcaucacaccuaacgguaguauuccaaaugacaaacccuuucagaacgugaaucgaaucaccuauggggccuguccuagauacgucaagcagagcacgcucaaacuggcuacuggaaugaggaacgugccagagaagcaaacacggggcauuuucggcgccauagcaggguuuaucgaaaauggaugggaggguaugguggauggcugguauggguuccgucaccagaacuccgagggacgcggccaggcugccgaccuuaaaucuacccaagcggccauugaucagaucaaugguaagcugaacagauugaucgggaaaacuaaugaaaaguuccaccagauugagaaggaauuuagcgaggucgaaggcaggauacaggaccucgagaaauacguugaggauacaaagaucgaccuguggucauauaacgcagaauuacugguggcucucgagaaccaacauaccauugaucuuacggacagugaaaugaauaaacuguucgagaagaccaaaaagcaguugcgggaaaacgccgaggauaugggaaauggcugcuuuaagaucuaccacaaaugugacaacgcuugcauuggguccauccgaaauggaacauaugaucaugacguauaccgcgacgaggcccuaaacaauagauuccagauaaaggguguggaacugaaaagcggcuacaaggauuggauccucuggauuucuuuugcaaucucaugcuuccugcuuugugucgcccuguugggguuuauuaugugggcuugccagaaaggaaacaucagguguaauauaugcauuuga

SEQ ID NO: 133680 - RNA, 1701 nt, Artificial Sequence; identical to SEQ ID NO: 132010
  derived and/or modified sequence opt3 from hemagglutinin__InfluenzaA__AHL98997

SEQ ID NO: 133681 - RNA, 1701 nt, Artificial Sequence; identical to SEQ ID NO: 131874
  derived and/or modified sequence opt3 from hemagglutinin__InfluenzaA__AHL99009

SEQ ID NO: 133682 - RNA, 1701 nt, Artificial Sequence; identical to SEQ ID NO: 131884
  derived and/or modified sequence opt3 from hemagglutinin__InfluenzaA__AHL99021

SEQ ID NO: 133683 - RNA, 1701 nt, Artificial Sequence
  derived and/or modified sequence opt3 from hemagglutinin__InfluenzaA__AHL99045
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcaauuccucauuuuucagucgucugaacuggcugacgcaucucaauuuuaaguauccagcauuaaacgugacuaugcccaacaaugagcaguucgacaagcuguacauuuggggaguccaccauccuggcaccgauaaagaccagaucuuucuuuaugcccagagcucuggcagaauaacaguguccacuaagaggucacaacaggcuguaauuccaaacaucgggagccggccccgcauuagaaauaucccuaguaggaucucuauuuacuggaccauaguuaaaccaggagauaucuugcugauuaacuccacagguaaucuaaucgccccgcggggcuacuucaagauacgcagcgggaaaucgucuauuaugcgauccgacgcgcccaucggaaaguguaagucagaaugcaucaccccuaacggcaguauuccaaaugacaaacccuuucagaacgugaauagaaucacguaugguccuuguccaagguacgucaagcagagcacucucaaacuggcaacagggaugcggaacgugcccgagaagcaaacccguggaauuuucggcgccauagcuggcuuuaucgaaaaugggugggagggaaugguggaugguugguauggcuuccgccaccagaacuccgaggggagaggacaggccgcagaccuuaaaucuacucaagcugccauugaucagaucaauggcaagcugaacagguugaucgguaaaacaaaugaaaaguuccaccagauugagaaggaauuuagcgaggucgaagggcggauacaggaccucgagaaauacguugaggauaccaagaucgaccuguggucauauaacgcggaauuacugguggcccucgagaaccaacauacgauugaucuuaccgacagugaaaugaauaaacuguucgagaagacuaaaaagcaguugcgagaaaacgcagaggauaugggcaauggaugcuuuaagaucuaccacaaaugugacaacgcuugcauuggcuccauccgcaaugggacauaugaucaugacguauacagagacgaggcccuaaacaauagguuccagauaaagggaguggaacugaaaagcgguuacaaggauuggauccucuggauuucuuuugcuaucucaugcuuccugcuuugugucgcccuguugggcuuuauuaugugggcaugccagaaagggaacauccgguguaauauaugcauuuga

SEQ ID NO: 133684 - RNA, 1701 nt, Artificial Sequence
  derived and/or modified sequence opt3 from hemagglutinin__InfluenzaA__AHL99057
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauaaucgauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauugggcugguguuacucaaaacgggacauccucugcaugcauccgcggaagcaauuccucauuuuucagucgacugaacuggcugacccaucucaauuuuaaguauccagccuuaaacgugacgaugcccaacaaugagcaguucgacaagcuguacauuuggggcguccaccauccuggcacugauaaagaccagaucuuucuuuaugcucagagcucugggcguauaaccguguccacaaagagaucacaacaggccguaauuccaaacaucggaagcaggccccggauucgcaauaucccuaguagaaucucuauuuacuggacuauaguuaaaccaggugauaucuugcugauuaacuccaccggcaaucuaaucgcgccgaggggguacuucaagauacggagcggaaaaucgucuauuaugcgcuccgacgcacccaucggcaaguguaagucagaaugcaucacaccuaacgguaguauuccaaaugacaaacccuuucagaacgugaaucgaaucaccuauggggccuguccuagauacgucaagcagagcacgcucaaacuggcuacuggaaugaggaacgugccagagaagcaaacacggggcauuuucggcgccauagcaggguuuaucgaaaauggaugggaggguaugguggauggcugguauggguuccgucaccagaacuccgagggacgcggccaggcugccgaccuuaaaucuacccaagcggccauugaucagaucaaugguaagcugaacagauugaucgggaaaacuaaugaaaaguuccaccagauugagaaggaauuuagcgaggucgaaggcaggauacaggaccucgagaaauacguugaggauacaaagaucgaccuguggucauauaacgcagaauuacugguggcucucgagaaccaacauaccauugaucuuacggacagugaaaugaauaaacuguucgagaagaccaaaaagcaguugcgggaaaacgccgaggauaugggaaauggcugcuuuaagaucuaccacaaaugugacaacgcuugcauuggguccauccgaaauggaacauaugaucaugacguauaccgcgacgaggcccuaaacaauagauuccagauaaaggguguggaacugaaaagcggcuacaaggauuggauccucuggauuucuuuugcaaucucaugcuuccugcuuugugucgcccuguugggguuuauuaugugggcuugccagaaaggaaacaucagguguaauauaugcauuuga

SEQ ID NO: 133685 - RNA, 1701 nt, Artificial Sequence
  derived and/or modified sequence opt3 from hemagglutinin__InfluenzaA__AHL99069
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaacuuuacaucuggggcguccaccauccuggcacugauaaagaccagaucuuuuuguaugcucagagcucugggcguauuaccguguccacaaagagaucacaacaggccguaauaccaaacauuggaagcaggccccggauccgcaauauuccuaguagaaucucuaucuacuggacuauuguuaaaccaggugauacccugcuaauaaacuccacaggcaaucucaucgcgccgaggggguacuucaagauucggagcggaaaaucgucuaucaugcgcuccgacgcacccauaggcaaguguaagucagaaugcauuaccccuaacgguaguaucccaaaugacaaacccuuucagaacgugaaucgaaucacguauggggccuguccuagauacgucaagcagagcacucugaaacuugcuacaggaaugaggaacgugccagagaagcaaacccggggcauuuucggcgccaucgcaggguuuauugaaaauggaugggaggguaugguggauggcugguauggguuccgucaccagaacuccgagggacgcggccaggcugccgaccugaaaucuacucaagcggccauagaucagaucaaugguaaguugaacagacucauugggaaaacaaaugaaaaguuccaccagaucgagaaggaauuuagcgaggucgaaggcaggauccaggaccuggagaaauacguugaggauaccaagauugacuuauggucauauaacgcagaacugcucguggcucuugagaaccaacauacgauagaucugaccgacagugaaaugaauaaauuguucgagaagacaaagaagcagcuacgggaaaacgccgaggauaugggaaauggcugcuuuaagaucuaccacaaaugugacaacgcuugcauuggguccauccgaaauggaacuuaugaucauaacguauaccgcgacgaggcccugaauaacagauuccagauuaaggguguggaacucaaaagcggcuacaaggacuggauccuguggauaucuuuugcaaucucaugcuuccuucugugugucgccuugcucggguuuauuaugugggcuugccagaaaggaaauaucagguguaacauuugcaucuga

SEQ ID NO: 133686 - RNA, 1701 nt, Artificial Sequence
  derived and/or modified sequence opt3 from hemagglutinin__InfluenzaA__AHL99081
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcaggggacucugaaacuugccacaggaaugcggaacgugccagagaagcaaacccguggcaucuucggcgcuauugccggguuuauagaaaauggaugggaggguaugguggauggcugguauggguuccgccaccagaacagcgagggaagaggccaggcagcugaccugaaauccacucaagccgcgaucgaucagauuaaugguaaguugaacaggcucaucgggaaaacaaaugaaaaguuccaccagaucgagaaggaauuuucugaggucgaaggccggauucaggaccuggagaaauacguugaggauaccaagauagacuuauggagcuauaacgccgaacugcucguggcacuugagaaccaacauacgaucgaucugaccgacucagaaaugaauaaauuguucgagaagacaaagaagcagcuacgagaaaacgcugaggauaugggaaauggcugcuuuaagauuuaccacaaaugugacaacgccugcaucgggaguauucgcaauggaacuuaugaucauaacguauacagagacgaggcucugaauaacagguuccagaucaaggguguggaacucaaauccggcuacaaggacuggauacuguggaucagcuuugccauuucuugcuuccuucugugugucgcauugcucggguuuaucaugugggccugccagaaaggaaauauucgguguaacaucugcauauga

SEQ ID NO: 133687 - RNA, 1701 nt, Artificial Sequence
  derived and/or modified sequence opt3 from hemagglutinin__InfluenzaA__AHL99093
augaagaccaucauugcccugagcuacauacucugccuuaucuucgcucagaaacugcccggcaacgacaauuccacagcaacuuuguguuuagggcaccaugccgugccuaacggaacgauugucaagaccaucacaaaugauagaauugagguuacuaacgcgaccgaacuggugcaaaauucuucaaucggugagauaugcgacaguccacaccagauccuagauggcgaaaacuguacacucauugacgcucugcuuggggauccgcagugcgacggauuucagaauaaaaagugggaucuguucguagagaggagcaaagccuauuccaacuguuaccccuaugacgugccugauuacgcaucuuugcggucgcucgucgccucaagcggcacccuggaauuuaauaacgagaguuucaauuggacuggugugacacaaaacgggaccuccucugcuugcauccgccgaagcaauuccucauuuuucagucgucugaacuggcucacgcauuuaaauuuuaaguauccagcacugaacguuacuaugcccaacaaugagcaguucgacaaacuuuacauuuggggagugcaccauccuggcaccgauaaagaccagaucuuuuuguaugcccagagcucuggcagaauaacagucuccacuaagaggucacaacaggcugugauuccaaacaucgggagccggccccgcauuagaaauaucccuaguaggaucucuauuuacuggaccauaguaaaaccaggagauauccugcuaauuaacuccacagguaaucucaucgccccgcggggcuacuucaagauacgcagcgggaaaucgucuauuaugcgauccgacgcgcccaucggaaaguguaagucagaaugcaucaccccuaacggcaguauuccaaaugacaaacccuuucagaacguuaauagaaucacguauggugcauguccuagguacgugaagcagagcacucugaaacuugccacagggaugcggaacgucccagagaagcaaacccguggaauuuucggcgcuauagccggcuuuaucgaaaaugggugggagggaaugguggaugguugguauggcuuccgccaccagaacuccgaggggagaggacaggcagcugaccugaaaucuacucaagccgcgauugaucagaucaauggcaaguugaacaggcucaucgguaaaacaaaugaaaaguuccaccagauugagaaggaauuuagcgagguggaagggcggauacaggaccuggagaaauacgucgaggauaccaagaucgacuuauggucauauaacgccgaacugcucguugcacuugagaaccaacauacgauugaucugaccgacagugaaaugaauaaauuguucgagaagacaaagaagcagcuacgagaaaacgcugaggauaugggcaauggaugcuuuaagaucuaccacaaaugugacaacgccugcauuggcuccauccgcaaugggacuuaugaucauaacguguacagagacgaggcucugaauaacagguuccagauaaagggaguagaacucaaaagcgguuacaaggacuggauccuguggauuucuuuugccaucucaugcuuccuucuguguguggcauugcucggcuuuauuaugugggccugccagaaagggaauaucaaguguaacauaugcauuuga

SEQ ID NO: 133688 - RNA, 1701 nt, Artificial Sequence; identical to SEQ ID NO: 131874
  derived and/or modified sequence opt3 from hemagglutinin__InfluenzaA__AHL99117

SEQ ID NO: 133689 - RNA, 1701 nt, Artificial Sequence
  derived and/or modified sequence opt3 from hemagglutinin__InfluenzaA__AHL99129
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgaggucgaagggcggauucaggacauagagaaauacguugaggauaccaagaucgaccuguggucauauaacgccgaauuacugguggcacucgagaaccaacauacgauugaucuuaccgacagugaaaugaauaaacuguucgagaagacaaagaagcaguugcgagaaaacgcugaggauaugggcaauggaugcuuuaagaucuaccacaaaugugacaacgccugcauuggcuccauccgcaaugggacuuaugaucauaacguauacagagacgaggcucuaaauaacagguuccagauaaagggaguggaacugaaaagcgguuacaaggacuggauccucuggauuucuuuugccaucucaugcuuccugcuuugugucgcacuguugggcuuuauuaucugggccugccagaaagggaauauacgguguaacauuugcaucuga

SEQ ID NO: 133690 - RNA, 1701 nt, Artificial Sequence
  derived and/or modified sequence opt3 from hemagglutinin__InfluenzaA__AHL99141
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacccuggaauuuaauaacgagaguuucaauuggacugguguuacacagaacgggaccuccucugcuugcauucggcgcagcaauuccucauuuuucagucgacugaacuggcucacgcauuuagacuuuaaguauccagcacugaaugugacuaugcccaacaacgagcaguucgauaaacuuuacaucuggggaguccaccauccuggcaccgacaaagaucagaucuuuuuguaugcccaaagcucuggccguauuacaguguccacuaagagaucacagcaggcuguaauaccaaauauugggagcaggccccggauccgcaacauuccuaguagaaucucuaucuacuggaccauuguuaaaccaggagacauacugcuaaucaauuccacagguaaccucauugccccgaggggcuacuucaagauccggagcgggaaaucgucuauaaugcgcuccgacgcgcccauuggaaaguguaagucagaaugcaucaccccuaauggcaguaucccaaacgauaaacccuuucagaaugugaaccgaauuacguauggugcauguccuagauacgucaagcaaagcacucugaaacuugccacagggaugaggaaugugccagagaagcagacccggggaaucuucggcgcuauugccggcuuuauagaaaacgggugggagggaaugguggacgguugguauggcuuccgucaccaaaauuccgaggggcgcggacaggcagcugaucugaaaucuacucaggccgcgaucgaccagauuaacggcaaguugaauagacucaucgguaaaacaaacgaaaaguuccaccagaucgagaaggaauuuagcgaggucgaagggaggauucaagaucuggagaaauacguugaggacaccaagauagauuuauggucauauaaugccgaacugcucguggcacuugagaaccagcauacgaucgaccugaccgauagugaaaugaacaaauuguucgagaagacaaagaagcagcuacgggaaaaugcugaggacaugggcaacggaugcuuuaagauuuaccacaaaugugauaaugccugcaucggcuccauucgaaacgggacuuaugaccaugacguauaccgcgaugaggcucugaauaacagauuccagaucaagggaguggaacucaaaagcgguuacaaggacuggauacuguggaucucuuuugccauuucaugcuuccuucugugugucgcauugcucggcuuuaucaugugggccugccaaaaagggaauauuagguguaacaucugcauauga

SEQ ID NO: 133691 - RNA, 1701 nt, Artificial Sequence
  derived and/or modified sequence opt3 from hemagglutinin__InfluenzaA__AHL99153
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaacuuuacaucuggggcguccaccauccuggcacugauaaagaccagaucuuuuuguaugcucagagcucugggcguauuaccguguccacaaagagaucacaacaggccguaacuccaaacauaggaagcaggccccggauucgcgauaucccuaguagaauuucuaucuacuggaccaucguuaaaccaggugacauucugcuaauaaauuccacaggcaaccucaucgcgccgaggggguacuucaagauucggagcggaaaaucgucuaucaugcgcuccgacgcacccauaggcaaguguaagucagaaugcauuaccccuaaugguaguaucccaaacgauaaacccuuucagaaugugaaccgaaucacguauggggccuguccuagauacgucaagcagagcacucugaaacuugcuacaggaaugaggaaugugccagagaagcaaacccggggcauuuucggcgccaucgcaggguuuauugaaaacggaugggaggguaugauggacggcugguauggguuccgucaccaaaauuccgagggacgcggccaggcugccgaucugaaaucuacucaggcggccauagaccagaucaacgguaaguugaauagacucauugggaaaacaaacgaaaaguuccaccagaucgagaaggaauuuagcgagguggaaggcaggauccaggaucuggagaaauacgucgaggacaccaagauugauuuauggucauauaaugcagaacugcucguugcucuugagaaccaacauacgauagaccugaccgauagugaaaugaacaaauuguucgagaagacaaagaagcagcuacgggaaaaugccgaggacaugggaaacggcugcuuuaagaucuaccacaaaugugauaaugcuugcauuggguccauccgaaacggaacuuaugaccaugacguguaccgcgaugaggcccugaauaacagauuccagauuaaggguguagaacucaaaagcggcuacaaggacuggauccuguggauaucuuuugcaaucucaugcuuccuucuguguguggccuugcucggguuuauuaugugggcuugccagaaaggaaauaucagguguaacauuugcaucuga

SEQ ID NO: 133692 - RNA, 1701 nt, Artificial Sequence; identical to SEQ ID NO: 132013
  derived and/or modified sequence opt3 from hemagglutinin__InfluenzaA__AHL99165

SEQ ID NO: 133693 - RNA, 1701 nt, Artificial Sequence; identical to SEQ ID NO: 132498
  derived and/or modified sequence opt3 from hemagglutinin__InfluenzaA__AHL99177

SEQ ID NO: 133694 - RNA, 1701 nt, Artificial Sequence; identical to SEQ ID NO: 131874
  derived and/or modified sequence opt3 from hemagglutinin__InfluenzaA__AHL99189

SEQ ID NO: 133695 - RNA, 1701 nt, Artificial Sequence; identical to SEQ ID NO: 132010
  derived and/or modified sequence opt3 from hemagglutinin__InfluenzaA__AHL99225

SEQ ID NO: 133696 - RNA, 1701 nt, Artificial Sequence; identical to SEQ ID NO: 132483
  derived and/or modified sequence opt3 from hemagglutinin__InfluenzaA__AHL99237

SEQ ID NO: 133697 - RNA, 1701 nt, Artificial Sequence; identical to SEQ ID NO: 131884
  derived and/or modified sequence opt3 from hemagglutinin__InfluenzaA__AHL99249

SEQ ID NO: 133698 - RNA, 1701 nt, Artificial Sequence; identical to SEQ ID NO: 131874
  derived and/or modified sequence opt3 from hemagglutinin__InfluenzaA__AHL99261

SEQ ID NO: 133699 - RNA, 1701 nt, Artificial Sequence; identical to SEQ ID NO: 132013
  derived and/or modified sequence opt3 from hemagglutinin__InfluenzaA__AHL99273

SEQ ID NO: 133700 - RNA, 1701 nt, Artificial Sequence
  derived and/or modified sequence opt3 from hemagglutinin__InfluenzaA__AHL99285
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccagagcgggaaaucgucuauaaugcgcuccgacgcgcccauuggaaaguguaagucagaaugcaucaccccuaacggcaguaucccaaaugacaaacccuuucagaacgugaaucgaauuacguauggugcauguccuagauacgucaagcaaagcacucugaaacuugccacagggaugaggaacgugccagagaagcagacccggggaaucuucggcgcuauugccggcuuuauagaaaaugggugggagggaaugguggaugguugguauggcuuccgucaccagaacuccgaggggcgcggacaagcagcugaccugaaaucuacucaggccgcgaucgaucagauuaauggcaaguugaacagacucaucgguaaaacaaaugaaaaguuccaccagaucgagaaggaauuuagcgaggucgaagggaggauucaagaccuggagaaauacguugaggauaccaagauagacuuauggucauauaacgccgaacugcucguggcacuugagaaccagcauacgaucgaucugaccgacagugaaaugaauaaauuguucgagaagacaaagaagcagcuacgggaaaacgcugaggauaugggcaauggaugcuuuaagauuuaccacaaaugugacaacgccugcaucggcuccauucgaaaugggacuuaugaucauaacguauaccgcgacgaggcucugaauaacagauuccagaucaagggaguggaacucaaaagcgguuacaaggacuggauacuguggaucucuuuugccauuucaugcuuccuucugugugucgcauugcucggcuuuaucaugugggccugccaaaaagggaauauuagguguaacaucugcauauga

SEQ ID NO: 133701 - RNA, 1701 nt, Artificial Sequence; identical to SEQ ID NO: 132039
  derived and/or modified sequence opt3 from hemagglutinin__InfluenzaA__AHL99297

SEQ ID NO: 133702 - RNA, 1701 nt, Artificial Sequence; identical to SEQ ID NO: 131884
  derived and/or modified sequence opt3 from hemagglutinin__InfluenzaA__AHL99309

SEQ ID NO: 133703 - RNA, 1701 nt, Artificial Sequence
  derived and/or modified sequence opt3 from hemagglutinin__InfluenzaA__AHL99321
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacaaaauucuucaauuggugagaucugcgacaguccacaccagauacuagauggcgaaaacuguacccucaucgacgcgcugcuuggggauccgcagugcgacggauuucagaauaaaaagugggaucuguucguggagagaagcaaggcuuauuccaacuguuaccccuaugacgucccugauuacgccucuuugaggucgcucguggcaucaagcggcacucuggaauuuaauaacgagaguuucaauugggccgguguuacacagaacgggaccuccucugcuugcauucggggaagcaauuccucauuuuucagucgccugaacuggcucacgcauuuaaauuuuaaguauccagcacugaacgugacuaugcccaacaaugagcaguucgacaaacuuuacaucuggggcguccaccauccuggcaccgauaaagaccagaucuuuuuguaugcccaaagcucugggcgaauuacaguguccacuaagcguucacagcaggcuguaauaccaaacauuggaagcagacccaggauccggaauauuccuagucgcaucucuaucuacuggaccauuguuaaaccaggugauauacugcuaaucaacuccacaggcaaucucauugccccgagaggguacuucaagaucaggagcggaaaaucgucuauaaugcgguccgacgcgcccauuggcaaguguaagucagaaugcaucaccccuaacgguaguaucccaaaugacaaacccuuucagaacgugaaucgcauuacguauggggcauguccucgauacgucaagcaaagcacucugaaacuugccacaggaaugagaaacgugccagagaagcagaccaggggcaucuucggcgcuauugccggguuuauagaaaauggaugggaggguaugguggauggcugguauggguuccggcaccagaacuccgagggacguggccaagcagcugaccugaaaucuacucaggccgcgaucgaucagauuaaugguaaguugaaccgccucaucgggaaaacaaaugaaaaguuccaccagaucgagaaggaauuuagcgaggucgaaggcaggauucaagaccuggagaaauacguugaggauaccaagauagacuuauggucauauaacgccgaacugcucguggcacuugagaaccagcauacgaucgaucugaccgacagugaaaugaauaaauuguucgagaagacuaaaaagcagcuaagagaaaacgcugaggauaugggaaauggcugcuuuaagauuuaccacaaaugugacaacgccugcaucggguccauucggaauggaacauaugaucaugacguauaccgagacgaggcucugaacaaucgcuuccagaucaaggguguggaacucaaaagcggcuacaaggauuggauacuguggaucucuuuugccauuucaugcuuccuucugugugucgcauugcucggguuuaucaugugggccugccaaaaaggaaacauuagauguaauaucugcauauga

SEQ ID NO: 133704 - RNA, 1701 nt, Artificial Sequence
  derived and/or modified sequence opt3 from hemagglutinin__InfluenzaA__AHL99333
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgaccaaaucgaagugacuaaugcgaccgagcugguacagucuucaaguacaggugaaauuugcaacagcccacaccagauccuagauggcgagaauuguacccucauagacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacucuggaguuuaacaaugaguccuucaacuggacagguguuacccagaaugggacgucuagcgcuugcauccggcgcuccaacaauucauuuuucagucgacugaacuggcucacucacuuaaauuuuaaauacccagcacugaacgugaccaugcccaacaaugaacaguucgacaaacuuuauauuuggggaguccaucacccuggcacagauaaggaccagaucuuuuuguacgcccaagcuagcggccguauuacugugucuaccaagagaucccagcaggccguaaucccaaacauagggucaaggccccggguucgcaauauuccuagcagagugaguaucuauuggacaauugucaagccaggagauauccugcuaaucaacucuaccgguaaucucauugcgccgaggggcuacuucaaaauacgguccggaaagagcucgaucaugcgcucugacgcacccauugggaaauguaacuccgccugcaucacgccuaauggcucaauaccaaacgacaagcccuuucagaaugugaaccgaauuacuuacggugcuuguccuagauaugugaagcaaaauacacugaaacuugccaccgggaugaggaacgucccagagaagcagacucggggaaucuucggcgcaaucgcuggcuuuauugaaaaugggugggagggaaugguugaugguugguacggcuuccgucaccagaacagugaggggcgcggacaagccgcggaccugaaaagcacacaggccgcaaucgaucagauuaauggcaaguugaacagacucauagguaaaaccaacgaaaaguuccaucagaucgagaaagaauuuuccgagguggaagggaggauucaagaccuggagaaguauguagaggauacgaagaucgacuuauggucuuacaaugcugaacugcucguggcccuugagaaccagcacaccaucgaucugacagacagcgaaaugaauaaauuguucgagaagacuaaaaagcagcuacgggaaaacgcugaggauaugggcaauggaugcuuuaaaauuuaucauaagugugacaacgccugcauaggcucaauccgaaaugggaccuacgaucacaacgucuaucgcgacgaggcacugaauaacagauuccagauuaagggaguggaacucaaaagugguuacaaggacuggauccuguggauuuccuuugccaucagcugcuuccuucuguguguugcuuugcucggcuuuauaaugugggcgugccaaaaagggaauaucagguguaacauuugcaucuga

SEQ ID NO: 133705 - RNA, 1701 nt, Artificial Sequence
  derived and/or modified sequence opt3 from hemagglutinin__InfluenzaA__AHL99356
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccaguaaguauucuaaaaaguuuaaaccugagauugcaauccgcccaaaggugcgagaccaggagggacguaugaacuacuauuggacacugauugaacccggugauaaaaucacuuucgaggccaccggcaaccuaguggucccuagauacgcuuuugccauggaaaggaaugcaggguccggaauaauuaucagcgacacaccaguucaugauugcaacaccacgugucaaacuccggagggcgcuauuaauacaucgcuccccuuccagaacauccacccuaucaccauugguaagugcccaaaguaugugaaaucuacuaagcugcggcuugccacagggcugcgcaauguacccuccauacagucaagaggauuguuuggcgcgaucgccggcuucauugaagggggauggaccgguaugguggacggcugguacggguaucaucaccagaacgagcaaggaaguggcuacgcagcugaccucaaaagcacgcagaaugccaucgauaagauaaccaacaaagucaauuccgugauugagaagaugaacacacaguuuacugcuguugguaaggaguucaaucaccuggagaaaaggaucgaaaacuuaaauaagaaaguggacgauggguuccuggacaucuggaccuacaacgccgagcuccuuguccuguuggaaaaugagcggacacuagauuaucaugacucuaacgugaagaaccuguacgagaaaguacgcaaucagcucaagaacaaugcaaaggaaauuggcaacggauguuuugaguucuaucacaaaugcgauaauacuuguauggaaagcguuaagaacggcaccuacgacuauccuaaauacucagaggaagccaagcugaaucgagagaaaaucgauggggugaaacuugagaguacaagaauuuaucaaauacuggcuaucuacuccaccgucgcgagcucuuuggugcucgucgugucacugggagcaauuaguuuuuggaugugcagcaacgguuccuuacagugcaggaucuguaucuga

SEQ ID NO: 133706 - RNA, 1701 nt, Artificial Sequence; identical to SEQ ID NO: 131899
  derived and/or modified sequence opt3 from hemagglutinin__InfluenzaA__AHL99367

SEQ ID NO: 133707 - RNA, 1701 nt, Artificial Sequence
  derived and/or modified sequence opt3 from hemagglutinin__InfluenzaA__AHL99379
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuggaucggacaacggcacuugcuauccaggugauuuuaucgacuacgaagaguugagggagcagcucucaagcgugaguuccuucgaacgguuugagauuuucccgaagacaucuagcuggcccaaucacgauuccaacaagggggucaccgccgcuuguccucaugcaggagccaaaggcuuuuauaagaaucugaucuggcuggugaaaaagggcaacucauacccaaaacucaguauaagcuauaucaaugacaaggggaaggaaguauuaguucugugggguauucaccaccccucuacgacugcugaucaacagucccuuuaccagaacgccgacaccuacguguucgucggaacaucacgcuauagcaaaaaguuuaaaccugagaucgcgauucgaccaaaggugcgugaucaggagggcagaaugaauuacuauuggacuuugguggaacccggggacaaaaucaccuucgaggcaacaggaaaccuggucguuccuagguacgccuuugcuauggaacggaacgccggcagugguauaauuaucucugauaccccagugcaugacugcaauacgacuugucaaacaccgaagggggcaauuaacaccucccuacccuuccagaauauccacccuaucacuauuggaaaaugcccaaaguauguaaagagcacaaaacuccgccuggcuaccggccuuagaaacgugcccucgauacagucuaggggccuguuuggggccaucgcgggauucauugaggguggcuggacggggauggucgacggaugguacggcuaucaucaccagaaugaacaagguuccggguacgccgcagauuugaagucaacccagaacgcuaucgacaaaauaacaaauaaggugaacaguguuauugagaaaaugaauacucaguuuaccgccgugggcaaggaguucaaccaccucgaaaagcggaucgagaaucugaacaaaaaggucgaugacggauucuuagauaucuggacauacaaugcugaacugcucgugcuucuggagaacgaacgcacuuuggacuaucaugauagcaauguuaaaaaccuauacgagaagguacgaaaccagcugaaaaauaacgccaaggagauuggcaauggguguuuugaguucuaucacaagugcgacaacaccuguauggaauccgugaaaaauggaacauacgauuauccuaaguacucugaagaggcaaaacucaacagagaaaagaucgacggugucaaacuggagagcaccaggauuuaucaaauacuugccaucuacucaacugcugcgaguucccugguguuggucgugagccucggcgcaauuucuuuuuggaugugcucaaaugggagucugcagugccggaucuguaucuga

SEQ ID NO: 133708 - RNA, 1701 nt, Artificial Sequence; identical to SEQ ID NO: 133700
  derived and/or modified sequence opt3 from hemagglutinin__InfluenzaA__AHL99390

SEQ ID NO: 133709 - RNA, 1701 nt, Artificial Sequence; identical to SEQ ID NO: 131874
  derived and/or modified sequence opt3 from hemagglutinin__InfluenzaA__AHL99402

SEQ ID NO: 133710 - RNA, 1701 nt, Artificial Sequence
  derived and/or modified sequence opt3 from hemagglutinin__InfluenzaA__AHL99426
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuaugaugcgauccgacgcgcccauaggaaaguguaagucagaaugcauuaccccuaacggcaguaucccaaaugacaaacccuuucagaacgugaauagaaucacguauggugcauguccuagguacgucaagcagagcacucugaaacuugccacagggaugcggaacgugccagagaagcaaacccguggaauuuucggcgcuaucgccggcuuuauugaaaaugggugggagggaaugguggaugguugguauggcuuccgccaccagaacuccgaggggagaggacaggcagcugaccugaaaucuacucaagccgcgauagaucagaucaauggcaaguugaacaggcucauugguaaaacaaaugaaaaguuccaccagaucgagaaggaauuuagcgaggucgaagggcggauccaggaccuggagaaauacguugaggauaccaagauugacuuauggucauauaacgccgaacugcucguggcacuugagaaccaacauacgauagaucugaccgacagugaaaugaauaaauuguucgagaagacaaagaagcagcuacgagaaaacgcugaggauaugggcaauggaugcuuuaagaucuaccacaaaugugacaacgccugcauuggcuccauccgcaaugggacuuaugaucaugacguauacagagacgaggcucugaacaauagguuccagauuaagggaguggaacucaaaagcgguuacaaggauuggauccuguggauaucuuuugccaucucaugcuuccuucugugugucgcauugcucggcuuuauuaugugggccugccagaaagggaacauccgguguaauauuugcaucuga

SEQ ID NO: 133711 - RNA, 1701 nt, Artificial Sequence
  derived and/or modified sequence opt3 from hemagglutinin__InfluenzaA__AHL99438
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccagagcgggaaaucgucuauaaugcgcuccgacgcgcccauuggaaaguguaagucagaaugcaucaccccuaacggcaguaucccaaaugacaaacccuuucagaacgugaaucgaauuacguauggugcauguccuagauacgucaagcaaagcacucugaaacuugccacagggaugaggaacgugccagagaagcagacccggggaaucuucggcgcuauugccggcuuuauagaaaaugggugggagggaaugguggaugguugguauggcuuccgucaccagaacuccgaggggcgcggacaagcagcugaccugaaaucuacucaggccgcgaucgaucagauuaauggcaaguugaacagacucaucgguaaaacaaaugaaaaguuccaccagaucgagaaggaauuuagcgaggucgaagggaggauucaagaccuggagaaauacguugaggauaccaagauagacuuauggucauauaacgccgaacugcucguggcacuugagaaccagcauacgaucgaucugaccgacagugaaaugaauaaauuguucgagaagacaaagaagcagcuacgggaaaacgcugaggauaugggcaauggaugcuuuaagauuuaccacaaaugugacaacgccugcaucggcuccauucgaaaugggacuuaugaucaugacguauaccgcgacgaggcucugaacaauagauuccagaucaagggaguggaacucaaaagcgguuacaaggauuggauacuguggaucucuuuugccauuucaugcuuccuucugugugucgcauugcucggcuuuaucaugugggccugccaaaaagggaacauuagguguaauaucugcauauga

SEQ ID NO: 133712 - RNA, 1701 nt, Artificial Sequence; identical to SEQ ID NO: 132010
  derived and/or modified sequence opt3 from hemagglutinin__InfluenzaA__AHL99450

SEQ ID NO: 133713 - RNA, 1701 nt, Artificial Sequence; identical to SEQ ID NO: 132483
  derived and/or modified sequence opt3 from hemagglutinin__InfluenzaA__AHL99462

SEQ ID NO: 133714 - RNA, 1701 nt, Artificial Sequence; identical to SEQ ID NO: 132013
  derived and/or modified sequence opt3 from hemagglutinin__InfluenzaA__AHL99474

SEQ ID NO: 133715 - RNA, 1701 nt, Artificial Sequence; identical to SEQ ID NO: 132039
  derived and/or modified sequence opt3 from hemagglutinin__InfluenzaA__AHL99486

SEQ ID NO: 133716 - RNA, 1701 nt, Artificial Sequence; identical to SEQ ID NO: 132010
  derived and/or modified sequence opt3 from hemagglutinin__InfluenzaA__AHL99498

SEQ ID NO: 133717 - RNA, 1701 nt, Artificial Sequence; identical to SEQ ID NO: 131874
  derived and/or modified sequence opt3 from hemagglutinin__InfluenzaA__AHL99510

SEQ ID NO: 133718 - RNA, 1701 nt, Artificial Sequence; identical to SEQ ID NO: 131874
  derived and/or modified sequence opt3 from hemagglutinin__InfluenzaA__AHL99522

SEQ ID NO: 133719 - RNA, 1701 nt, Artificial Sequence; identical to SEQ ID NO: 131899
  derived and/or modified sequence opt3 from hemagglutinin__InfluenzaA__AHL99534

SEQ ID NO: 133720 - RNA, 1701 nt, Artificial Sequence; identical to SEQ ID NO: 131874
  derived and/or modified sequence opt3 from hemagglutinin__InfluenzaA__AHL99546

SEQ ID NO: 133721 - RNA, 1701 nt, Artificial Sequence; identical to SEQ ID NO: 131874
  derived and/or modified sequence opt3 from hemagglutinin__InfluenzaA__AHL99558

SEQ ID NO: 133722 - RNA, 1701 nt, Artificial Sequence
  derived and/or modified sequence opt3 from hemagglutinin__InfluenzaA__AHL99570
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccucuuguuaccccuaugacgucccugauuacgcaucguugcggucacucguggccagcaguggcacccuggaauuuaacaaugaguccuucaacuggacugguguuacacaaaaugggaccucuagcgcuugcauucgccgauccaacucaaguuucuuuagccgucugaauuggcucacgcauuuaaacuuuaaguauccagcacugaaugugacuaugcccaacaacgagcaguucgacaaacuuuacaucuggggaguccaccauccuggcaccgauaaagaccagaucuuuuuguaugcccagucuuccggcagaauuacagugucaacuaagaggagccaacaggcuguaauaccaaauauugggagucggccccgcaucagaaacauuccuucuaggaucuccaucuacuggaccauuguuaaaccaggagauauacugcuaaucaauagcacagguaaccucauugccccgcggggcuacuucaagauccgcucggggaaaucuuccauaaugcgaucagacgcgcccauuggaaaguguaagagugaaugcaucaccccuaauggcagcaucccaaacgacaaacccuuucagaaugugaacagaauuacguauggugcauguccuagguacaucaagcaguccacucugaaacuugccacagggaugcggaaugucccagagaagcaaacccguggaauuuucggcgcuauagccggcuuuaucgaaaacgggugggagggaaugguggaugguugguauggcuuccgccaccaaaauucugaggggagaggacaggcagcugaccugaaaagcacucaggccgcgauugaucagaucaacggcaaguugaauaggcucaucgguaaaacaaacgaaaaguuccaccagauugagaaggaauuuucagagguggaagggcggauacaggaccuggagaaauacgucgaggauaccaagaucgacuuauggaguuauaaugccgaacugcucguugcacuugagaaccaacauacgauugaucugaccgacuccgaaaugaacaaauuguucgagaagacaaagaagcagcuacgagaaaaugcugaggauaugggcaacggaugcuuuaagaucuaccacaaaugugacaaugccugcauuggcagcauccgcaacgggacuuaugaucaugacguguacagagacgaggcucugaauaacagguuccagauaaagggaguagaacucaaaucugguuacaaggauuggauccuguggauuucauuugccaucaguugcuuccuucuguguguggcauugcucggcuuuauuaugugggccugccagaaagggaauauccgguguaacauaugcauuuga

SEQ ID NO: 133723 - RNA, 1701 nt, Artificial Sequence; identical to SEQ ID NO: 131874
  derived and/or modified sequence opt3 from hemagglutinin__InfluenzaA__AHL99582

SEQ ID NO: 133724 - RNA, 1701 nt, Artificial Sequence
  derived and/or modified sequence opt3 from hemagglutinin__InfluenzaA__AHL99594
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuggaucggacaacggcacuugcuauccaggugauuuuaucgacuacgaagaguugagggagcagcucucaagcgugaguuccuucgaacgguuugagauuuucccgaagacaucuagcuggcccaaucacgauuccaacaagggggucaccgccgcuuguccucgcgcaggagccaaaggcuuuuauaagaaucugaucuggcuggugaaaaagggcaacucauacccaaaacucaguauaagcuauaucaaugacaaggggaaggaaguauuaguucugugggguauucaucaccccucuacgacugcugaucaacagucccuuuaccagaacgccgacaccuacguguucgucggaacaucacgauauagcaaaaaguuuaaaccugagaucgcgauucguccaaaggugagagaucaggagggcaggaugaauuacuauuggacuuugguggaacccggggacaaaaucaccuucgaggcaacaggaaaccuggucguuccucgguacgccuuugcuauggaacgcaacgccggcagugguauaauuaucucugauaccccagugcacgacugcaauacgacuugucaaacaccgaagggggcaauuaacaccucccuacccuuccagaauauccauccuaucacuauuggaaaaugcccaaaguauguaaagagcacaaaacucagacuggcuaccggccuuaggaacgugcccucgauacagucucggggccuguuuggggccaucgcgggauucauugaggguggcuggacggggauggucgacggaugguacggcuaucaccaucagaaugaacaagguuccggguacgccgcagauuugaagucaacccagaacgcuaucgacaaaauaacaaauaaggugaacaguguuauugagaaaaugaauacucaguuuaccgccgugggcaaggaguucaaccaccucgaaaagcgcaucgagaaucugaacaaaaaggucgaugacggauucuuagauaucuggacauacaaugcugaacugcucgugcuucuggagaacgaacgaacuuuggacuaucacgauagcaauguuaaaaaccuauacgagaagguaagaaaccagcugaaaaauaacgccaaggagauuggcaauggguguuuugaguucuaucauaagugcgacaacaccuguauggaauccgugaaaaauggaacauacgauuauccuaaguacucugaagaggcaaaacucaacagggaagagaucgacggugucaagcuggagagcacccggauuuaucaaauacuugccaucuacucaacugcugcgaguucccugguguuggucgugagccucggcgcaauuucuuuuuggaugugcucaaaugggagucugcagugccguaucuguaucuga

SEQ ID NO: 133725 - RNA, 1701 nt, Artificial Sequence; identical to SEQ ID NO: 132483
  derived and/or modified sequence opt3 from hemagglutinin__InfluenzaA__AHL99605

SEQ ID NO: 133726 - RNA, 1701 nt, Artificial Sequence; identical to SEQ ID NO: 132013
  derived and/or modified sequence opt3 from hemagglutinin__InfluenzaA__AHL99617

SEQ ID NO: 133727 - RNA, 1701 nt, Artificial Sequence; identical to SEQ ID NO: 131874
  derived and/or modified sequence opt3 from hemagglutinin__InfluenzaA__AHL99629

SEQ ID NO: 133728 - RNA, 1701 nt, Artificial Sequence
  derived and/or modified sequence opt3 from hemagglutinin__InfluenzaA__AHL99641
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaguuccaaacauagggagccggccccgcauuagaaauaucccuaguaggauuucuaucuacuggaccaucgugaaaccaggagauauucugcuaauaaacuccacagguaaucucaucgccccgcggggcuacuucaagauucgcagcgggaaaucgucuaucaugcgauccgacgcgcccauaggaaaguguaagucagaaugcauuaccccuaacggcaguaucccaaaugacaaacccuuucagaacgucaauagaaucacguauggugcauguccuagguacgugaagcagagcacucugaaacuugccacagggaugcggaacgugccagagaagcaaacccguggaauuuucggcgcuaucgccggcuuuauugaaaaugggugggagggaauggucgaugguugguauggcuuccgccaccagaacuccgaggggagaggacaggcagcugaccugaaaucuacucaagccgcgauagaucagaucaauggcaaguugaacaggcucauugguaaaacaaaugaaaaguuccaccagaucgagaaggaauuuagcgagguugaagggcggauccaggaccuggagaaauacguggaggauaccaagauugacuuauggucauauaacgccgaacugcucguagcacuugagaaccaacauacgauagaucugaccgacagugaaaugaauaaauuguucgagaagacaaagaagcagcuacgagaaaacgcugaggauaugggcaauggaugcuuuaagaucuaccacaaaugugacaacgccugcauuggcuccauccgcaaugggacuuauaaccaugauguguacagagacgaggcucugaauaacagguuccagauuaagggagucgaacucaaaagcgguuacaaggacuggauccuguggauaucuuuugccaugucaugcuuccuucuguguguggcauugcucggcuuuaucaugugggccugccagaaagggaauauucgguguaacaucugcauuuga

SEQ ID NO: 133729 - RNA, 1701 nt, Artificial Sequence
  derived and/or modified sequence opt3 from hemagglutinin__InfluenzaA__AHL99665
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacaucaagcagagcacucugaaacuugccacagggaugcggaacgucccagagaagcaaacccguggaauuuucggcgcuauagccggcuuuaucgaaaaugggugggagggaaugguggaugguugguauggcuuccgccaccagaacuccgaggggagaggacaggcagcugaccugaaaucuacucaagccgcgauugaucagaucaauggcaaguugaacaggcucaucgguaaaacaaaugaaaaguuccaccagauugagaaggaauuuagcgagguggaagggcggauacaggaccuggagaaauacgucgaggauaccaagaucgacuuauggucauauaacgccgaacugcucguugcacuugagaaccaacauacgauugaucugaccgacagugaaaugaauaaauuguucgagaagacaaagaagcagcuacgagaaaacgcugaggauaugggcaauggaugcuuuaagaucuaccacaaaugugacaacgccugcauuggcuccauccgcaaugggacuuaugaucaugacguguacagagacgaggcucugaacaauagguuccagauaaagggaguagaacucaaaagcgguuacaaggauuggauccuguggauuucuuuugccaucucaugcuuccuucuguguguggcauugcucggcuuuauuaugugggccugccagaaagggaacauccgguguaauauaugcauuuga

SEQ ID NO: 133730 - RNA, 1701 nt, Artificial Sequence; identical to SEQ ID NO: 131874
  derived and/or modified sequence opt3 from hemagglutinin__InfluenzaA__AHL99677

SEQ ID NO: 133731 - RNA, 1701 nt, Artificial Sequence; identical to SEQ ID NO: 131874
  derived and/or modified sequence opt3 from hemagglutinin__InfluenzaA__AHL99689

SEQ ID NO: 133732 - RNA, 1701 nt, Artificial Sequence
  derived and/or modified sequence opt3 from hemagglutinin__InfluenzaA__AHL99701
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaacuuuacaucuggggcguccaccauccuggcacugauaaagaccagaucuuuuuguaugcucagagcucugggcguauuaccguguccacaaagagaucacaacaggccguaacuccaaacauaggaagcaggccccggauucgcaauaucccuaguagaauuucuaucuacuggaccaucguuaaaccaggugauauucugcuaauaaacuccacaggcaaucucaucgcgccgaggggguacuucaagauucggagcggaaaaucgucuaucaugcgcuccgacgcacccauaggcaaguguaagucagaaugcauuaccccuaacgguaguaucccaaaugacaaacccuuucagaacgugaaucgaaucacguauggggccuguccuagauacgucaagcagagcacucugaaacuugcuacaggaaugaggaacgugccagagaagcaaacccggggcauuuucggcgccaucgcaggguuuauugaaaauggaugggaggguaugauggauggcugguauggguuccgucaccagaacuccgagggacgcggccaggcugccgaccugaaaucuacucaagcggccauagaucagaucaaugguaaguugaacagacucauugggaaaacaaaugaaaaguuccaccagaucgagaaggaauuuagcgagguggaaggcaggauccaggaccuggagaaauacgucgaggauaccaagauugacuuauggucauauaacgcagaacugcucguugcucuugagaaccaacauacgauagaucugaccgacagugaaaugaauaaauuguucgagaagacaaagaagcagcuacgggaaaacgccgaggauaugggaaauggcugcuuuaagaucuaccacaaaugugacaacgcuugcauuggguccauccgaaauggaacuuaugaucaugacguguaccgcgacgaggcccugaacaauagauuccagauuaaggguguagaacucaaaagcggcuacaaggauuggauccuguggauaucuuuugcaaucucaugcuuccuucuguguguggccuugcucggguuuauuaugugggcuugccagaaaggaaacaucagguguaauauuugcaucuga

SEQ ID NO: 133733 - RNA, 1701 nt, Artificial Sequence
  derived and/or modified sequence opt3 from hemagglutinin__InfluenzaA__AHL99713
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacaccucuuugcggucgcucguggcaucaagcggcacucuggaauuuaauaacgagaguuucaauuggacagguguuacccaaaacgggacguccucugccugcauucgccgaagcaauuccucauuuuucagucgucugaacuggcucacucauuuaaauuuuaaguauccagcucugaacgugaccaugcccaacaaugagcaguucgacaaguuguacaucuggggaguccaccauccuggcacagauaaagaccagauuuuucuuuaugcacagagcucuggcagaaucacuguguccaccaagaggucacaacaggccguaauaccaaacauugggagccggccccgcaucagaaauauuccuaguaggaucucuaucuacuggacaauuguuaaaccaggagauauacugcuaaucaacuccaccgguaaucucauugcuccgcggggcuacuucaagauccgcagcgggaaaucgucuauaaugcgauccgacgcccccauuggaaaguguaagucagaaugcaucacgccuaacggcaguaucccaaaugacaaacccuuucagaacgugaauagaauuacuuauggugcguguccuagguacgucaagcagagcacacugaaacuugcaaccgggaugcggaacgugccagagaagcaaacucguggaaucuucggcgccauugcuggcuuuauagaaaaugggugggagggaaugguggaugguugguauggcuuccgccaccagaacuccgaggggagaggacaggccgcagaccugaaaucuacacaagcugccaucgaucagauuaauggcaaguugaacaggcucaucgguaaaaccaaugaaaaguuccaccagaucgagaaggaauuuagcgaggucgaagggcggauucaggaccuggagaaauacguugaggauacgaagauagacuuauggucauauaacgcggaacugcucguggcccuugagaaccaacauaccaucgaucugacagacagugaaaugaauaaauuguucgagaagacuaaaaagcagcuacgagaaaacgcagaggauaugggcaauggaugcuuuaagauuuaccacaaaugugacaacgcuugcaucggcuccauucgcaaugggaccuaugaucaugacguauacagagacgaggcccugaacaauagguuccagaucaagggaguggaacucaaaagcgguuacaaggauuggauacuguggaucucuuuugcuauuacaugcuuccuucugugugucgccuugcucggcuuuaucaugugggcaugccagaaagggaacauucgguguaauaucugcauauga

SEQ ID NO: 133734 - RNA, 1701 nt, Artificial Sequence; identical to SEQ ID NO: 131874
  derived and/or modified sequence opt3 from hemagglutinin__InfluenzaA__AHL99725

SEQ ID NO: 133735 - RNA, 1701 nt, Artificial Sequence; identical to SEQ ID NO: 132076
  derived and/or modified sequence opt3 from hemagglutinin__InfluenzaA__AHL99737

SEQ ID NO: 133736 - RNA, 1701 nt, Artificial Sequence; identical to SEQ ID NO: 131874
  derived and/or modified sequence opt3 from hemagglutinin__InfluenzaA__AHL99748

SEQ ID NO: 133737 - RNA, 1701 nt, Artificial Sequence; identical to SEQ ID NO: 131874
  derived and/or modified sequence opt3 from hemagglutinin__InfluenzaA__AHL99760

SEQ ID NO: 133738 - RNA, 1701 nt, Artificial Sequence; identical to SEQ ID NO: 131884
  derived and/or modified sequence opt3 from hemagglutinin__InfluenzaA__AHL99772

SEQ ID NO: 133739 - RNA, 1701 nt, Artificial Sequence; identical to SEQ ID NO: 131899
  derived and/or modified sequence opt3 from hemagglutinin__InfluenzaA__AHL99784

SEQ ID NO: 133740 - RNA, 1701 nt, Artificial Sequence; identical to SEQ ID NO: 132039
  derived and/or modified sequence opt3 from hemagglutinin__InfluenzaA__AHL99796

SEQ ID NO: 133741 - RNA, 1701 nt, Artificial Sequence; identical to SEQ ID NO: 131874
  derived and/or modified sequence opt3 from hemagglutinin__InfluenzaA__AHL99808

SEQ ID NO: 133742 - RNA, 1701 nt, Artificial Sequence
  derived and/or modified sequence opt3 from hemagglutinin__InfluenzaA__AHL99820
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccagaacuccgacgggagaggacaggcagcugaucugaaaucuacucaagccgcgaucgaccagauuaauggcaaguugaacaggcucaucgguaaaacaaaugagaaguuccaccagaucgaaaaggaguuuagcgaagucgaggggcggauucaggaucuggaaaaauacguugaggacaccaagauagauuuauggucauauaacgccgagcugcucguggcacuugaaaaccaacauacgaucgaccugaccgauagugagaugaauaaauuguucgaaaagacaaagaagcagcuacgagagaacgcugaagacaugggcaauggaugcuuuaagauuuaccacaaaugugauaacgccugcaucggcuccauucgcaaugggacuuaugaccaugacguauacagagaugaggcucugaacaauagguuccagaucaagggaguggagcucaaaagcgguuacaaggacuggauacuguggaucucuuuugccauuucaugcuuccuucugugugucguguugcucggcuuuaucaugugggcaugccagaaagggaacauucgguguaauaucugcauauga

SEQ ID NO: 133743 - RNA, 1701 nt, Artificial Sequence; identical to SEQ ID NO: 131874
  derived and/or modified sequence opt3 from hemagglutinin__InfluenzaA__AHL99832

SEQ ID NO: 133744 - RNA, 1701 nt, Artificial Sequence; identical to SEQ ID NO: 131899
  derived and/or modified sequence opt3 from hemagglutinin__InfluenzaA__AHL99844

SEQ ID NO: 133745 - RNA, 1701 nt, Artificial Sequence; identical to SEQ ID NO: 131851
  derived and/or modified sequence opt3 from hemagglutinin__InfluenzaA__AHL99856

SEQ ID NO: 133746 - RNA, 1701 nt, Artificial Sequence
  derived and/or modified sequence opt3 from hemagglutinin__InfluenzaA__AHL99868
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgaccaaaucgaagugacuaaugcgaccgagcugguacagucuucaaguacaggugaaauuugcaacagcccacaccagauccuagauggcgagaauuguacccucauagacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacucuggaguuuaacaaugaguccuucaacuggacagguguuacccagaaugggacgucuagcgcuugcauccggcgcuccaacaauucauuuuucagucgacugaacuggcucacucacuuaaauuuuaaauacccagcacugaacgugaccaugcccaacaaugaacaguucgacaagcuguauauuuggggaguccaucacccuggcacagauaaggaccagaucuuuuuguacgcccaagcuagcggccguauuacugugucuaccaaaaagucccagcaggccguaaucccaaacauagggucaagacccaggguucggaauauuccuagccgcgugaguaucuauuggacaauugucaaaccaggagauauccugcuaaucaacucuaccgguaaucucauugcgccgagaggcuacuucaagauaagguccgggaaaagcucgaucaugcggucugacgcacccauuggaaaguguaacuccgccugcaucacgccuaauggcucaauaccaaacgacaagcccuuucagaaugugaaccgcauuacuuacggugcuuguccucgauaugugaaacaaaauacacugaaacuugccaccgggaugagaaacgucccagagaagcagacuaggggaaucuucggcgcaaucgcuggcuuuauugaaaaugggugggagggaaugguugaugguugguacggcuuccggcaccagaacagugaggggcguggacaagccgcggaccuuaagagcacacaggccgcaaucgaucagauuaauggcaaauugaaccgccucauagguaagaccaacgaaaaauuccaucagaucgagaaggaauuuuccgagguggaagggaggauucaagaccuggagaaguauguagaggauacgaaaaucgacuuauggucuuacaaugcugaacugcucguggcccuugagaaccagcacaccaucgaucugacagacagcgaaaugaauaaguuguucgagaaaacuaagaaacagcuaagagaaaacgcugaggauaugggcaauggaugcuuuaagauuuaucauaagugugacaacgccugcauaggcucaauccggaaugggaccuacgaucacgacgucuaucgagacgaggcacugaacaaucgcuuccagauuaaaggaguggaacucaagagugguuacaaagauuggauccuguggauuuccuuugccaucagcugcuuccuucuguguguugcuuugcucggcuuuauaaugugggcgugccaaaaggggaacaucagauguaauauuugcaucuga

SEQ ID NO: 133747 - RNA, 1701 nt, Artificial Sequence; identical to SEQ ID NO: 132013
  derived and/or modified sequence opt3 from hemagglutinin__InfluenzaA__AHL99880

SEQ ID NO: 133748 - RNA, 1701 nt, Artificial Sequence; identical to SEQ ID NO: 131874
  derived and/or modified sequence opt3 from hemagglutinin__InfluenzaA__AHL99892

SEQ ID NO: 133749 - RNA, 1701 nt, Artificial Sequence; identical to SEQ ID NO: 132010
  derived and/or modified sequence opt3 from hemagglutinin__InfluenzaA__AHL99904

SEQ ID NO: 133750 - RNA, 1701 nt, Artificial Sequence
  derived and/or modified sequence opt3 from hemagglutinin__InfluenzaA__AHL99916
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagaugcggagcggaaaaucgucuaucaugcgcuccgacgcacccauaggcaaguguaagucagaaugcauuacaccuaacgguaguaucccaaaugacaaacccuuucagaacgugaaucgaaucaccuauggggccuguccuagauacgucaagcagagcacgcugaaacuugcuacuggaaugaggaacgugccagagaagcaaacacggggcauuuucggcgccaucgcaggguuuauugaaaauggaugggaggguaugauggauggcugguauggguuccgucaccagaacuccgagggacgcggccaggcugccgaccugaaaucuacccaagcggccauagaucagaucaaugguaaguugaacagacucauugggaaaacuaaugaaaaguuccaccagaucgagaaggaauuuagcgagguggaaggcaggauccaggaccuggagaaauacgucgaggauacaaagauugacuuauggucauauaacgcagaacugcucguugcucuugagaaccaacauaccauagaucugacggacagugaaaugaauaaauuguucgagaagaccaaaaagcagcuacgggaaaacgccgaggauaugggaaauggcugcuuuaagaucuaccacaaaugugacaacgcuugcauuggguccauccgaaauggaacauaugaucaugacguguaccgcgacgaggcccugaacaauagauuccagauuaaggguguagaacucaaaagcggcuacaaggauuggauccuguggauaucuuuugcaaucucaugcuuccuucuguguguggccuugcucggguuuauuaugugggcuugccagaaaggaaacaucagguguaauauuugcaucuga

SEQ ID NO: 133751 - RNA, 1701 nt, Artificial Sequence; identical to SEQ ID NO: 131899
  derived and/or modified sequence opt3 from hemagglutinin__InfluenzaA__AHL99928

SEQ ID NO: 133752 - RNA, 1701 nt, Artificial Sequence
  derived and/or modified sequence opt3 from hemagglutinin__InfluenzaA__AHL99940
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcggggucgagggccggauucaggaccuggaaaaauacguugaggauaccaagauagacuuauggucauauaacgccgagcugcucguggcacuugaaaaccaacauacgaucgaucugaccgacagugagaugaauaaauuguucgaaaagacaaagaagcagcuacgagagaacgcugaagauaugggaaauggcugcuuuaagauuuaccacaaaugugacaacgccugcaucggguccauucgcaauggaacuuaugaucaugacguauacagagacgaggcucugaacaauagguuccagaucaaggguguggagcucaaaagcggcuacaaggauuggauacuguggaucucuuuugccauuucaugcuuccuucugugugucgcauugcucggguuuaucaugugggccugccagaaaggaaacauucgguguaauaucugcauauga

SEQ ID NO: 133753 - RNA, 1701 nt, Artificial Sequence; identical to SEQ ID NO: 131874
  derived and/or modified sequence opt3 from hemagglutinin__InfluenzaA__AHL99952

SEQ ID NO: 133754 - RNA, 1701 nt, Artificial Sequence; identical to SEQ ID NO: 131899
  derived and/or modified sequence opt3 from hemagglutinin__InfluenzaA__AHL99964

SEQ ID NO: 133755 - RNA, 1701 nt, Artificial Sequence; identical to SEQ ID NO: 131899
  derived and/or modified sequence opt3 from hemagglutinin__InfluenzaA__AHL99976

SEQ ID NO: 133756 - RNA, 1701 nt, Artificial Sequence; identical to SEQ ID NO: 131899
  derived and/or modified sequence opt3 from hemagglutinin__InfluenzaA__AHL99988

SEQ ID NO: 133757 - RNA, 1701 nt, Artificial Sequence; identical to SEQ ID NO: 131874
  derived and/or modified sequence opt3 from hemagglutinin__InfluenzaA__AHM00001

SEQ ID NO: 133758 - RNA, 1701 nt, Artificial Sequence; identical to SEQ ID NO: 131874
  derived and/or modified sequence opt3 from hemagglutinin__InfluenzaA__AHM00013

SEQ ID NO: 133759 - RNA, 1701 nt, Artificial Sequence; identical to SEQ ID NO: 131884
  derived and/or modified sequence opt3 from hemagglutinin__InfluenzaA__AHM00025

SEQ ID NO: 133760 - RNA, 1701 nt, Artificial Sequence; identical to SEQ ID NO: 131899
  derived and/or modified sequence opt3 from hemagglutinin__InfluenzaA__AHM00037

SEQ ID NO: 133761 - RNA, 1701 nt, Artificial Sequence; identical to SEQ ID NO: 131899
  derived and/or modified sequence opt3 from hemagglutinin__InfluenzaA__AHM00061

SEQ ID NO: 133762 - RNA, 1701 nt, Artificial Sequence; identical to SEQ ID NO: 131874
  derived and/or modified sequence opt3 from hemagglutinin__InfluenzaA__AHM00073

SEQ ID NO: 133763 - RNA, 1701 nt, Artificial Sequence; identical to SEQ ID NO: 131874
  derived and/or modified sequence opt3 from hemagglutinin__InfluenzaA__AHM00085

SEQ ID NO: 133764 - RNA, 1701 nt, Artificial Sequence
  derived and/or modified sequence opt3 from hemagglutinin__InfluenzaA__AHM00097
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaauucuuauauaaacgacaagggcaaggaaguacugguucuuugggggauccaccaccccuccacgacugcugaucaacagucauuguaccagaaugccgacaccuacguguucgucggaacaagccgcuauaguaaaaaguuuaaaccugagauugcgauccgaccaaaggugcgugaucaggaggguagaaugaacuacuauuggacucugguggaacccggcgacaaaauuaccuucgaggcaacagggaaccuagucguuccuagguacgccuuugcuauggaacggaaugccggaucuggcaucauaauuuccgauaccacggugcaugacugcaacacuacaugucaaaccccaaagggugcaaucaauacuagccucccguuccagaacauucaccccaucacaaucgggaaaugcccuaaguauguaaagucgaccaaacugcgccuugcuacgggacugagaaaugugccaucuauucaguccaggggcuuguuuggcgccauagcgggguucaucgagggagguuggaccggcauggucgacgggugguacggauaucaucaccagaacgaacaaggcucagguuacgccgcagaucucaagaguacacagaaugcuauugacaaaaucacuaacaaggugaauagcguuauagagaaaaugaacacccaguuuacagccguggggaaggaguucaaucaccuggaaaagcggauugagaacuuaaauaaaaaggucgaugacggcuuccuggauaucuggacuuacaacgcugaacuccuugugcuguuggagaaugaacgcacccuagacuaucaugauuccaacguuaaaaaccuguacgagaagguacgaaaucagcucaaaaacaaugccaaggagaucggaaacggcuguuuugaguucuaucacaagugcgacaauauguguauggagucugugaaaaacgggacauacgauuaucccaaguacagcgaagaggcaaaacugaauagagaaaagauugacggagucaaacuugagucaaccaggaucuaucaaauucuggccauauacaguacuguggcuuccagcuugguccucgugguuucucugggugcgaucucauuuuggaugugcaguaacggcagcuuacagugccggauuuguaucuga

SEQ ID NO: 133765 - RNA, 1701 nt, Artificial Sequence; identical to SEQ ID NO: 131899
  derived and/or modified sequence opt3 from hemagglutinin__InfluenzaA__AHM00108

SEQ ID NO: 133766 - RNA, 1701 nt, Artificial Sequence; identical to SEQ ID NO: 131899
  derived and/or modified sequence opt3 from hemagglutinin__InfluenzaA__AHM00120

SEQ ID NO: 133767 - RNA, 1701 nt, Artificial Sequence
  derived and/or modified sequence opt3 from hemagglutinin__InfluenzaA__AHM00132
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgaccaaaucgaagugacuaaugcgaccgagcugguacagucuucaaguacaggugaaauuugcaacagcccacaccagauccuagauggcgagaauuguacccucauagacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacucuggaguuuaacaaugaguccuucaacuggacagguguuacccagaaugggacgucuagcgcuugcauccggcgcuccaacaauucauuuuucagucgacugaacuggcucacucacuuaaauuuuaaauacccagcacugaacgugaccaugcccaacaaugaacaguucgacaaacuuuauauuuggggaguccaucacccuggcacagauaaggaccagaucagcuuguacgcccaggcuucuggccguauuacuguguccaccaagagaucacaacaggccguaaucccaaacauagggagcaggccccggguucgcaauauuccuaguagagugucuaucuauuggacaauugucaagccaggagauauccugcuaaucaacuccaccgguaaucucauugcgccgaggggcuacuuuaaaauacggagcgggaagucgucuaucaugcgcuccgacgcacccauuggaaaauguaacucagccugcaucacgccuaauggcaguauaccaaacgacaagcccuuccagaaugugaaccgaauuacuuacggugcuuguccuagauaugugaagcaaaauacacugaaacuugccaccgggaugaggaacgucccagagaagcagacucggggaaucuuuggcgcaaucgcuggcuucauugaaaaugggugggagggaaugguugaugguugguacggcuuucgucaccagaacagcgaggggcgcggacaagccgcggaccugaaauccacacaggccgcaaucgaucagauuaauggcaaguugaacagacucauagguaaaaccaacgaaaaguuccaucagaucgagaaagaguucucugaaguggaagggaggauucaagaccuggagaaguauguagaggauacgaagaucgacuuauggagcuacaaugcugaacugcucguggcccuugagaaccagcacaccaucgaucugacagacucagaaaugaauaaauuguuugagaagacuaaaaagcagcuacgggaaaacgcugaggauaugggcaauggaugcuucaaaauuuaucauaagugugacaacgccugcauaggcaguauccgaaaugggaccuacgaucacgacgucuaucgcgacgaggcacugaacaauagauuucagauuaagggaguggaacucaaauccgguuacaaggauuggauccuguggauuagcuucgccaucucuugcuuucuucuguguguugcuuugcucggcuucauaaugugggcgugccaaaaagggaacaucagguguaauauuugcaucuga

SEQ ID NO: 133768 - RNA, 1701 nt, Artificial Sequence; identical to SEQ ID NO: 131874
  derived and/or modified sequence opt3 from hemagglutinin__InfluenzaA__AHM00144

SEQ ID NO: 133769 - RNA, 1701 nt, Artificial Sequence; identical to SEQ ID NO: 131899
  derived and/or modified sequence opt3 from hemagglutinin__InfluenzaA__AHM00156

SEQ ID NO: 133770 - RNA, 1701 nt, Artificial Sequence; identical to SEQ ID NO: 131874
  derived and/or modified sequence opt3 from hemagglutinin__InfluenzaA__AHM00168

SEQ ID NO: 133771 - RNA, 1701 nt, Artificial Sequence
  derived and/or modified sequence opt3 from hemagglutinin__InfluenzaA__AHM00180
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaacccacaccagauacuagauggcgaaaauuguacacucaucgacgcucugcuuggggauccgcagugcgacggauuucagaacaaaaagugggaucuguucguggagaggaguaaagccuauagcaauuguuaccccuaugacgucccugauuacgcauccuugcggucucucguggccucgucaggcacccuggaauuuaacaaugagagcuucaacuggacugguguuacacaaaaugggaccaguuccgcuugcauucgccgaucuaacagcuccuuuuucucacgucugaauuggcucacgcauuuaaacuuuaaguauccagcacugaacgugacuaugcccaauaacgagcaguucgacaaacuuuacaucuggggaguccaccauccuggcaccgauaaagaccagaucuuuuuguaugcccagaguagcggcagaauuacagugucuacuaagaggucccaacaggcuguaauaccaaauauugggucacggccccgcaucagaaacauuccuagcaggaucaguaucuacuggaccauuguuaaaccaggagauauacugcuaaucaauucuacagguaaccucauugccccgcggggcuacuucaagauccgcuccgggaaaagcucgauaaugcgaucugacgcgcccauuggaaaguguaaguccgaaugcaucaccccuaauggcucaaucccaaacgacaaacccuuucagaaugugaacagaauuacguauggugcauguccuagguacgucaagcagaguacucugaaacuugccacagggaugcggaaugugccagagaagcaaacccguggaaucuucggcgcuauugccggcuuuauagaaaacgggugggagggaaugguggaugguugguauggcuuccgccaccagaauagcgaggggagaggacaggcagcugaccugaaauccacucaagccgcgaucgaucagauuaacggcaaguugaauaggcucaucgguaaaacaaacgaaaaguuccaccagaucgagaaggaauuuucugaggucgaagggcggauucaggaccuggagaaauacguugaggauaccaagauagacuuauggagcuauaacgccgaacugcucguggcacuugagaaucaacauacgaucgaucugaccgacucagaaaugaacaaauuguucgagaagacaaagaagcagcuacgagaaaaugcugaggauaugggcaacggaugcuuuaagauuuaccacaaaugugacaaugccugcaucggcaguauucgcaacgggacuuaugaucauaauguauacagagacgaggcucugaacaauagguuccagaucaagggaguggaacucaaauccgguuacaaggacuggauacuguggaucagcuuugccauuucuugcuuccuucugugugucgcauugcucggcuuuaucaugugggccugccagaaagggaacauucgguguaauaucugcauauga

SEQ ID NO: 133772 - RNA, 1701 nt, Artificial Sequence; identical to SEQ ID NO: 131851
  derived and/or modified sequence opt3 from hemagglutinin__InfluenzaA__AHM00192

SEQ ID NO: 133773 - RNA, 1701 nt, Artificial Sequence; identical to SEQ ID NO: 131899
  derived and/or modified sequence opt3 from hemagglutinin__InfluenzaA__AHM00204

SEQ ID NO: 133774 - RNA, 1701 nt, Artificial Sequence; identical to SEQ ID NO: 131899
  derived and/or modified sequence opt3 from hemagglutinin__InfluenzaA__AHM00216

SEQ ID NO: 133775 - RNA, 1701 nt, Artificial Sequence; identical to SEQ ID NO: 131874
  derived and/or modified sequence opt3 from hemagglutinin__InfluenzaA__AHM00228

SEQ ID NO: 133776 - RNA, 1701 nt, Artificial Sequence; identical to SEQ ID NO: 131874
  derived and/or modified sequence opt3 from hemagglutinin__InfluenzaA__AHM00240

SEQ ID NO: 133777 - RNA, 1701 nt, Artificial Sequence; identical to SEQ ID NO: 131874
  derived and/or modified sequence opt3 from hemagglutinin__InfluenzaA__AHM00252

SEQ ID NO: 133778 - RNA, 1701 nt, Artificial Sequence; identical to SEQ ID NO: 131874
  derived and/or modified sequence opt3 from hemagglutinin__InfluenzaA__AHM00264

SEQ ID NO: 133779 - RNA, 1701 nt, Artificial Sequence; identical to SEQ ID NO: 131851
  derived and/or modified sequence opt3 from hemagglutinin__InfluenzaA__AHM00276

SEQ ID NO: 133780 - RNA, 1701 nt, Artificial Sequence; identical to SEQ ID NO: 131874
  derived and/or modified sequence opt3 from hemagglutinin__InfluenzaA__AHM00288

SEQ ID NO: 133781 - RNA, 1701 nt, Artificial Sequence; identical to SEQ ID NO: 131874
  derived and/or modified sequence opt3 from hemagglutinin__InfluenzaA__AHM00300

SEQ ID NO: 133782 - RNA, 1701 nt, Artificial Sequence; identical to SEQ ID NO: 131899
  derived and/or modified sequence opt3 from hemagglutinin__InfluenzaA__AHM00312

SEQ ID NO: 133783 - RNA, 1701 nt, Artificial Sequence; identical to SEQ ID NO: 131851
  derived and/or modified sequence opt3 from hemagglutinin__InfluenzaA__AHM00324

SEQ ID NO: 133784 - RNA, 1701 nt, Artificial Sequence; identical to SEQ ID NO: 131851
  derived and/or modified sequence opt3 from hemagglutinin__InfluenzaA__AHM00336

SEQ ID NO: 133785 - RNA, 1701 nt, Artificial Sequence; identical to SEQ ID NO: 131899
  derived and/or modified sequence opt3 from hemagglutinin__InfluenzaA__AHM00348

SEQ ID NO: 133786 - RNA, 1701 nt, Artificial Sequence
  derived and/or modified sequence opt3 from hemagglutinin__InfluenzaA__AHM00360
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacccuggaauuuaauaacgagaguuucaauuggacugguguuacacagaacgggaccuccucugcuugcauucggcgcagcaauuccucauuuuucagucgacugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccaaagcucuggccguauuacaguguccacuaagagaucacagcaggcuguaauaccaaacauugggagcaggccccggauccgcaauauuccuaguagaaucucuaucuacuggaccauuguuaaaccaggagauauacugcuaaucaacuccacagguaaucucauugccccgaggggcuacuucaagauccggagcgggaaaucgucuauaaugcgcuccgacgcgcccauuggaaaguguaagucagaaugcaucaccccuaacggcaguaucccaaaugacaaacccuuucagaacgugaaucgaauuacguauggugcauguccuagauacgucaagcaaagcacucugaaacuugccacagggaugaggaacgugccagagaagcagacccggggaaucuucggcgcuauugccggcuuuauagaaaaugggugggagggaaugguggaugguugguauggcuuccgucaccagaacuccgaggggcgcggacaagcagcugaccugaaaucuacucaggccgcgaucgaucagauuaauggcaaguugaacagacucaucgguaaaacaaaugaaaaguuccaccagaucgagaaggaauuuagcgaggucgaagggaggauucaagaccuggagaaauacguugaggauaccaagauagacuuauggucauauaacgccgaacugcucguggcacuugagaaccagcauacgaucgaucugaccgacagugaaaugaauaaauuguucgagaagacaaagaagcagcuacgggaaaacgcugaggauaugggcaauggaugcuuuaagauuuaccacaaaugugacaacgccugcaucggcuccauucgaaaugggacuuaugaucaugacguauaccgcgacgaggcucugaacaauagauuccagaucaagggaguggaacucaaaagcgguuacaaggauuggauacuguggaucucuuuugccauuucaugcuuccuucugugugucgcauugcucggcuuuaucaugugggccugccaaaaagggaacauuagguguaauaucugcauauga

SEQ ID NO: 133787 - RNA, 1701 nt, Artificial Sequence; identical to SEQ ID NO: 131899
  derived and/or modified sequence opt3 from hemagglutinin__InfluenzaA__AHM00372

SEQ ID NO: 133788 - RNA, 1701 nt, Artificial Sequence; identical to SEQ ID NO: 131899
  derived and/or modified sequence opt3 from hemagglutinin__InfluenzaA__AHM00395

SEQ ID NO: 133789 - RNA, 1701 nt, Artificial Sequence; identical to SEQ ID NO: 131874
  derived and/or modified sequence opt3 from hemagglutinin__InfluenzaA__AHM00407

SEQ ID NO: 133790 - RNA, 1701 nt, Artificial Sequence; identical to SEQ ID NO: 131874
  derived and/or modified sequence opt3 from hemagglutinin__InfluenzaA__AHM00419

SEQ ID NO: 133791 - RNA, 1701 nt, Artificial Sequence; identical to SEQ ID NO: 131874
  derived and/or modified sequence opt3 from hemagglutinin__InfluenzaA__AHM00443

SEQ ID NO: 133792 - RNA, 1701 nt, Artificial Sequence; identical to SEQ ID NO: 131899
  derived and/or modified sequence opt3 from hemagglutinin__InfluenzaA__AHM00455

SEQ ID NO: 133793 - RNA, 1701 nt, Artificial Sequence; identical to SEQ ID NO: 131899
  derived and/or modified sequence opt3 from hemagglutinin__InfluenzaA__AHM00467

SEQ ID NO: 133794 - RNA, 1701 nt, Artificial Sequence; identical to SEQ ID NO: 131899
  derived and/or modified sequence opt3 from hemagglutinin__InfluenzaA__AHM00479

SEQ ID NO: 133795 - RNA, 1701 nt, Artificial Sequence; identical to SEQ ID NO: 131899
  derived and/or modified sequence opt3 from hemagglutinin__InfluenzaA__AHM00491

SEQ ID NO: 133796 - RNA, 1701 nt, Artificial Sequence; identical to SEQ ID NO: 131874
  derived and/or modified sequence opt3 from hemagglutinin__InfluenzaA__AHM00503

SEQ ID NO: 133797 - RNA, 1701 nt, Artificial Sequence; identical to SEQ ID NO: 131874
  derived and/or modified sequence opt3 from hemagglutinin__InfluenzaA__AHM00515

SEQ ID NO: 133798 - RNA, 1701 nt, Artificial Sequence
  derived and/or modified sequence opt3 from hemagglutinin__InfluenzaA__AHM00527
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuccaauuggugagaucugcgacucaccgcaccagauacuagauggcgaaaacuguacacucaucgacgcucugcuuggggauccccagugcgacggauuucagaauaaaaagugggaucuguucguggagaggaguaaagccuauagcaacuguuacccuuaugacgucccagauuacgcauccuugcggucucucguggccucgucaggcacccuggaauuuaauaacgagagcuucaauuggacugguguuacacaaaacgggaccaguuccgcuugcauucgccgaucuaauagcuccuuuuucucacgucugaacuggcucacgcauuuaaauuuuaaguaucccgcacugaacgugacuaugccuaacaaugagcaguucgacaaacuuuacaucuggggaguccaccauccaggcaccgauaaagaccagaucuuuuuguaugcccagaguagcggcagaauuacagugucuacuaagaggucccaacaggcuguaauacccaacauugggucacggccucgcaucagaaauauuccaagcaggaucaguaucuacuggaccauuguuaaaccgggagauauacugcuaaucaacucuacagguaaucucauugcgccccggggcuacuucaagauccgcuccgggaaaagcucgauaaugcgaucugacgccccuauuggaaaguguaaguccgaaugcaucaccccaaacggcucaauccccaaugacaaaccuuuucagaacgugaauagaauuacguauggugcauguccaagguacgucaagcagaguacucugaaacuugccacagggaugcggaacgugcccgagaagcaaacccguggaaucuucggcgcuauugccggcuuuauagaaaaugggugggagggaaugguggaugguugguauggcuuccgccaccagaacagcgaggggagaggacaggcagcugaccugaaauccacucaagccgcgaucgaucagauuaauggcaaguugaacaggcucaucgguaaaacaaaugaaaaguuccaccagaucgagaaggaauuuucugaggucgaagggcggauucaggaccuggagaaauacguugaggauaccaagauagacuuauggagcuauaacgccgaacugcucguggcacuugagaaccaacauacgaucgaucugaccgacucagaaaugaauaaauuguucgagaagacaaagaagcagcuacgagaaaacgcugaggauaugggcaauggaugcuuuaagauuuaccacaaaugugacaacgccugcaucggcaguauucgcaaugggacuuaugaucauaacguauacagagacgaggcucugaauaacagguuccagaucaagggaguggaacucaaauccgguuacaaggacuggauacuguggaucagcuuugccauuucuugcuuccuucugugugucgcauugcucggcuuuaucaugugggccugccagaaagggaauauucgguguaacaucugcauauga

SEQ ID NO: 133799 - RNA, 1701 nt, Artificial Sequence; identical to SEQ ID NO: 131851
  derived and/or modified sequence opt3 from hemagglutinin__InfluenzaA__AHM00539

SEQ ID NO: 133800 - RNA, 1701 nt, Artificial Sequence
  derived and/or modified sequence opt3 from hemagglutinin__InfluenzaA__AHM00543
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgaccaaaucgaagugacuaaugcgaccgagcugguacagucuucaaguacaggugaaauuugcaacagcccacaccagauccuagauggcgagaauuguacccucauagacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacuauggaguuuaacaaugaguccuucaacuggacagguguuacccagaaugggacgucuagcgcuugcauccggcgcuccaacaauucauuuuucagucgacugaacuggcugacucaccucaauuuuaaauacccagcauuaaacgugaccaugcccaacaaugaacaguucgacaagcuguauauuuggggaguccaucacccuggcacagauaaggaccagaucuuucuuuacgcccaagcuagcggccguauuacugugucuaccaaaagaucccagcaggccguaaucccaaacauagggucaaggccccggguucgcaauauuccuagcagagugaguaucuauuggacaauugucaagccaggagauaucuugcugaucaacucuaccgguaaucuaauugcgccgaggggcuacuucaaaauacgguccggaaagagcucgaucaugcgcucugacgcacccauugggaaauguaacuccgccugcaucacgccuaauggcucaauaccaaacgacaagcccuuucagaaugugaaccgaauuacuuacggugcuuguccuagauaugugaagcaaaauacacucaaacuggccaccgggaugaggaacgucccagagaagcagacucggggaaucuucggcgcaaucgcuggcuuuauugaaaaugggugggagggaaugguugaugguugguacggcuuccgucaccagaacagugaggggcgcggacaagccgcggaccuuaaaagcacacaggccgcaaucgaucagauuaauggcaagcugaacagauugauagguaaaaccaacgaaaaguuccaucagaucgagaaagaauuuuccgagguggaagggaggauucaagaccucgagaaguauguagaggauacgaagaucgaccuguggucuuacaaugcugaauuacugguggcccucgagaaccagcacaccaucgaucuuacagacagcgaaaugaauaaacuguucgagaagacuaaaaagcaguugcgggaaaacgcugaggauaugggcaauggaugcuuuaaaauuuaucauaagugugacaacgccugcauaggcucaauccgaaaugggaccuacgaucacgacgucuaucgcgacgaggcacuaaacaauagauuccagauuaagggaguggaacugaaaagugguuacaaggauuggauccucuggauuuccuuugccaucagcugcuuccugcuuuguguugcucuguugggcuuuauaaugugggcgugccaaaaagggaacaucagguguaauauuugcaucuga

SEQ ID NO: 133801 - RNA, 1701 nt, Artificial Sequence; identical to SEQ ID NO: 131874
  derived and/or modified sequence opt3 from hemagglutinin__InfluenzaA__AHM00555

SEQ ID NO: 133802 - RNA, 1701 nt, Artificial Sequence
  derived and/or modified sequence opt3 from hemagglutinin__InfluenzaA__AHM00567
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgcaagagcaauuccucauuuuucagucgacugaacuggcucacgcauuuaaauuuuaaguauccagcacugaacgugacuaugcccaacaaugagcaguucgacaaacuuuacaucuggggaguccaccauccuggcaccgauaaggaccagauuuuucuuuaugcccagagcucuggccguaucacaguguccacuaaaagaucacaacaggcuguaauaccaaacauugggagcaggccccggauccgcaauauuccuaguagaaucucuaucuacuggaccauuguuaagccaggagauauacugcuaaucaacuccacagguaaucucauugccccgaggggcuacuucaaaauccggagcgggaagucgucuauaaugcgcuccgacgcgcccauuggaaaguguaaaucagaaugcaucaccccuaacggcaguaucccaaaugacaagcccuuucagaacgugaaucgaauuacguauggugcauguccuagauacgucaaacagagcacucugaaguuggccacagggaugaggaacgugccagagaaacaaacccggggaaucuucggcgcuauugccggcuuuauagaaaaugggugggagggaaugguggaugguugguauggcuuccgucaccagaacuccgaggggcgcggacaggcagcugaccugaagucuacucaagccgcgaucgaucagauuaauggcaaauugaacagacucaucgguaagacaaaugaaaaguuccaccagaucgagaaagaauuuagcgaggucgaagggaggauucaggaccuggagaaguacguugaggauaccaaaauagacuuauggucauauaacgccgaacugcucguggcacuugagaaccaacauacgaucgaucugaccgacagugaaaugaauaaguuguucgagaaaacaaagaagcagcuacgggaaaacgcugaggauaugggcaauggaugcuuuaaaauuuaccacaagugugacaacgccugcaucggcuccauucgaaaugggacuuaugaucaugacguauaccgcgacgaggcucugaacaauagauuccagaucaaaggaguggaacucaagagcgguuacaaagauuggauacuguggaucucuuuugccauuucaugcuuccuucugugugucgcauugcucggcuuuaucaugugggccugccagaaggggaacauuagguguaauaucugcauauga

SEQ ID NO: 133803 - RNA, 1701 nt, Artificial Sequence; identical to SEQ ID NO: 131874
  derived and/or modified sequence opt3 from hemagglutinin__InfluenzaA__AHM00579

SEQ ID NO: 133804 - RNA, 1701 nt, Artificial Sequence; identical to SEQ ID NO: 131899
  derived and/or modified sequence opt3 from hemagglutinin__InfluenzaA__AHM00591

SEQ ID NO: 133805 - RNA, 1701 nt, Artificial Sequence; identical to SEQ ID NO: 131874
  derived and/or modified sequence opt3 from hemagglutinin__InfluenzaA__AHM00603

SEQ ID NO: 133806 - RNA, 1701 nt, Artificial Sequence; identical to SEQ ID NO: 131874
  derived and/or modified sequence opt3 from hemagglutinin__InfluenzaA__AHM00615

SEQ ID NO: 133807 - RNA, 1701 nt, Artificial Sequence
  derived and/or modified sequence opt3 from hemagglutinin__InfluenzaA__AHM00627
augaagaccacaaucgcccugagcuacauucucugccuuguguucgcucagaaacugcccggcaacgacaauuccacugcaacguuguguuuagggcaccaugccgucccuaacggaaccauaguuaagacaaucacuaaugauagaauugaggugaccaacgcgacagaacugguacaaaauucuucaaucggugagauuugcgacaguccacaccagauccuagauggcgaaaacuguacccucauagacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacucuggaauuuaauaacgagaguuucaauuggacagguguuacccaaaacgggacguccucugcuugcauccgccgaagcaauuccucauuuuucagucgucugaacuggcucacucauuuaaauuuuaaguauccagcacugaacgugaccaugcccaacaaugagcaguucgacaaacuuuacauuuggggaguccaccauccuggcacagauaaggaccagaucuuuuuguaugcccagagcucuggcagaauuacuguguccaccaagaggucacaacaggcuguaaucccaaacauagggagccggccccgcauuagaaauaucccuaguaggauuucuaucuacuggacaaucguuaaaccaggagauauucugcuaauaaacuccaccgguaaucucaucgccccgcggggcuacuucaagauucgcagcgggaaaucgucuaucaugcgauccgacgcgcccauaggaaaguguaagucagaaugcauuacgccuaacggcaguaucccaaaugacaaacccuuucagaacgugaauagaaucacuuauggugcauguccuagguacgucaagcagagcacacugaaacuugccaccgggaugcggaacgugccagagaagcaaacucguggaauuuucggcgcuaucgccggcuuuauugaaaaugggugggagggaaugguggaugguugguauggcuuccgccaccagaacuccgaggggagaggacaggcagcugaccugaaaucuacacaagccgcgauagaucagaucaauggcaaguugaacaggcucauugguaaaaccaaugaaaaguuccaccagaucgagaaggaauuuagcgaggucgaagggcggauccaggaccuggagaaauacguugaggauacgaagauugacuuauggucauauaacgccgaacugcucguggcacuugagaaccaacauaccauagaucugacagacagugaaaugaauaaauuguucgagaagacuaaaaagcagcuacgagaaaacgcugaggauaugggcaauggaugcuuuaagaucuaccacaaaugugacaacgccugcauuggcuccauccgcaaugggaccuaugaucauaacguauacagagacgaggcucugaauaacagguuccagauuaagggaguggaacucaaaagcgguuacaaggacuggauccuguggauaucuuuugccaucucaugcuuccuucugugugucgcauugcucggcuuuauuaugugggccugccagaaagggaauauccgguguaacauuugcaucuga

SEQ ID NO: 133808 - RNA, 1701 nt, Artificial Sequence; identical to SEQ ID NO: 131874
  derived and/or modified sequence opt3 from hemagglutinin__InfluenzaA__AHM00639

SEQ ID NO: 133809 - RNA, 1701 nt, Artificial Sequence; identical to SEQ ID NO: 131851
  derived and/or modified sequence opt3 from hemagglutinin__InfluenzaA__AHM00651

SEQ ID NO: 133810 - RNA, 1701 nt, Artificial Sequence; identical to SEQ ID NO: 132010
  derived and/or modified sequence opt3 from hemagglutinin__InfluenzaA__AHM00663

SEQ ID NO: 133811 - RNA, 1701 nt, Artificial Sequence; identical to SEQ ID NO: 131899
  derived and/or modified sequence opt3 from hemagglutinin__InfluenzaA__AHM00675

SEQ ID NO: 133812 - RNA, 1701 nt, Artificial Sequence; identical to SEQ ID NO: 132961
  derived and/or modified sequence opt3 from hemagglutinin__InfluenzaA__AHM00687

SEQ ID NO: 133813 - RNA, 1701 nt, Artificial Sequence
  derived and/or modified sequence opt3 from hemagglutinin__InfluenzaA__AHM00698
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgaccaaaucgaagugacuaaugcgaccgagcugguacagucuucaaguacaggugaaauuugcaacagcccacaccagauccuagauggcgagaauuguacccucauagacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacucuggaguuuaacaaugaguccuucaacuggacagguguuacccagaaugggacgucuagcgcuugcacucggcgcuccaacaauucauuuuucagucgacugaacuggcucacccacuuaaauuuuaaauacccagcacugaacgugacaaugcccaacaaugaacaguucgacaaguuguauaucuggggaguccaucacccuggcacugauaaggaccagauuuuucuuuacgcccaagcuagcggccguaucaccgugucuacaaaaagaucccagcaggccguaauuccaaacaucgggucaaggccccggguucgcaauauaccuagcagagugaguauuuauuggaccaucgucaagccaggagauauucugcuaaucaacucuacggguaaucucaucgcgccgaggggcuacuucaaaauucgguccggaaagagcucgauaaugcgcucugacgcacccaucgggaaauguaacuccgccugcauuacuccuaauggcucaaucccaaacgacaagcccuuucagaaugugaaccgaauaacauacggugcuuguccuagauaugugaagcaaaauacccugaaacuugccacugggaugaggaacgucccagagaagcagacacggggaauuuucggcgcaaucgcuggcuuuaucgaaaaugggugggagggaaugguugaugguugguacggcuuccgucaccagaacagugaggggcgcggacaagccgcggaccugaaaagcacccaggccgcaauugaucagaucaauggcaaguugaacagacucauugguaaaacgaacgaaaaguuccaucagauagagaaagaauuuuccgagguggaagggaggauccaagaccuggagaaguauguagaggauaccaagauugacuuauggucuuacaaugcugaacugcucguggcccuugagaaccagcacacaaucgaucugacugacagcgaaaugaauaaauuguucgagaagaccaaaaagcagcuacgggaaaacgcugaggauaugggcaauggaugcuuuaaaaucuaucauaagugugacaacgccugcauuggcucaauacgaaaugggacauacgaucacgacgucuaucgcgacgaggcacugaacaauagauuccagaucaagggaguggaacucaaaagugguuacaaggauuggauucuguggaucuccuuugccauuagcugcuuccuucuguguguugcuuugcucggcuuuaucaugugggcgugccaaaaagggaacauaagguguaauaucugcauuuga

SEQ ID NO: 133814 - RNA, 1701 nt, Artificial Sequence; identical to SEQ ID NO: 131874
  derived and/or modified sequence opt3 from hemagglutinin__InfluenzaA__AHM00710

SEQ ID NO: 133815 - RNA, 1701 nt, Artificial Sequence; identical to SEQ ID NO: 131874
  derived and/or modified sequence opt3 from hemagglutinin__InfluenzaA__AHM00722

SEQ ID NO: 133816 - RNA, 1701 nt, Artificial Sequence; identical to SEQ ID NO: 131874
  derived and/or modified sequence opt3 from hemagglutinin__InfluenzaA__AHM00734

SEQ ID NO: 133817 - RNA, 1701 nt, Artificial Sequence; identical to SEQ ID NO: 132009
  derived and/or modified sequence opt3 from hemagglutinin__InfluenzaA__AHM00746

SEQ ID NO: 133818 - RNA, 1701 nt, Artificial Sequence; identical to SEQ ID NO: 131874
  derived and/or modified sequence opt3 from hemagglutinin__InfluenzaA__AHM00758

SEQ ID NO: 133819 - RNA, 1701 nt, Artificial Sequence; identical to SEQ ID NO: 132042
  derived and/or modified sequence opt3 from hemagglutinin__InfluenzaA__AHM00770

SEQ ID NO: 133820 - RNA, 1701 nt, Artificial Sequence; identical to SEQ ID NO: 131851
  derived and/or modified sequence opt3 from hemagglutinin__InfluenzaA__AHM00782

SEQ ID NO: 133821 - RNA, 1701 nt, Artificial Sequence
  derived and/or modified sequence opt3 from hemagglutinin__InfluenzaA__AHM00794
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugauagaaucgaggugaccaacgccacagaacugguacaaaauucuucaauuggugagaucugcgacaguccacaccagauacuagauggcgaaaacuguacccucaucgacgcgcugcuuggggauccgcagugcgacggauuucagaauaaaaagugggaucuguucguggagaggagcaaggcuuauuccaacuguuaccccuaugacgucccugauuacgccucuuugcggucgcucguggcaucaagcggcacucuggaauuuaauaacgagaguuucaauuggacagguguuacccaaaacgggacguccucugccugcauucgccgaagcaauuccucauuuuucagucgucugaacuggcucacucauuuaaauuuuaaguauccagcucugaacgugaccaugcccaacaaugagcaguucgacaaacuuuacaucuggggaguccaccauccuggcacagauaaagaccagaucuuuuuguaugcacagagcucuggcagaauuacuguguccaccaagaggucacaacaggccguaauaccaaacauugggagccggccccgcaucagaaauauuccuaguaggaucucuaucuacuggacaauuguuaaaccaggagauauacugcuaaucaacuccaccgguaaucucauugcuccgcggggcuacuucaagauccgcagcgggaaaucgucuauaaugcgauccgacgcccccauuggaaaguguaagucagaaugcaucacgccuaacggcaguaucccaaaugacaaacccuuucagaacgugaauagaauuacuuauggugcguguccuagguacgucaagcagagcacacugaaacuugcaaccgggaugcggaacgugccagagaagcaaacucguggaaucuucggcgccauugcuggcuuuauagaaaaugggugggagggaaugguggaugguugguauggcuuccgccaccagaacuccgaggggagaggacaggccgcagaccugaaaucuacacaagcugccaucgaucagauuaauggcaaguugaacaggcucaucgguaaaaccaaugaaaaguuccaccagaucgagaaggaauuuagcgaggucgaagggcggauucaggaccuggagaaauacguugaggauacgaagauagacuuauggucauauaacgcggaacugcucguggcccuugagaaccaacauaccaucgaucugacagacagugaaaugaauaaauuguucgagaagacuaaaaagcagcuacgagaaaacgcagaggauaugggcaauggaugcuuuaagauuuaccacaaaugugacaacgcuugcaucggcuccauucgcaaugggaccuaugaucaugacguauacagagacgaggcccugaacaauagguuccagaucaagggaguggaacucaaaagcgguuacaaggauuggauacuguggaucucuuuugcuauuucaugcuuccuucugugugucgccuugcucggcuuuaucaugugggcaugccagaaagggaacauucgguguaauaucugcauauga

SEQ ID NO: 133822 - RNA, 1701 nt, Artificial Sequence; identical to SEQ ID NO: 132042
  derived and/or modified sequence opt3 from hemagglutinin__InfluenzaA__AHM00806

SEQ ID NO: 133823 - RNA, 1701 nt, Artificial Sequence
  derived and/or modified sequence opt3 from hemagglutinin__InfluenzaA__AHM00818
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaauuucaacuggacugguguuacacaaaaugggaccaguuccgcuugcauucgccgaucuaacagcuccuuuuucucacgucugaauuggcucacgcauuuaaacuuuaaguauccagcacugaacgugacuaugcccaauaacgagcaguucgacaaacuuuacaucuggggaguccaccauccuggcaccgauaaagaccagaucuuuuuguaugcccagaguagcggcagaauuacagugucuacuaagaggucccaacaggcuguaauaccaaauauugggucacggccccgcaucagaaacauuccuagcaggaucaguaucuacuggaccauuguuaaaccaggagauauacugcuaaucaauucuacagguaaccucauugccccgcggggcuacuucaagauccgcuccgggaaaagcucgauaaugcgaucugacgcgcccauuggaaaguguaaguccgaaugcaucaccccuaauggcucaaucccaaacgacaaacccuuucagaaugugaacagaauuacguauggugcauguccuagguacgucaagcagaguacucugaaacuugccacagggaugcggaaugugccagagaagcaaacccguggaaucuucggcgcuauugccggcuuuauagaaaacgggugggagggaaugguggaugguugguauggcuuccgccaccagaauagcgaggggagaggacaggcagcugaccugaaauccacucaagccgcgaucgaucagauuaacggcaaguugaauaggcucaucgguaaaacaaacgaaaaguuccaccagaucgagaaggaauuuucugaggucgaagggcggauucaggaccuggagaaauacguugaggauaccaagauagacuuauggagcuauaacgccgaacugcucguggcacuugagaaucaacauacgaucgaucugaccgacucagaaaugaacaaauuguucgagaagacaaagaagcagcuacgagaaaaugcugaggauaugggcaacggaugcuuuaagauuuaccacaaaugugacaaugccugcaucggcaguauucgcaacgggacuuaugaucaugacguauacagagacgaggcucugaauaacagguuccagaucaagggaguggaacucaaauccgguuacaaggauuggauacuguggaucagcuuugccauuucuugcuuccuucugugugucgcauugcucggcuuuaucaugugggccugccagaaagggaauauucgguguaacaucugcauauga

SEQ ID NO: 133824 - RNA, 1701 nt, Artificial Sequence; identical to SEQ ID NO: 131899
  derived and/or modified sequence opt3 from hemagglutinin__InfluenzaA__AHM00830

SEQ ID NO: 133825 - RNA, 1701 nt, Artificial Sequence; identical to SEQ ID NO: 131899
  derived and/or modified sequence opt3 from hemagglutinin__InfluenzaA__AHM00842

SEQ ID NO: 133826 - RNA, 1701 nt, Artificial Sequence; identical to SEQ ID NO: 133802
  derived and/or modified sequence opt3 from hemagglutinin__InfluenzaA__AHM00854

SEQ ID NO: 133827 - RNA, 1701 nt, Artificial Sequence; identical to SEQ ID NO: 133802
  derived and/or modified sequence opt3 from hemagglutinin__InfluenzaA__AHM00866

SEQ ID NO: 133828 - RNA, 1701 nt, Artificial Sequence; identical to SEQ ID NO: 131874
  derived and/or modified sequence opt3 from hemagglutinin__InfluenzaA__AHM00878

SEQ ID NO: 133829 - RNA, 1701 nt, Artificial Sequence; identical to SEQ ID NO: 131851
  derived and/or modified sequence opt3 from hemagglutinin__InfluenzaA__AHM00890

SEQ ID NO: 133830 - RNA, 1701 nt, Artificial Sequence; identical to SEQ ID NO: 131884
  derived and/or modified sequence opt3 from hemagglutinin__InfluenzaA__AHM00902

SEQ ID NO: 133831 - RNA, 1701 nt, Artificial Sequence; identical to SEQ ID NO: 131874
  derived and/or modified sequence opt3 from hemagglutinin__InfluenzaA__AHM00914

SEQ ID NO: 133832 - RNA, 1701 nt, Artificial Sequence; identical to SEQ ID NO: 131874
  derived and/or modified sequence opt3 from hemagglutinin__InfluenzaA__AHM00926

SEQ ID NO: 133833 - RNA, 1701 nt, Artificial Sequence; identical to SEQ ID NO: 131851
  derived and/or modified sequence opt3 from hemagglutinin__InfluenzaA__AHM00938

SEQ ID NO: 133834 - RNA, 1701 nt, Artificial Sequence
  derived and/or modified sequence opt3 from hemagglutinin__InfluenzaA__AHM00950
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgugucuuugcggucgcucguugcaucaagcggcacccuggaauuuaauaacgagaguuucaauuggacuggugugacacaaaacgggaccuccucugccugcauucgccgaagcaauuccucauuuuucagucgucugaacuggcucacgcauuuaaauuuuaaguauccagcucugaacgucacuaugcccaacaaugagcaguucgacaaacuuuacaucuggggagugcaccauccuggcaccgauaaagaccagaucuuuuuguaugcacagagcucuggcagaauuacaguauccacuaagaggucacaacaggccguuauaccaaacauugggagccggccccgcaucagaaauauuccuaguaggaucucuaucuacuggaccauugugaaaccaggagauauacugcuaaucaacuccacagguaaucucauugcuccgcggggcuacuucaagauccgcagcgggaaaucgucuauaaugcgauccgacgcccccauuggaaaguguaagucagaaugcaucaccccuaacggcaguaucccaaaugacaaacccuuucagaacgucaauagaauuacguauggugcguguccuagguacgugaagcagagcacucugaaacuugcaacagggaugcggaacgugccagagaagcaaacccguggaaucuucggcgccauugcuggcuuuauagaaaaugggugggagggaauggucgaugguugguauggcuuccgccaccagaacuccgaggggagaggacaggccgcagaccugaaaucuacucaagcugccaucgaucagauuaauggcaaguugaacaggcucaucgguaaaacaaaugaaaaguuccaccagaucgagaaggaauuuagcgagguugaagggcggauucaggaccuggagaaauacguggaggauaccaagauagacuuauggucauauaacgcggaacugcucguagcccuugagaaccaacauacgaucgaucugaccgacagugaaaugaauaaauuguucgagaagacaaagaagcagcuacgagaaaacgcagaggauaugggcaauggaugcuuuaagauuuaccacaaaugugacaacgcuugcaucggcuccauucgcaaugggacuuaugaucauaacguguacagagacgaggcccugaauaacagguuccagaucaagggagucgaacucaaaagcgguuacaaggacuggauacuguggaucucuuuugcuaugucaugcuuccuucuguguguggccuugcucggcuuuauuaugugggcaugccagaaagggaauauccgguguaacauuugcaucuga

SEQ ID NO: 133835 - RNA, 1701 nt, Artificial Sequence; identical to SEQ ID NO: 131851
  derived and/or modified sequence opt3 from hemagglutinin__InfluenzaA__AHM00962

SEQ ID NO: 133836 - RNA, 1701 nt, Artificial Sequence
  derived and/or modified sequence opt3 from hemagglutinin__InfluenzaA__AHM00974
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgaccaaaucgaagugacuaaugcgaccgagcugguacagucuucaaguacaggugaaauuugcaacagcccacaccagauccuagauggcgagaauuguacccucauagacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacucuggaguuuaacaaugaguccuucaacuggacagguguuacccagaaugggacgucuagcgcuugcauccggcgcuccaacaauucauuuuucagucgacugaacuggcucacucacuuaaauuuuaaauacccagcacugaacgugaccaugcccaacaaugaacaguucgacaaacuuuauauuuggggaguccaucacccuggcacagauaaggaccagaucuuuuuguacgcccaagcuagcggcgggauuacugugucuaccaagcguucccagcaggccguaaucccaaacauaggaucaagacccaggguucggaauauuccuagccgcgugaguaucuauuggacaauugucaagccaggugauauccugcuaaucaacucuaccggcaaucucauugcgccgagaggguacuucaaaauaagguccggaaagagcucgaucaugcggucugacgcacccauuggcaaauguaacuccgccugcaucacgccuaaugguucaauaccaaacgacaagcccuuucagaaugugaaccgcauuacuuacggggcuuguccucgauaugugaagcaaaauacacugaaacuugccaccggaaugagaaacgucccagagaagcagacuaggggcaucuucggcgcaaucgcuggguuuauugaaaauggaugggaggguaugguugauggcugguacggguuccggcaccagaacagugagggacguggccaagccgcggaccugaaaagcacacaggccgcaaucgaucagauuaaugguaaguugaaccgccucauagggaaaaccaacgaaaaguuccaucagaucgagaaagaauuuuccgagguggaaggcaggauucaagaccuggagaaguauguagaggauacgaagaucgacuuauggucuuacaaugcugaacugcucguggcccuugagaaccagcacaccaucgaucugacagacagcgaaaugaauaaauuguucgagaagacuaaaaagcagcuaagagaaaacgcugaggauaugggaaauggcugcuuuaaaauuuaucauaagugugacaacgccugcauagggucaauccggaauggaaccuacgaucacgacgucuaucgagacgaggcacugaacaaucgcuuccagauuaaggguguggaacucaaaaguggcuacaaggauuggauccuguggauuuccuuugccaucagcugcuuccuucuguguguugcuuugcucggguuuauaaugugggcgugccaaaaaggaaacaucagauguaauauuugcaucuga

SEQ ID NO: 133837 - RNA, 1683 nt, Artificial Sequence
  derived and/or modified sequence opt3 from hemagglutinin__InfluenzaA__AHM24224
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaacgcacaguggauuugggccaaugcggguuacugggaaccaucacuggcccaccgcagugugaccaguuucuagaguucucugcugaucucauaaucgaacgacgugaggguucagacguuugcuaccccgggaaguuugugaaagaggaagcccugagacagauucuuagggagaguggaggcaucgauaaggaagcaaugggcuucacauauagcgggauucggaccaacggagccacguccgcuugucgcagaucugguucgucauuuuacgcagagaugaaguggcuguugagcaauacugacaacgccgcuuucccucaaaugaccaaaaguuauaagaauacaaggaaauccccagcccucaucgucuggggcauacaccauucugugagcacugcggagcagaccaagcuguacggguccggaaacaaacugguaacaguuggcucaaguaauuaucagcagagcuuugugcccucuccuggugcacggccacaagucaacgggcucuccggacgcauugauuuccacugguuaaugcugaaucccaacgacaccgugacguuuucauucaauggcgccuuuaucgcuccugaucgagccagcuuccuuagaggcaagaguauggggauucagucuggagugcaggucgacgcaaacugcgaaggugauuguuaccauuccggcgggacuaucaucagcaacuugccauuucagaauauugacucgagggcuguuggaaagugcccgcgguaugugaaacaacguucucugcuacucgccacaggcaugaagaacguacccgagauaccuaaaggucgcgggcuguucggcgcgaucgccggauucauugaaaauggcugggaggggcuuaucgauggaugguacgguuuuagacaccagaacgcacagggcgaagggaccgcugccgacuacaaguccacucaaucagcuauagaccagauuacaggaaaacugaauagguugaucgagaagaccaaccagcaguucgagcucaucgauaaugaauuuaacgagguggaaaaacaaauuggcaaugucaucaacuggacgcgggacaguauuaccgagguguggagcuauaaugccgaacuguuaguugcaauggagaaccagcacacaauagaucuggccgacuccgagauggauaagcucuacgaacgagugaagcgccagcuuagagagaaugcugaagaggacgguacuggguguuucgaaaucuuucauaaaugcgaugacgauuguauggcgucuauuaggaacaauaccuaugaccacagcaaguaccgggaggaggcaaugcagaaccgcauccaaaucgauccagucaaacugucaaguggcuauaaggacgugauuuugugguucuccuuuggagccagcugcuucauacuacuggcuaucguaaugggccucguuuuuauuugcgugaaaaacgggaauaugagauguacaaucugcauuuga

SEQ ID NO: 133838 - RNA, 1683 nt, Artificial Sequence; identical to SEQ ID NO: 132004
  derived and/or modified sequence opt3 from hemagglutinin__InfluenzaA__AHM24236

SEQ ID NO: 133839 - RNA, 1683 nt, Artificial Sequence; identical to SEQ ID NO: 132004
  derived and/or modified sequence opt3 from hemagglutinin__InfluenzaA__AHM24248

SEQ ID NO: 133840 - RNA, 1701 nt, Artificial Sequence
  derived and/or modified sequence opt3 from hemagglutinin__InfluenzaA__AHM98309
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugaggucuucccgaagacaagcuccuggcccaaccacgacucaaauaagggugugaccgccgcuuguccucaugcaggggccaaaaguuuuuauaagaaccugauuuggcucguuaaaaagggaaauagcuacccaaaauuaucuaaguccuauaucaacgauaagggcaaagaaguacuggugcuuuggggcauacaccaccccucaacgacugcugaccaacagagcuuguaccagaaugccgaugcguacgucuucguggggaccagucgcuauucuaagaaauuuaagccugagaucgcaauucgaccaaaagugcgugaccaggagggaagaaugaacuacuauuggacacuggucgaacccggugauaagaucacuuucgaggccaccggcaaccuaguugugccuagguacgcuuuugccauggaacggaaugcaggguccggaauuaucauaagcgacacaccaguacaugauugcaacaccacgugucaaacuccgaaaggcgcuauuaauacaucgcuccccuuccagaacauccacccuauuaccaucgguaagugcccaaaguaugugaaaucuacuaagcugcgccuugccacagggcugagaaauguccccuccauccagucaaggggauuguuuggcgcgauugccggcuucauagaagggggauggaccgguaugguggacggcugguacggguaucaucaccagaacgaacaaggaaguggcuacgcagcugaccucaaaagcacgcagaaugccaucgauaagauuaccaacaaaguuaauuccgugaucgagaagaugaacacacaguuuacugcugucgguaaggaguucaaucaccuggaaaaacggauagagaacuuaaauaagaaaguggacgauggguuccuggacauuuggaccuacaacgccgaacuccuuguacuguuggagaaugaacgcacacuagauuaucaugacucuaacguuaagaaccuguacgagaaagugcgaaaucagcucaagaacaaugcaaaggagaucggcaacggauguuuugaguucuaucacaaaugcgauaauacuuguauggaaagcgucaagaacggcaccuacgacuauccuaaauacucagaagaggccaagcugaauagagaagagaucgauggggugaaacuugagaguacaaggauuuaucaaauccuggcuauuuacuccaccgucgcgagcucuuuggugcucguugugucacugggagcaauaaguuuuuggaugugcagcaacgguuccuuacagugccggaucuguauuuga

SEQ ID NO: 133841 - RNA, 1710 nt, Artificial Sequence
  derived and/or modified sequence opt3 from hemagglutinin__InfluenzaA__AHM98339
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagagcuuguaccagaacgccgacgcguacguguucgucgggaccagucgcuauucuaagaaauuuaagccugagauugcaauccgaccaaaagugcgugaucaggagggaagaaugaauuacuauuggacacugguggaacccggugacaagauuacuuucgaggccaccggcaaccuagucguuccuagguacgcuuuugccauggaacggaacgcaggguccggaaucauaauuagcgauacaccagugcaugacugcaauaccacgugucaaacuccgaaaggcgcuaucaacacaucgcucaccucucugcccuuccagaauauucacccuaucacuaucgguaagugcccaaaguauguaaaauccacaaaacuucgccuggccaccggguugagaaacgugcccucaauucagaguaggggacucuuuggcgcgauagccggcuucaucgaagggggauggacggguauggucgacggcugguacggguaucaucaccagaaugaacaaggaagcggcuacgcagcugaucugaaguccacccagaacgccauugacaagaucacaaauaaagugaacucuguuauagagaagaugaauacucaguuuaccgcuguggguaaggaguucaaccacuuagaaaaacggauugagaaucugaacaagaaagucgaugacggguuccucgauaucuggacauacaaugccgaacuucugguguugcuagagaacgaacgcacucuggacuaucaugauagcaauguaaagaaccucuacgagaaaguucgaaaccagcugaagaauaacgcaaaggagaucggcaauggauguuuugaguucuaucacaaaugcgacaacaccuguauggaaucagugaagaauggcacauacgauuauccuaaauacagugaagaggccaaacuuaacagagaagagauugacggggucaagcuggaguccaccaggaucuaucaaauuuuggcuauauacagcacuguggcgucuucacucguccuggugguuaguuuaggagcaaucagcuuuuggaugugcuccaaugguucucugcagugccggauuuguaucuga

SEQ ID NO: 133842 - RNA, 1701 nt, Artificial Sequence
  derived and/or modified sequence opt3 from hemagglutinin__InfluenzaA__AHM98350
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugagggagcagcucagcaguguguccucuuucgaacgguuugagauuuucccgaagacaagcuccuggcccaaucacgaugccaacaagggugucaccgcugcauguccucaugccggggcuaaaggauuuuauaagaaucugaucuggcuggugaaaaagggcaacucauacccaaaacucaguaagagcuauauaaaugacaagggcaaagaaguauuaguucugugggggauccaccaccccucuacgacugccgaucaacagucccuuuaccagaacgcggacaccuacguguucgucggaacaucacgcuauagcaagaaauuuaagccugagauugcaauccgaccaaaagugcgugaucaggaggguagaaugaauuacuauuggacuuugguggaacccggcgacaagauuaccuucgaggccacagggaaccuggucguuccuagguacgcuuuugccauggaacggaacgcaggaaguggcaucauaauuucugauaccccagugcaugacugcaauacgacuugucaaacaccgaaaggugcuaucaacaccucccuacccuuccagaauauucacccuaucacuaucgggaagugcccaaaguauguaaaaagcacaaagcuccgccuggccaccggacuuagaaacgugcccucgauucagucuaggggccuguuuggcgcgauagccggguucaucgagggagguuggacgggcauggucgacgggugguacggauaucaucaccagaaugaacaaggcuccgguuacgcagcugauuugaaaucaacccagaacgccauugacaagaucacaaauaaagugaacaguguuauagagaagaugaauacucaguuuaccgcuguggggaaggaguucaaccaccucgaaaaacggauugagaaucugaacaagaaagucgaugacggcuucuuagauaucuggacauacaaugccgaacugcucgugcuucuggagaacgaacgcacuuuggacuaucaugauagcaauguaaagaaccuauacgagaaaguucgaaaccagcugaagaauaacgcaaaggagaucggaaauggcuguuuugaguucuaucacaaaugcgacaacaccuguauggaauccgugaagaaugggacauacgauuauccuaaauacucugaagaggccaagcucaacagagaagagauugacggagucaaacuggagagcaccaggaucuaucaaauucuugcuauauacucaacuguggcgaguucccuggucuuggugguuagccucggugcaaucucuuuuuggaugugcucaaauggcagucugcagugccggauuuguaucuga

SEQ ID NO: 133843 - RNA, 1701 nt, Artificial Sequence; identical to SEQ ID NO: 128470
  derived and/or modified sequence opt3 from hemagglutinin__InfluenzaA__AHM98361

SEQ ID NO: 133844 - RNA, 1701 nt, Artificial Sequence; identical to SEQ ID NO: 128883
  derived and/or modified sequence opt3 from hemagglutinin__InfluenzaA__AHM98372

SEQ ID NO: 133845 - RNA, 1701 nt, Artificial Sequence; identical to SEQ ID NO: 128883
  derived and/or modified sequence opt3 from hemagglutinin__InfluenzaA__AHM98383

SEQ ID NO: 133846 - RNA, 1701 nt, Artificial Sequence; identical to SEQ ID NO: 128840
  derived and/or modified sequence opt3 from hemagglutinin__InfluenzaA__AHM98394

SEQ ID NO: 133847 - RNA, 1701 nt, Artificial Sequence
  derived and/or modified sequence opt3 from hemagglutinin__InfluenzaA__AHM98405
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggaacucagggagcagcugagcaguguguccucuuucaagcgguuugaaauuuucccgaagacaagcuccuggcccaaucacgauucaaacaaaggugucaccgccgcuuguccucaugcaggggccaagggauuuuauaaaaaucugaucuggcucgugaagaaaggcaacaguuacccaaaguuaagcaagucuuauauaaaugacaaaggcaaggagguacugguucuuugggggauccaccaccccuccacgacugcugaucaacagucauuguaccagaacgccgacaccuacguguucgucggaacaagccgcuauaguaaaaaguuuaaaccugaaauugcgauccgaccaaaggugcgugaucaggaggguagaaugaauuacuauuggacucugguggagcccggcgacaaaauuaccuucgaagcaacagggaaccuagucguuccuagguacgccuuugcuauggagcggaacgccggaucuggcaucauaauuuccgauaccccagugcaugacugcaauacgacuugucaaacaccgaagggugcaaucaacaccagccuccccuuccagaauauucacccuaucacuaucgggaagugcccaaaauauguaaagucgacaaaacugcgccuugcuaccggacugagaaacgugcccucuauucaguccaggggcuuguuuggcgccauagcgggguucaucgaaggagguuggacgggcauggucgacgggugguacggauaucaucaccagaaugagcaaggcucagguuacgccgcagaucucaagaguacccagaacgcuauugacaaaaucacaaauaaggugaacagcguuauagaaaagaugaauacucaguuuaccgccguggggaaagaguucaaccaccuggagaagcggauugaaaauuuaaacaaaaaggucgaugacggcuuccuggauaucuggacauacaaugcugagcuccuugugcuguuggaaaacgagcgcacucuagacuaucaugauuccaauguaaagaaccuguacgaaaagguucgaaaccagcucaagaauaacgccaaagagaucggaaauggcuguuuugaguucuaucacaagugcgacaacaccuguauggaaucugugaaaaaugggacauacgauuauccuaaguacagcgaggaagcaaaacugaacagagaggaaauugacggagucaaacuugagucaaccaggaucuaucaaauucuggccauauacaguacuguggcuuccagcuugguccucgugguuucucugggugcgaucucauuuuggaugugcaguaauggcagcuuacagugccggauuuguaucuga

SEQ ID NO: 133848 - RNA, 1701 nt, Artificial Sequence; identical to SEQ ID NO: 133847
  derived and/or modified sequence opt3 from hemagglutinin__InfluenzaA__AHM98416

SEQ ID NO: 133849 - RNA, 1701 nt, Artificial Sequence; identical to SEQ ID NO: 128840
  derived and/or modified sequence opt3 from hemagglutinin__InfluenzaA__AHM98427

SEQ ID NO: 133850 - RNA, 1701 nt, Artificial Sequence; identical to SEQ ID NO: 129058
  derived and/or modified sequence opt3 from hemagglutinin__InfluenzaA__AHM98438

SEQ ID NO: 133851 - RNA, 1701 nt, Artificial Sequence; identical to SEQ ID NO: 130202
  derived and/or modified sequence opt3 from hemagglutinin__InfluenzaA__AHM98449

SEQ ID NO: 133852 - RNA, 1701 nt, Artificial Sequence
  derived and/or modified sequence opt3 from hemagglutinin__InfluenzaA__AHM98460
augaaggccauccuggugguccuccuuugcaccuucgcuacagcaaacgccgacacucuguguauuggcuaccacgcgaauaacagcacggauaccguugacacaguguuggagaaaaauguaacugugacccauuccgucaacuuacuggaagauaagcacaaugggaaacuaugcaagcucagaggaguggcuccccugcaucuugguaaauguaacauagccggcuggauccuggggaauccugagugcgaaucuuugucaacagcaaguagcugguccuauauuguugagaccucuucgucagacaacggaacuuguuacccaggcgauuuuaucgacuaugaagaacucagggagcagcugagcaguguguccucuuucgaacgguuugagauuuucccgaagacaagcuccuggcccaaucacgauucaaacaagggugucaccgccgcuugcccucaugcaggggccaaaggauuuuacaagaaucugaucuggcucgugaaaaagggcaacaguuauccaaaauuaagcaagucuuacauaaaugacaagggcaaagaaguacugguucuuugggggauccaccaccccuccacgacugcugaucaacagucauuguaucagaacgccgacaccuacguguucgucggaacaagccgcuacaguaagaaauuuaagccugagauugcgauccgaccaaaagugcgugaucaggaggguagaaugaauuauuacuggacucugguggaacccggcgacaagauuaccuucgaggcaacagggaaccuagucguuccuagguaugccuuugcuauggaacggaacgccggaucuggcaucauaauuuccgauaccacggugcaugacuguaauacuacaugccaaaccccaaaaggugcaaucaacacuagccucccguuccagaauauucaccccaucacaaucgggaaguguccuaaguacguaaaaucgaccaagcugcgccuugcuacgggacugagaaacgugccaucuauucaguccaggggcuuguuuggcgccauagcgggguucaucgagggagguuggaccggcauggucgacgggugguauggauaccaucaccagaaugaacaaggcucagguuaugccgcagaucucaaaaguacacagaacgcuauugacaagaucacuaauaaagugaacagcguuauagagaagaugaauacccaguuuacagccguggggaaggaguucaaccaccuggaaaaacggauugagaauuuaaacaagaaagucgaugacggcuuccuggauaucuggacuuacaaugcugaacuccuugugcuguuggagaacgaacgcacccuagacuaccaugauuccaauguaaagaaccuguaugagaaaguucgaaaccagcucaagaauaacgccaaggagaucggaaauggcugcuuugaguucuaccacaaaugugacaacacaugcauggagucugugaagaaugggaccuaugauuaccccaaauauagcgaagaggcaaagcugaacagagaaaagauugacggagucaaacuugagucaacuaggaucuaccaaauucuggccauauauaguacgguggcuuccagcuugguccucgugguuucucugggugcgaucucauuuuggaugugcaguaauggcagcuuacagugucggauuugcaucuga

SEQ ID NO: 133853 - RNA, 1701 nt, Artificial Sequence; identical to SEQ ID NO: 128883
  derived and/or modified sequence opt3 from hemagglutinin__InfluenzaA__AHM98471

SEQ ID NO: 133854 - RNA, 1701 nt, Artificial Sequence
  derived and/or modified sequence opt3 from hemagglutinin__InfluenzaA__AHM98482
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugaucaggaggguagaaugaauuacuauuggacucugguggaacccggcgacaagauuaccuucgaggcaacagggaaccuagucguuccuagguacgccuuugcuauggaacggaacgccggaucuggcaucauaauuuccgauaccccagugcaugacugcaauacgacuugucaaacaccgaaaggugcaaucaacaccagccuccccuuccagaauauucacccuaucacuaucgggaagugcccaaaguauguaaaaucgacaaagcugcgccuugcuaccggacugagaaacgugcccucuauucaguccaggggcuuguuuggcgccauagcgggguucaucgagggagguuggacgggcauggucgacgggugguacggauaucaucaccagaaugaacaaggcucagguuacgccgcagaucucaaaaguacccagaacgcuauugacaagaucacaaauaaagugaacagcguuauagauaagaugaauacucaguuuaccgccguggggaaggaguucaaccaccuggagaaacggauugaaaauuuaaacaagaaagucgacgauggcuuccuggacaucuggacauacaaugcugagcuccuugugcuguuggaaaacgagcgcacucuagauuaucaugacuccaauguaaagaaccuguacgaaaaaguucgaaaccagcucaagaauaacgccaaggagaucggaaauggcuguuuugaguucuaucacaaaugcgauaacaccuguauggaaucugugaagaaugggacauacgacuauccuaaauacagcgaggaagcaaagcugaacagagaggaaauugauggagucaaacuugagucaaccaggaucuaucaaauucuggccauauacaguacuguggcuuccagcuugguccucgugguuucucugggugcgaucucauuuuggaugugcaguaauggcagcuuacagugccggauuuguaucuga

SEQ ID NO: 133855 - RNA, 1701 nt, Artificial Sequence
  derived and/or modified sequence opt3 from hemagglutinin__InfluenzaA__AHM98493
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucuaaguauuccaaaaaguuuaaaccugagauugcagugcgcccaaaggugcgagaccaggagggacguaugaacuacuauuggacccuggucgaacccggugauaaaaucacauucgaggccacuggcaaccuacucguuccuagauacgcuuuugccauggaaaggaaugcagggagcggaauuaucauaucggacaccccagugcaugauugcaacacaaccugucaaacgccgaagggcgcuauuaauacuucucugcccuuccagaacauccacccuauuacaaucgguaaguauccaaaauacguaaaguccaccaaacuucggcuggccacuggguugcgcaaugugcccucaauccagaguagaggacucuuuggcgcgauugccggcuucauagaagggggauggacagguauggucgacggcugguauggguaccaucaccagaacgaacaaggaagcggcuacgcagcugaccugaaguccacccagaaugccaucgauaaaauuacgaacaagguaaauucuguuaucgagaagaugaacacccaguuuacagcuguggguaaagaguucaaucacuuagaaaagaggauagagaaccugaauaaaaaggucgacgauggguuccucgacauuuggacuuauaacgccgaacuucugguguugcuagagaaugaacggacccuggauuaccaugacagcaacgugaaaaaccucuaugagaagguucgcucacagcugaagaauaacgcaaaagagaucggcaauggaugcuuugaguucuaccacaagugugauaacacaugcauggaaagugugaaaaauggcacuuaugacuacccuaaguauuccgaagaggccaaacuuaaccgagaagagaucgauggggucaagcuggagagcaccagaauuuaccaaaucuuggcuauuuacucuacaguggcgucaagucucguccuggugguuagcuuaggagcaauauccuuuuggauguguucuaaugguucgcugcagugcaggaucugcauuuga

SEQ ID NO: 133856 - RNA, 1701 nt, Artificial Sequence
  derived and/or modified sequence opt3 from hemagglutinin__InfluenzaA__AHM98504
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcgugaccaggagggaagaaugaacuacuauuggacacugguggaacccggugauaagauuacuuucgaggccaccggcaaccuagucguuccuagguacgcuuuugccauggaacggaaugcaggguccggaaucauaauuagcgacacaccagugcaugauugcaacaccacgugucaaacuccgaaaggcgcuaucaauacaucgcuccccuuccagaacauucacccuaucaccaucgguaagugcccaaaguauguaaaaucuacuaagcugcgccuugccacagggcugagaaaugugcccuccauucagucaaggggauuguuuggcgcgauagccggcuucaucgaagggggauggaccgguauggucgacggcugguacggguaucaucaccagaacgaacaaggaaguggcuacgcagcugaccucaaaagcacgcagaaugccauugauaagaucaccaacaaaguuaauuccgugauagagaagaugaacacacaguuuacugcuguggguaaggaguucaaucaccuggaaaaacggauugagaacuuaaauaagaaagucgacgauggguuccuggacaucuggaccuacaacgccgaacuccuugugcuguuggagaaugaacgcacacuagauuaucaugacucuaacguaaagaaccuguacgagaaaguucgaaaucagcucaagaacaaugcaaaggagaucggcaacggauguuuugaguucuaucacaaaugcgauaauacuuguauggaaagcgugaagaacggcaccuacgacuauccuaaauacucaaaggaagccaaacugaauagagaggaaauugauggggucaaacuugagaguacaaggaucuaucaaauucuggcuauauacuccaccguggcgagcucuuugguccucgugguuucacugggagcaaucaguuuuuggaugugcagcaacgguuccuuacagugccggauuuguaucuga

SEQ ID NO: 133857 - RNA, 1701 nt, Artificial Sequence; identical to SEQ ID NO: 128470
  derived and/or modified sequence opt3 from hemagglutinin__InfluenzaA__AHM98515

SEQ ID NO: 133858 - RNA, 1701 nt, Artificial Sequence
  derived and/or modified sequence opt3 from hemagglutinin__InfluenzaA__AHM98526
augaaggccauccuggugguccuccuucacaccuucgcuacagcaaacgccgacacucugugcauuggcuaccaugcgaauaacagcacggauaccguugacacaguguuggagaagaauguaacugugacccacuccgucaacuuacuggaagauaagcauaaugggaaacuauguaagcucagaggaguggcuccccugcaccuugguaaaugcaacauagccggcuggauccuggggaauccugagugugaaucuuugucaacagcaaguagcugguccuauauuguugagaccucuucgucagacaacggaacuugcuacccaggcgauuuuaucgacuaugaagaacucagggagcagcugagcaguguguccucuuucgaacgguuugagauuuucccgaagacaagcuccuggcccaaucaugauucaaacaagggugucaccgccgcuuguccucacgcaggggccaaaggauuuuacaagaaucugaucuggcucgugaaaaagggcaacaguuauccaaaauuaagcaagucuuacauaaaugacaagggcaaagaaguacugguucuuugggggauccaccaucccuccacgacugcugaucaacagucauuguaucagaacgccgacaccuacguguucgucggaacaagccgcuacaguaagaaauuuaagccugagauugcgauccgaccaaaagugcgugaucaggaggguagaaugaauuauuacuggacucugguggaacccggcgacaagauuaccuucgaggcaacagggaaccuagucguuccuagguaugccuuugcuauggaacggaacgccggaucuggcaucauaauuuccgauaccccagugcacgacugcaauacgacuugucaaacaccgaaaggugcaaucaacaccagccuccccuuccagaauauucauccuaucacuaucgggaagugcccaaaguacguaaaaucgacaaagcugcgccuugcuaccggacugagaaacgugcccucuauucaguccaggggcuuguuuggcgccauagcgggguucaucgagggagguuggacgggcauggucgacgggugguauggauaccaccaccagaaugaacaaggcucagguuaugccgcagaucuccggaguacccagaacgcuauugacaaaaucacaaauaaggugaacagcguuauagagaaaaugaauacucaguuuaccgccguggggaaggaguucaaccaucuggaaaagcgcauugagaauuuaaacaaaaaggucgaugacggcuuccuggauaucuggacauacaaugcugaacuccuuauccuguuggagaacgaacgaacucuagacuaccacgauuccaaugugaaaaaccuguaugagaagguaagaaaccagcucaaaaauaacgccaaggagauuggaaauggcuguuuugaguucuaccauaagugcgacaacaccuguauggagucuguuaaaaaugggacauaugauuacccuaaguauagcgaagaggcaaaacugaacagggaagagaucgacggagugaaacuugagucaacccggauuuaccaaauacuggccaucuauaguacugucgcuuccagcuuggugcucgucgugucucugggugcgauuucauuuuggaugugcaguaauggcagcuuacagugccguaucuguaucuga

SEQ ID NO: 133859 - RNA, 1701 nt, Artificial Sequence; identical to SEQ ID NO: 128470
  derived and/or modified sequence opt3 from hemagglutinin__InfluenzaA__AHM98537

SEQ ID NO: 133860 - RNA, 1701 nt, Artificial Sequence
  derived and/or modified sequence opt3 from hemagglutinin__InfluenzaA__AHM98548
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcgugaccaggagggaagaaugaacuacuauuggacacugguggaacccggugauaagauuacuuucgaggccaccggcaaccuagucguuccuagguacgcuuuugccauggaacggaaugcaggguccggaaucauaauuagcgacacaccagugcaugauugcaacaccacgugucaaacuccgaaaggcgcuaucaauacaucgcuccccuuccagaacauucacccuguaaccaucgguaagugcccaaaguaugugaaaucuacuaagcugcgccuugccacagggcugagaaauguccccuccauccagucaaggggauuguuuggcgcgauugccggcuucauagaagggggauggaccgguaugguggacggcugguacggguaucaucaccagaacgaacaaggaaguggcuacgcagcugaccucaaaagcacgcagaaugccaucgauaagauuaccaacaaaguuaauuccgugaucgagaagaugaacacacaguuuacugcugucgguaaggaguucaaucaccuggaaaaacggauagagaacuuaaauaagaaaguggacgauggguuccuggacauuuggaccuacaacgccgaacuccuuguacuguuggagaaugaacgcacacuagauuaucaugacucuaacguuaagaaccuguacgagaaagugcgaaaucagcucaagaacaaugcaaaggagaucggcaacggauguuuugaguucuaucacaaaugcgauaauacuuguauggaaagcgucaagaacggcaccuacgacuauccuaaauacucagaagaggccaagcugaauagagaagagaucgauggggugaaacuugagaguacaaggauuuaucaaauccuggcuauuuacuccaccgucgcgagcucuuuggugcucguugugucacugggagcaauaaguuuuuggaugugcagcaacgguuccuuacagugccggaucuguauuuga

SEQ ID NO: 133861 - RNA, 1701 nt, Artificial Sequence
  derived and/or modified sequence opt3 from hemagglutinin__InfluenzaA__AHM98559
augaaggccauccuggugguccuccuuuacaccuucgcuacagcaaaagccgacacucugugcauuggcuaucacgcgaacaauagcacggauaccguugacacaguguuggagaagaacguaacugugacccauuccgucaauuuacuggaagauaaacacaacgggaagcuauguaaacucagaggaguggcuccccugcaucuugguaagugcaauauagccggcuggauccuggggaacccugagugugaaucuuugucaacagcaaguagcugguccuacauuguugagaccucuucgucagacaauggaacuugcuauccaggcgauuuuaucaacuacgaggagcucagggagcagcugagcaguguguccucuuucgaacgguuugagauuuucccgaagacaagcuccuggcccaaucacgacucaaacaaaggugucaccgccgcuuguccucaugcaggggccaagaguuuuuauaaaaaucugaucuggcucgugaagaaaggaaacagcuacccaaaguuaucuaaguccuauauaaaugauaaaggcaaggaaguacugguucuuuggggcauccaccaccccucaacgacugcugaccaacagagcuuguaccagaacgccgaugcguacguguucgucgggaccagucgcuauucuaaaaaguuuaaaccugagauugcaauccgaccaaaggugcgugaccaggagggaagaaugaauuacuauuggacacugguggaacccggugauaaaauuacuuucgaggccaccggcaaccuagucguuccuagguacgcuuuugccauggaacggaacgcaggguccggaaucauaauuagcgacacaccagugcaugauugcaauaccacgugucaaacuccgaagggcgcuaucaacacaucgcuccccuuccagaauauucacccuaucaccaucgguaagugcccaaaauauguaaagucuacuaaacugcgccuugccacagggcugagaaacgugcccuccauucagucaaggggauuguuuggcgcgauagccggcuucaucgaagggggauggaccgguauggucgacggcugguacggguaucaucaccagaaugaacaaggaaguggcuacgcagcugaccucaagagcacgcagaacgccauugauaaaaucaccaauaaggugaacuccguuauagagaagaugaauacacaguuuacugcuguggguaaagaguucaaccaccuggaaaagcggauugagaauuuaaacaaaaaggucgacgauggguuccuggacaucuggaccuacaaugccgaacuccuugugcuguuggagaacgaacgcacacuagauuaucaugacucuaauguaaagaaccuguacgagaagguucgaaaccagcucaagaauaacgcaaaagagaucggcaauggauguuuugaguucuaucacaagugcgauaacacuuguauggaaagcgugaaaaauggcaccuacgacuauccuaaguacucagaagaggccaaacugaacagagaagagauugauggggucaaacuugagaguacaaggaucuaucaaauucuggcuauauacuccaccguggcgagcucuuugguccucgugguuucacugggagcaaucaguuuuuggaugugcagcaaugguuccuuacagugccggauuuguaucuga

SEQ ID NO: 133862 - RNA, 1701 nt, Artificial Sequence; identical to SEQ ID NO: 128840
  derived and/or modified sequence opt3 from hemagglutinin__InfluenzaA__AHM98570

SEQ ID NO: 133863 - RNA, 1701 nt, Artificial Sequence
  derived and/or modified sequence opt3 from hemagglutinin__InfluenzaA__AHM98581
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaggaguuggagcuacauuguugagaccuccucuucggacaacggaacuugcuauccaggcgauuuuaucgacuacgaggaacuccgggagcagcugucaagcgugaguuccuucaagcgcuuugaaauuuucccgaagacaucuagcuggcccaaucacgauuccaacaaaggugucaccgccgcuuguccucaugcaggggccaagggauuuuauaaaaaucugaucuggcucgugaagaaaggcaacucauacccaaaguuaaguaagagcuauauaaaugacaaaggcaaggagguacugguucuuugggggauccaccaccccucuacgacugcugaucaacaguccuuguaccagaacgccgacaccuacguguucgucggaacaucacgauauagcaaaaaguuuaaaccugaaauugcgauccguccaaaggugagagaucaggaggguaggaugaauuacuauuggacucugguggagcccggcgacaaaauuaccuucgaagcaacagggaaccuagucguuccucgguacgccuuugcuauggagcgcaacgccggaaguggcaucauaauuucugauaccccagugcaugacugcaauacgacuugucaaacaccgaagggugcaaucaacaccucccuccccuuccagaauauucacccuaucacuaucgggaagugcccaaaauauguaaagagcacaaaacugagacuugcuaccggacugaggaacgugcccucgauucagucucggggcuuguuuggcgccauagcgggguucaucgaaggagguuggacgggcauggucgacgggugguacggauaucaucaccagaaugagcaaggcuccgguuacgccgcagaucucaagucaacccagaacgcuauugacaaaaucacaaauaaggugaacaguguuauagaaaagaugaauacucaguuuaccgccguggggaaagaguucaaccaccuggagaagcgcauugaaaauuuaaacaaaaaggucgaugacggcuuccuggauaucuggacauacaaugcugagcuccuugugcuguuggaaaacgagcgaacucuagacuaucaugauagcaauguaaagaaccuguacgaaaagguuagaaaccagcucaagaauaacgccaaagagaucggaaauggcuguuuugaguucuaucacaagugcgacaacaccuguauggaauccgugaaaaaugggacauacgauuauccuaaguacucugaggaagcaaaacugaacagggaggaaauugacggagucaaacuugagagcacccggaucuaucaaauucuggccauauacucaacuguggcuaguuccuugguccucgugguuagccugggugcgaucucuuuuuggaugugcucaaauggcaguuuacagugccguauuuguaucuga

SEQ ID NO: 133864 - RNA, 1701 nt, Artificial Sequence; identical to SEQ ID NO: 128840
  derived and/or modified sequence opt3 from hemagglutinin__InfluenzaA__AHM98592

SEQ ID NO: 133865 - RNA, 1701 nt, Artificial Sequence; identical to SEQ ID NO: 128883
  derived and/or modified sequence opt3 from hemagglutinin__InfluenzaA__AHM98603

SEQ ID NO: 133866 - RNA, 1701 nt, Artificial Sequence; identical to SEQ ID NO: 128470
  derived and/or modified sequence opt3 from hemagglutinin__InfluenzaA__AHM98614

SEQ ID NO: 133867 - RNA, 1701 nt, Artificial Sequence; identical to SEQ ID NO: 133847
  derived and/or modified sequence opt3 from hemagglutinin__InfluenzaA__AHM98625

SEQ ID NO: 133868 - RNA, 1701 nt, Artificial Sequence; identical to SEQ ID NO: 133847
  derived and/or modified sequence opt3 from hemagglutinin__InfluenzaA__AHM98636

SEQ ID NO: 133869 - RNA, 1701 nt, Artificial Sequence
  derived and/or modified sequence opt3 from hemagglutinin__InfluenzaA__AHM98647
augaaggccauccuggugguccuccuuuacaccuucgcuacagcaaaagccgacacucugugcauuggcuaucacgcgaacaauagcacggauaccguugacacaguguuggagaagaacguaacugugacccauuccgucaauuuacuggaagauaaacacaacgggaagcuauguaaacucagaggaguggcuccccugcaucuugguaagugcaauauagccggcuggauccuggggaacccugagugugaaucuuugucaacagcaaguagcugguccuacauuguugagaccucuucgucagacaauggaacuugcuauccaggcgauuuuaucaacuacgaggagcucagggagcagcugagcaguguguccucuuucgaacgguuugagauuuucccgaagacaagcuccuggcccaaucacgacucaaacaaaggugucaccgccgcuuguccucaugcaggggccaagaguuuuuauaaaaaucugaucuggcucgugaagaaaggaaacagcuacccaaaguuaucucaauccuauauaaaugauaagggcaaagaaguacugguucuuuggggcauccaccaccccucaacgacugcugaccagcagagcuuguaccagaacgccgaugcguacguguucgucgggaccagucgcuauucuaagaaauuuaagccugagauugcaauccgaccaaaagugcgugaccaagagggaagaaugaauuacuauuggacacugguggaacccggugauaagauuacuuucgaggccaccggcaaccuagucguuccuagguacgcuuuugccauggaacggaacgcaggguccggaaucauaauuagcgacacaccagugcaugauugcaauaccacgugucagacuccgaaaggcgcuaucaacacaucgcuccccuuccagaauauucacccuaucaccaucgguaagugcccaaaguauguaaaaucuacuaagcugcgccuugccacagggcugagaaacgugcccuccauucagucaaggggauuguuuggcgcgauagccggcuucaucgaagggggauggaccgguauggucgacggcugguacggguaucaucaccaaaaugaacagggaaguggcuacgcagcugaccucaaaagcacgcagaacgccauugauaagaucaccaauaaagugaacuccguuauagagaagaugaauacacaguuuacugcuguggguaaggaguucaaccaccuggaaaaacggauugagaauuuaaacaagaaagucgacgauggguuccuggacaucuggaccuacaaugccgaacuccuugugcuguuggagaacgaacgcacacuagauuaucaugacucuaauguaaagaaccuguacgagaaaguucgaaaccaacucaagaauaacgcaaaggagaucggcaauggauguuuugaguucuaucacaaaugcgauaacacuuguauggaaagcgugaagaauggcaccuacgacuauccuaaauacucagaagaggccaagcugaacagagaagagauugauggggucaaacuugagaguacaaggaucuaucagauucuggcuauauacuccaccguggcgagcucuuugguccucgugguuucacugggagcaaucaguuuuuggaugugcagcaaugguuccuuacagugccggauuuguaucuga

SEQ ID NO: 133870 - RNA, 1701 nt, Artificial Sequence; identical to SEQ ID NO: 128883
  derived and/or modified sequence opt3 from hemagglutinin__InfluenzaA__AHM98658

SEQ ID NO: 133871 - RNA, 1701 nt, Artificial Sequence; identical to SEQ ID NO: 128840
  derived and/or modified sequence opt3 from hemagglutinin__InfluenzaA__AHM98669

SEQ ID NO: 133872 - RNA, 1701 nt, Artificial Sequence; identical to SEQ ID NO: 130202
  derived and/or modified sequence opt3 from hemagglutinin__InfluenzaA__AHM98701

SEQ ID NO: 133873 - RNA, 1701 nt, Artificial Sequence; identical to SEQ ID NO: 130202
  derived and/or modified sequence opt3 from hemagglutinin__InfluenzaA__AHM98712

SEQ ID NO: 133874 - RNA, 1701 nt, Artificial Sequence
  derived and/or modified sequence opt3 from hemagglutinin__InfluenzaA__AHM98723
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaacugcaauauagccggcuggauccuggggaacccugagugugaaucuuugucaacagcaaguagcugguccuacauuguugagaccucuucgucagacaauggaacuugcuauccaggcgauuuuaucaacuacgaggagcucagggagcagcugagcaguguguccucuuucgaacgguuugagauucugccgaaaacaagcuccuggcccaaucacgacucaaacaagggugucaccgccgcuuguccucaagcaggggccaagaguuucuauaaaaaucucaucugguuagugaagaaaggaaacagcuacccaaagcugucuaaauccuauauaaaugauaagggcaaggaaguacuuguuuuguggggcauccaucaccccucaacgagcgcugaccagcagagucuguaccagaacgccgaugcguacguguuugucgggacuucuaaauauuccaagaaauucaagccugagauugcagugcgcccaaaagugcgagaccaagagggacguaugaacuacuauuggacccuaaucgaacccggugauaagauuacauuugaggccacuggcaaucuccuggucccuagauacgcuuucgccauggaaaggaacgcagggagcggaaucauaauuucggacaccccaguucacgauugcaauacaaccugucagacgccgaaaggcgcuaucaacacuucucuucccuuucagaauauucauccuaucacaaucgguaagugcccaaaguaugugaaauccaccaagcugcgguuggccacugggcuccgcaacguacccucaauucagaguagaggacuguucggcgcgauagccggcuuuaucgaagggggauggacagguaugguggacggcugguacggguaucaccaucaaaaugcacagggaagcggcuacgcugccgacuuaaaauccacccagaacgcuauugauaagaucacgaauaaagucaacucugugauagaaaagaugaauacccaguucacagccguugguaaggaguuuaaccaccuggagaaaaggauugaaaaucucaacaagaaaguggacgauggguuccuugacaucuggacuuacaaugcagagcuguugguccuacuggaaaacgagcggacccucgauuaucacgacagcaacgugaagaaucuguacgaaaaaguacgcucacaacuuaagaacaaugccaaggagaucggcaacggauguuucgaguuuuaucauaaaugcgauaauacauguauggaaaguguuaagaacggcacuuacgacuauccucgauacuccgaggaagcuaaacugaauagagaggaaauugauggggugaaguuggagagcaccaggaucuaucagauucucgcgauauacucuacagucgcaucaagucugguguuaaucgucagccugggagccauuuccuucuggaugugcucuaacgguucgcuacagugccggaucuguaucuga

SEQ ID NO: 133875 - RNA, 1701 nt, Artificial Sequence
  derived and/or modified sequence opt3 from hemagglutinin__InfluenzaA__AHM98734
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaacauugucuaccgcaucaaguuggagcuacauuguugagacuuccaacucugacaauggaacaugcuauccaggcgauuuuaucgacuacgaagaacucagggagcagcugucgucagugagcaguuucgaacgguuugagauuuucccgaagaccuccucuuggcccaaccacgauagcaauaagggugucacggccgcuuguccucaugcaggguccaaaggauuuuauaagaaccugaucuggcucgugaaaaagggcaauucauacccaaaauuaaguaagagcuauauaaacgacaagggcaaagaaguacugguucuuugggggauccaccaccccucuacuaccgccgaucaacaguccuuguaccagaaugcugacacauacguguucgucggaacuucacgcuauagcaagaaauuuaagccugagauugccauccgaccaaaagugcgugaucaggaggguagaaugaacuacuauuggacccugguggaacccggcgacaagauuacauucgaggcgaccgggaaccuagucguuccuagguacgcauuugccauggaacgggaugcuggaaguggcaucauaauuucugacacgccagugcaugacugcaauacuacaugucaaaccccgaaaggugccaucaacacuucccuccccuuccagaauauucacccuaucacaaucgggaagugcccaaaguauguaaaaagcaccaagcugcgccuugcaacgggacugagaaacgugcccucgauucagucuaggggcuuguuuggcgcuauagccggguucaucgagggagguuggaccggcauggucgaugggugguacggauaucaucaccagaaugaacaaggcuccgguuacgcggccgaccucaaaucaacacagaacgcaauugauaagaucacuaauaaagugaacaguguuauagagaagaugaauacccaguuuacagcuguggggaaggaguucaaccaccuggaaaaacggauugagaauuuaaacaagaaagucgacgauggcuuccuggacaucuggacuuacaaugccgaacuccuugugcuguuggagaacgaacgcacccuagauuaucaugacagcaauguaaagaaccuguacgagaaaguucgaaaccagcucaagaauaacgcuaaggagaucggaaauggcuguuuugaguucuaucacaaaugcgauaacacauguauggaguccgugaagaaugggaccuacgacuauccuaaauacucugaagaggccaagcugaacagagaagagauugauggagucaaacuugagagcacuaggaucuaucaaauucuggcaauauacucaacggccgcuaguuccuuggugcucgucgugagccugggugcgaucucuuuuuggaugugcucaaauggcaguuuacagugccggauuuguaucuga

SEQ ID NO: 133876 - RNA, 1701 nt, Artificial Sequence; identical to SEQ ID NO: 130202
  derived and/or modified sequence opt3 from hemagglutinin__InfluenzaA__AHM98745

SEQ ID NO: 133877 - RNA, 1701 nt, Artificial Sequence
  derived and/or modified sequence opt3 from hemagglutinin__InfluenzaA__AHM98756
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaacauugucuaccgcaucaaguuggagcuacauuguugagacuuccucuucggacaacggaacaugcuauccaggcgauuuuaucgacuacgaggaacucagggagcagcugucaagcgugaguuccuucgaacgguuugagauuuucccgaagaccucuagcuggcccaaucacgauuccaacaagggugucacggccgcuuguccucaugcaggggccaaaggauuuuauaagaaucugaucuggcucgugaaaaagggcaacucauacccaaaauuaaguaagagcuauauaaaugacaagggcaaagaaguacugguucuuugggggauccaccaccccucuacuaccgcugaucaacaguccuuguaccagaacgccgacacauacguguucgucggaacuucacgcuauagcaagaaauuuaagccugagauugcgauccgaccaaaagugcgugaucaggaggguagaaugaauuacuauuggacccugguggaacccggcgacaagauuacauucgaggcaaccgggaaccuagucguuccuagguacgccuuugcuauggaacgggaugccggaaguggcaucauaauuucugacacgccagugcaugacugcaacacuacaugucaaaccccgaaaggugcaaucaauacuucccuccccuuccagaacauucacccuaucacaaucgggaagugcccaaaguauguaaaaagcaccaagcugcgccuugcuacgggacugagaaaugugcccucgauucagucuaggggcuuguuuggcgccauagcgggguucaucgagggagguuggaccggcauggucgaugggugguacggauaucaucaccagaacgaacaaggcuccgguuacgccgcagaccucaaaucaacacagaaugcuauugauaagaucacuaacaaagugaauaguguuauagugaagaugaacacccaguuuacagccgucgggaaggaguucaaucaccuggagaaacggauugaaaacuuaaauaagaaaguggacgauggcuuccuggacaucuggacuuacaacgcugagcuccuuguacuguuggaaaaugagcgcacccuagauuaucaugacagcaacguuaagaaucuguacgaaaaagugcgaaaccagcucaagaacaaugccaaggagaucggaaacggcuguuuugaguucuaucacaaaugcgauaauacauguauggaauccgucaagaacgggaccuacgacuauccuaaauacucugaggaagcaaagcugaauagagaggaaauugauggagugaaacuugagagcacuaggaucuaucaaauucuggccauauacucaacggcugcgaguuccuugguccucgugguuagccugggugcaaucucuuuuuggaugugcucaaacggcaguuuacagugccggauuuguaucuga

SEQ ID NO: 133878 - RNA, 1701 nt, Artificial Sequence; identical to SEQ ID NO: 130202
  derived and/or modified sequence opt3 from hemagglutinin__InfluenzaA__AHM98767

SEQ ID NO: 133879 - RNA, 1701 nt, Artificial Sequence
  derived and/or modified sequence opt3 from hemagglutinin__InfluenzaA__AHM98778
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaauagaaaacuauguaagcucagggguguggcuccccugcaucuuggaaaaugcaacauagccgguuggauccugggcaauccugagugugaaucuuugucaacagcaaguagcugguccuacauuguugagaccucuucgucagacaacgggacuugcuauccaggagauuuuaucaauuacgaagaacuccgggagcagcugagcaguguguccucuuucgaacgcuuugagauuuucccgaagacaagcuccuggcccaaccacgacucaaauaagggcgucaccgccgcuuguccucgagcaggggccaaaaguuuuuauaagaaccugaucuggcucgugaaaaaggggaauagcuacccaaaauuaucuaaguccuauauaaacgauaagggaaaagaaguacugguucuuuggggcauccaucaccccucaacgacugcugaccaacagagcuuguaccagaaugccgaugcguacguguucgucggcaccagucguuauucuaagaaauuuaagccugagauugcaaucagaccaaaagugagggaccaggaggggcggaugaacuacuauuggacacugguggaacccggagauaagauuacuuucgaggccaccgguaaccuacucgucccucgcuacgcuuuugccauggaaagaaaugcaggcuccgggaucauaauuagcgacacaccaguucacgauugcaacaccacgugucaaacuccgaaaggagcuaucaauacaucgcugcccuuccagaacauucauccuaucaccaucggcaagugcccaaaguaugugaaaucuacuaagcugaggcuugccacagguuugcggaauguacccuccauucagucacgcgggcucuuuggagcgauagccggcuucaucgagggcggguggaccggaaugguggacgguugguacggcuaucaccaucagaacgaacaagggaguggauacgcagcugaccugaaaagcacgcagaaugccauugauaagaucaccaacaaagucaauuccgugauagagaagaugaacacacaguuuacugcuguuggcaaggaguucaaucacuuagaaaaacgaauugagaaccugaauaagaaaguggacgaugguuuccucgacaucuggaccuacaacgccgaacuucuggucuugcuagagaaugaaagaacacuggauuaucacgacucuaacgugaagaaccucuacgagaaaguaaggaaucagcugaagaacaaugcaaaggagaucgggaacggcuguuuugaguucuaucauaaaugcgauaauacuuguauggagagcguuaagaacggaaccuacgacuauccuaaauacucagaagaggccaaacuuaaucgggaagagauugauggcgugaagcuggagaguacacguaucuaucaaauuuuggcuauauacuccaccgucgcgagcucucucgugcuggucgugucauuaggggcaaucaguuuuuggaugugcagcaacggaucccugcagugccgcauuuguaucuga

SEQ ID NO: 133880 - RNA, 1701 nt, Artificial Sequence; identical to SEQ ID NO: 129066
  derived and/or modified sequence opt3 from hemagglutinin__InfluenzaA__AHM98798

SEQ ID NO: 133881 - RNA, 1701 nt, Artificial Sequence; identical to SEQ ID NO: 128840
  derived and/or modified sequence opt3 from hemagglutinin__InfluenzaA__AHM98809

SEQ ID NO: 133882 - RNA, 1701 nt, Artificial Sequence; identical to SEQ ID NO: 128840
  derived and/or modified sequence opt3 from hemagglutinin__InfluenzaA__AHM98820

SEQ ID NO: 133883 - RNA, 1701 nt, Artificial Sequence; identical to SEQ ID NO: 128840
  derived and/or modified sequence opt3 from hemagglutinin__InfluenzaA__AHM98831

SEQ ID NO: 133884 - RNA, 1701 nt, Artificial Sequence
  derived and/or modified sequence opt3 from hemagglutinin__InfluenzaA__AHM98836
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugagggagcagcucagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcuggugaaaaagggcaacaguuacccaaaacucagcaagucuuauauaaaugacaagggcaaagaaguauuaguucugugggggauccaccaccccuccacgacugcugaucaacagucacuuuaccagaacgccgacaccuacguguucgucggaacaagccgcuauaguaagaaauuuaagccugagauugcgauccgaccaaaagugcgugaucaggaggguagaaugaauuacuauuggauuuugguggaacccggcgacaagaucacuuucgaggcaaccgggaaccuggucguuccuagguacgccuuugcuauggaacggaacgccggaucuggcauaauuaucuccgauacaccagugcaugacugcaauaccacgugucaaacuccgaaaggugcaauuaacacaagccuacccuuccagaauauccacccuaucaccauugggaagugcccaaaguauguaaaaucgacuaagcuccgccuggcuacaggacuuagaaacgugcccucuauacaguccaggggccuguuuggcgccaucgcgggguucauugagggagguuggaccggcauggucgacgggugguacggauaucaucaccagaaugaacaaggcucagguuacgccgcagauuugaaaaguacgcagaacgcuaucgacaagauaaccaauaaagugaacagcguuauugagaagaugaauacacaguuuacugccguggggaaggaguucaaccaccucgaaaaacggaucgagaaucugaacaagaaagucgaugacggcuucuuagauaucuggaccuacaaugcugaacugcucgugcuucuggagaacgaacgcacauuggacuaucaugauuccaauguaaagaaccuauacgagaaaguucgaaaccagcugaagaauaacgccaaggagauuggaaauggcuguuuugaguucuaucacaaaugcgacaacacuuguauggaaucugugaagaaugggaccuacgauuauccuaaauacagcgaagaggcaaagcucaacagagaagagaucgacggagucaaacuggagucaacaaggauuuaucaaauacuugccaucuacaguaccguggcuuccagccuggucuuggugguuucucucggugcgauuucauuuuggaugugcaguaauggcagccugcagugccggaucuguaucuga

SEQ ID NO: 133885 - RNA, 1701 nt, Artificial Sequence
  derived and/or modified sequence opt3 from hemagglutinin__InfluenzaA__AHM98847
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacgacgggaaacuguguaagcuaagaggaguggcuccccuccaucuggguaaaugcaauauagccggcuggauccuugggaacccugagugugaaucucugucaacagcaaguagcugguccuacauuguugagaccucuucgucagauaauggaacuugcuauccaggcgacuuuaucgauuacgaagaguugagggagcagcucagcaguguguccucuuucgaacgguuugagauuuucccgaagacaagcuccuggcccaaccacgacucaaauaagggugucaccgccgcuuguccucaugcaggggccaaaggauuuuauaagaaccugaucuggcuggugaaaaagggcaauaguuacccaaaacucagcaagucuuauauaaacgauaagggcaaagaaguauuaguucugugggggauccaccaccccuccacgacugcugaccaacagucacuuuaccagaaugccgauaccuacguguucgucggaacaagccgcuauaguaagaaauuuaagccugagauugcgauccgaccaaaagugcgugaccaggaggguagaaugaacuacuauuggacuuugguggaacccggcgauaagauuaccuucgaggcaacagggaaucuggucguuccuagguacgccuuugcuauggaacggaacgccggaucuggcaucauaauuuccgacaccccagugcaugacugcaacacgacuugucaaacaccgaaaggugcaaucaauaccagccuacccuuccagaacauucacccuaucacuaucgggaagugcccaaaguauguaaaaucgacaaagcuccgccuggcuaccggacuuagaaaugugcccucuauucaguccaggggccuguuuggcgccauagcgggguucaucgagggagguuggacgggcauggucgaugggugguacggauaucaucaccagaacgaacaaggcucagguuacgccgcagacuugaaaaguacccagaaugcuauugauaagaucacaaacaaagugaauagcguuauagagaagaugaacacucaguuuaccgccguggggaaggaguucaaucaccucgaaaaacggauugagaaccugaauaagaaagucgacgauggcuucuuagacaucuggacauacaacgcugaacugcucgugcuucuggagaaugaacgcacuuuggauuaucaugacuccaacguaaagaaucuauacgagaaaguucgaaaccagcugaagaacaaugccaaggagaucggaaacggcuguuuugaguucuaucacaaaugcgauaauaccuguauggaaucugugaagaacgggacauacgacuauccuaaauacagcgaagaggcaaagcucaauagagaagagauugauggagucaaacuggagucaaccaggaucuaucaaauucuugccauauacaguacuguggcuuccagccuggucuuggugguuucucucggugcgaucucauuuuggaugugcaguaacggcagccugcagugccggauuuguaucuga

SEQ ID NO: 133886 - RNA, 1701 nt, Artificial Sequence; identical to SEQ ID NO: 128840
  derived and/or modified sequence opt3 from hemagglutinin__InfluenzaA__AHM98858

SEQ ID NO: 133887 - RNA, 1701 nt, Artificial Sequence; identical to SEQ ID NO: 128883
  derived and/or modified sequence opt3 from hemagglutinin__InfluenzaA__AHM98877

SEQ ID NO: 133888 - RNA, 1701 nt, Artificial Sequence
  derived and/or modified sequence opt3 from hemagglutinin__InfluenzaA__AHM98898
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaaucacaacgggaagcuauguaaacucagaggaguggcuccccugcaucuugguaagugcaauauagccggcuggauccuggggaacccugagugugaaucuuugucaacagcaaguagcugguccuacauuguugagaccucuucgucagacaauggaacuugcuauccaggcgauuuuaucaacuacgaggagcucagggagcagcugagcaguguguccucuuucgaacgguuugagauuuucccgaaaacaagcuccuggcccaaucacgacucaaacaagggugucaccgccgcuuguccucaugcaggggccaagaguuuuuauaaaaaucugaucuggcucgugaagaaaggaaacagcuacccaaaguuaucuaaauccuauauaaaugauaagggcaaggaaguacugguucuuuggggcauccaccaccccucaacgacugcugaccaacagagcuuguaccagaacgccgaugcguacguguucgucgggaccagucgcuauucuaaaaaguuuaaaccugagauugcaauccgaccaaaggugcgugaccaggagggaagaaugaacuacuauuggacacugguggaacccggugauaaaauuacuuucgaggccaccggcaaucuagucguuccuagguacgcuuuugccauggaacggaacgcaggguccggaaucauaauuagcgacacaccagugcaugauugcaauaccacgugucaaacuccgaagggcgcuaucaacacaucgcuccccuuccagaauauucacccuaucaccaucgguaaaugcccaaaguauguaaagucuacuaaacugcgccuugccacagggcugagaaacgugcccuccauucagucaaggggauuguuuggcgcgauagccggcuucaucgaagggggauggaccgguauggucgacggcugguacggguaucaucaccagaaugaacaaggaaguggcuacgcagcugaccucaagagcacgcagaacgccauugauaaaaucaccaauaaggugaacuccguuauagagaaaaugaauacacaguuuacugcuguggguaaggaguucaaccaccuggaaaagcggauugagaauuuaaacaaaaaggucgacgauggguuccuggacaucuggaccuacaaugccgaacuccuugugcuguuggagaacgaacgcacacuagauuaucaugacucuaacguaaagaaucuguacgagaagguucgaaaccagcucaaaaauaacgcaaaggagaucggcaauggauguuuugaguucuaucacaagugcgauaacacuuguauggaaagcgugaaaaauggcaccuacgacuauccuaaguacucagaagaggccaaacugaacagagaagagauugauggggucaaacuugagaguacaaggaucuaucaaauucuggcuauauacuccaccguggcgagcucuuugguccucgugguuucacugggagcaaucaguuuuuggaugugcagcaaugguuccuuacagugccggauuuguaucuga

SEQ ID NO: 133889 - RNA, 1701 nt, Artificial Sequence; identical to SEQ ID NO: 132466
  derived and/or modified sequence opt3 from hemagglutinin__InfluenzaA__AHM98909

SEQ ID NO: 133890 - RNA, 1701 nt, Artificial Sequence
  derived and/or modified sequence opt3 from hemagglutinin__InfluenzaA__AHM98932
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucggagguguggcuccccugcaucuuggcaaaugcaacauagccggguggauccugggaaauccugagugugaaucuuugucaacagcaaguagcugguccuacauuguugagaccucuucgucagacaacggcacuugcuauccaggugauuuuaucgacuacgaagaacucagagagcagcugagcaguguguccucuuucgaaagguuugagauuuucccgaagacaagcuccuggcccaaucacgauucaaacaagggggucaccgccgcuuguccucaugcaggagccaaaaguuuuuauaagaaucugaucuggcucgugaaaaagggcgacagcuacccaaaauuaucuaaguccuauauaaacgauaagggcaaagaaguacugguucuuugggggauccaccaccccucaacgagcgcugaccaacagaguuuguaccagaaugccgaugcguacguguucgucggaucuucccgguauagcaagaaauuuaagccugagauugcaauccgcccaaaagugcgagaccgugaggguagaaugaacuacuauuggacucugguggaacccggcgauaagauuaccuucgaggccacagggaaucuagucguuccuagguacgcuuuugccauggaacggaacgcaggaucgggcaucauaauuucugacacuccagugcaugacugcaacaccacaugucagaccccgaaaggugcuaucaauacgucccuccccuuccaaaacauucacccuaucacuaucgggaagugcccaaaguauguaaaaucaacaaagcugcgccuugccaccggacugagaaaugugcccaguauucagagcaggggcuuguuuggcgcgauagccggguucaucgagggagguuggacuggcauggucgaugggugguacggauaucaucaccagaacgaacagggcuccgguuacgcagcugaccucaaaucuacacaaaaugccauugaugagaucaccaacaaggugaauagcguuauagagaaaaugaacacgcaguuuaccgcuguggggaaggaguucaaucaccuggagaagcggauugaaaacuuaaauaaaaaggucgacgauggcuuccuggacaucuggacauacaacgccgagcuccuugugcuguuggaaaaugagcgcacucuagauuaucaugacucaaacguaaagaaucuguacgagaagguucgaagucagcucaaaaacaacgcaaaggaaaucggaaauggcuguuuugaguucuaucacaagugcgauaacaccuguauggaauccgugaaaaaugggacauacgacuauccuaaguacagcgaggaagccaaacugaacagagaggagauugauggagucaaacuugaaucuacuaggaucuaucagauucuggcuauauacucaaccguggcgaguagcuugguccucgugguuucccugggugcaaucucuuuuuggaugugcucgaauggcagcuuacaaugccggauuuguaucuga

SEQ ID NO: 133891 - RNA, 1701 nt, Artificial Sequence; identical to SEQ ID NO: 133890
  derived and/or modified sequence opt3 from hemagglutinin__InfluenzaA__AHM98940

SEQ ID NO: 133892 - RNA, 1701 nt, Artificial Sequence; identical to SEQ ID NO: 133890
  derived and/or modified sequence opt3 from hemagglutinin__InfluenzaA__AHM98951

SEQ ID NO: 133893 - RNA, 1701 nt, Artificial Sequence
  derived and/or modified sequence opt3 from hemagglutinin__InfluenzaA__AHM98975
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgaaucaaacaagggugucaccgccgcuuguccucaugcaggggccaaaaguuuuuauaagaaucugaucuggcucgugaaaaagggaaacagcuacccaaaauuaucuaaguccuauauaaaugauaagggcaaagagguacugguucuuuggggcauccaccaccccucaacgagcgcugaccaacagaguuuguaccagaacgccgaugcguacguguucgucgggucuucccgcuauagcaagaaauuuaagccugagauugcaauccgaccaaaagugcgugaccaggaaggaagaaugaauuacuauuggacucugguggagcccggugauaagauuaccuucgaagccacaggcaaccuagucguuccuagguacgcuuuugccauggagcggaacgcagggucgggaaucauaauuucugacacuccagugcaugauugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacgugcccaguauucagagcaggggauuguuuggcgcgauagccggcuucaucgaagggggauggacugguauggucgacggcugguacggguaucaucaccagaaugagcaaggauccggcuacgcagcugaccucaaaucuacacagaacgccauugaugagaucaccaauaaggugaacagcguuauagaaaagaugaauacgcaguuuaccgcuguggguaaggaguucaaccaccuggaaaagcggauugagaauuuaaacaaaaaggucgacgauggguuccuggacaucuggacauacaaugccgaacuccuugugcuguuggagaacgagcgcacucuagauuaucaugacucaaauguuaaaaaccuguacgaaaagguacgaagucagcucaaaaacaaugcaaaggagaucggcaacggauguuuugaguucuaucacaagugcgauaauaccuguauggaguccgugaaaaacggcacauacgacuauccuaaguacagcgaagaggccaaacugaauagagaggaaauugauggggucaaacuugagucuacuaggaucuaucaaauucuggcuauauacucaaccguggcgaguagcuugguccucgugguuucccugggagcaaucucuuuuuggaugugcucgaacgguagcuuacagugccggauuuguaucuga

SEQ ID NO: 133894 - RNA, 1701 nt, Artificial Sequence
  derived and/or modified sequence opt3 from hemagglutinin__InfluenzaA__AHM98997
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggagacagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggucuucccgcuauagcaagaaauuuaagccugagauugcaauccgaccaaaagugcguggacaggaggguagaaugaacuacuauuggacucugguggaacccggcgacaagauuaccuucgaggccacagggaaucuagucguuccuagguacgcuuuugccauggaacggaacgcaggaucgggcaucauaauuucugauacuccagugcaugacugcaacaccacaugucaaaccccgaaaggugcuaucaauacgucccuccccuuccagaacauucacccuaucacuaucgggaagugcccaaaguauguaaaaucaacaaagcugcgccuugccaccggacugagaaaugugcccaguauucagagcaggggcuuguuuggcgcgauagccggguucaucgagggagguuggacuggcauggucgacgggugguacggauaucaucaccagaacgaacaaggcuccgguuacgcagcugaucucaaaucuacacagaaugccauugacgagaucaccaacaaggugaauagcguuauagagaaaaugaacacgcaguuuaccgcuguggggaaggaguucaaucaccuggagaagcggauugaaaacuuaaauaaaaaggucgaugacggcuuccuggauaucuggacauacaacgccgagcuccuugugcuguuggaaaaugagcgcacucuagacuaucaugauucaaacguaaagaaucuguacgagaagguucgaagucagcucaaaaacaacgcaaaggaaaucggaaauggcuguuuugaguucuaucacaagugcgacaacaccuguauggaauccgugaaaaaugggacauacgauuauccuaaguacagcgaggaagccaaacugaacagagaggagauugacggagucaaacuugaaucuacuaggaucuaucaaauucuggcuauauacucaaccguggcgaguagcuugguccucgugguuucccugggugcaaucucuuuuuggaugugcucgaauggcagcuuacagugccggauuuguaucuga

SEQ ID NO: 133895 - RNA, 1701 nt, Artificial Sequence
  derived and/or modified sequence opt3 from hemagglutinin__InfluenzaA__AHM99019
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucaaaggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagagagcagcugagcaguguguccucuuucgaaagguuugagauuuucccgaagacaagcuccuggcccaaucacgauucaaacaaaggugucaccgccgcuuguccucaugcaggggccaagaguuuuuauaaaaaucugaucuggcucgugaagaaaggagacagcuacccaaaguuaucuaaguccuauauaaacgauaaaggcaaggaaguacugguucuuuggggcauccaccaccccucaacgagcgcugaccaacagaguuuguaccagaaugccgaugcguacguguucgucgggucuucccgguauagcaaaaaguuuaaaccugagauugcaauccgcccaaaggugcgaggacaggagggucguaugaacuacuauuggacucugguggaacccggcgacaaaauuaccuucgaggccacagggaaucuagucguuccuagauacgcuuuugccauggaaaggaacgcaggaucgggcaucauaauuucugauacuccagugcaugacugcaacaccacaugucaaaccccgaagggugcuaucaauacgucccuccccuuccagaacauucacccuaucacuaucgggaagugcccaaaauauguaaagucaacaaaacugcggcuugccaccggacugcgcaaugugcccaguauucagagcagaggcuuguuuggcgcgauagccggguucaucgagggagguuggacuggcauggucgacgggugguacggauaucaucaccagaacgaacaaggcuccgguuacgcagcugaucucaagucuacacagaaugccauugacgagaucaccaacaaagugaauagcguuauagagaagaugaacacgcaguuuaccgcuguggggaaggaguucaaucaccuggagaaaaggauugaaaacuuaaauaagaaagucgaugacggcuuccuggauaucuggacauacaacgccgagcuccuugugcuguuggaaaaugagcggacucuagacuaucaugauucaaacguaaagaaucuguacgagaaaguucgcagucagcucaagaacaacgcaaaggaaaucggaaauggcuguuuugaguucuaucacaaaugcgacaacaccuguauggaauccgugaagaaugggacauacgauuauccuaaauacagcgaggaagccaagcugaaccgagaggagauugacggagucaaacuugaaucuacuagaaucuaucaaauucuggcuauauacucaaccguggcgaguagcuugguccucgugguuucccugggugcaaucucuuuuuggaugugcucgaauggcagcuuacagugcaggauuuguaucuga

SEQ ID NO: 133896 - RNA, 1701 nt, Artificial Sequence; identical to SEQ ID NO: 133895
  derived and/or modified sequence opt3 from hemagglutinin__InfluenzaA__AHM99031

SEQ ID NO: 133897 - RNA, 1701 nt, Artificial Sequence; identical to SEQ ID NO: 133895
  derived and/or modified sequence opt3 from hemagglutinin__InfluenzaA__AHM99043

SEQ ID NO: 133898 - RNA, 1701 nt, Artificial Sequence; identical to SEQ ID NO: 133895
  derived and/or modified sequence opt3 from hemagglutinin__InfluenzaA__AHM99054

SEQ ID NO: 133899 - RNA, 1701 nt, Artificial Sequence; identical to SEQ ID NO: 133895
  derived and/or modified sequence opt3 from hemagglutinin__InfluenzaA__AHM99065

SEQ ID NO: 133900 - RNA, 1701 nt, Artificial Sequence
  derived and/or modified sequence opt3 from hemagglutinin__InfluenzaA__AHM99075
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggagacagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggucuucccgcuauagcaagaaauuuaagccugagauugcaauccgaccaaaagugcgugaccaggagggaagaaugaacuacuauuggacucugguggaacccggugauaagauuaccuucgaggccacaggcaaucuagucguuccuagguacgcuuuugccauggaacggaacgcagggucgggaaucauaauuucugacacuccagugcaugacugcaacaccacaugucaaaccccgaaaggcgcuaucaauacgucccuccccuuccagaacauucacccuaucacuaucgguaagugcccaaaguauguaaaaucaacaaagcugcgccuugccaccgggcugagaaaugugcccaguauucagagcaggggauuguuuggcgcgauagccggcuucaucgaagggggauggacugguauggucgauggcugguacggguaucaucaccagaacgaacaaggauccggcuacgcagcugaccucaaaucuacacagaaugccauugaugagaucaccaacaaggugaauagcguuauagagaaaaugaacacgcaguuuaccgcuguggguaaggaguucaaucaccuggaaaagcggauugaaaacuuaaauaaaaaggucgacgauggguuccuggacaucuggacauacaacgccgagcuccuugugcuguuggaaaaugagcgcacucuagauuaucaugacucaaacguaaagaaucuguacgagaagguucgaagucagcucaaaaacaacgcaaaggaaaucggcaauggauguuuugaguucuaucacaagugcgauaacaccuguauggaauccgugaaaaauggcacauacgacuauccuaaguacagcgaggaagccaaacugaacagagaggagauugauggggucaaacuugaaucuacuaggaucuaucaaauucuggcuauauacucaaccguggcgaguagcuugguccucgugguuucccugggagcaaucucuuuuuggaugugcucgaaugguagcuuacagugccggauuuguaucuga

SEQ ID NO: 133901 - RNA, 1701 nt, Artificial Sequence
  derived and/or modified sequence opt3 from hemagglutinin__InfluenzaA__AHN00717
augaaggccauccugcucgugcuucugugcaccuucgcugcaacaaacgccgacacuuuguguauuggcuaccacgcgaauaacagcacggauaccgucgacacaguuuuagagaaaaaugugacuguaacccauuccgugaaccugcuagaagauagacacaaugggaagcucugcaaacugggagguauagcuccccuucaucugggcaaguguaacaucgccgggugguugcucggaaauccugagugcgaacugcuguuuacagucucuucauggaguuauauuguggagaccagcaacuccgacaauggcacuuguuacccaggugauuucaucaacuaugaggaacucagggagcaguuaucuucgguuaguagcuuugaacgguucgagauuuuuccgaaaacaaguuccuggcccaaucacgaaaccaaccgcggggugacggcagccugcccuuacgcuggagcaaauucuuucuaucgaaaccugaucuggcuugucaagaagggcaauagcuacccaaaauuguccaagucauaugugaacaacaaaggcaaggagguacugguucuaugggggauacaucaucccccuacuucaaccgaccaacagagccucuaccagaaugccgaugcuuacguguuugucggaucuuccaaauauaaccguaaguucaagccagagaucgccgcgagacccaaagugaggggucaggcaggccggaugaauuacuauuggacacugauugaaccuggggacacuaucaccuuugaggccacaggaaaccuuguggucccacgcuacgcuuucgccaugaauagaggcccggguucagggauuaucauaagcgaugcacccguucacgacuguaacaccacgugccaaacuccuaagggagcuauuaauacaagucugccauuucagaacauccaccccgugaccauuggcgaauguccuaaauauguaaagucuacuaaauugaggauggccacaggccuccggaauaucccauccauccagagccgcgggcuguucggagcgauugccgguuuuauagagggcggguggaccggaaugaucgauggcugguacgguuaucaccaucagaacgaacaagggucgggcuacgcagcugaccagaagucuacgcagaaugccauugauggaaucaccaacaaagucaauuccgugauaaagaagaugaacacacaguucacugcugugggcaaagaguucaaucacuuagagaagcgaauugaaaaccugaacaaaaagguugacgacggguuucucgauguguggaccuacaaugccgagcuucuggucuugcuagaaaacgagagaacacuggacuuccacgauucaaaugugaaaaaccucuaugaaaagguaaggagucaacugcggaauaacgcaaaggagaucggaaaugguugcuuugaguucuaccauaaaugugacgauacuugcauggaaagcguuaagaacggcaccuaugacuaccccaaauauuccgaggaaucuaaacuuaaucgugaggaaaucgauggggugaagcuggagagcacacgcauuuaccagaucuuggccauuuauucaaccgcugcgaguucccucguccuguuagugagccugggagcaauaucuuuuuggaugugcucaaacggcagucuacaguguagaaucugcauuuga

SEQ ID NO: 133902 - RNA, 1701 nt, Artificial Sequence
  derived and/or modified sequence opt3 from hemagglutinin__InfluenzaA__AHN00764
augaaggccauccugcucgugcuucugugcaccuucgcugcaacaaacgccgacacuuuguguauuggcuaccacgcgaauaacagcacggauaccgucgacacaguuuuagagaaaaaugugacuguaacccauuccgugaaccugcuagaagauaagcacaaugggaaacucugcaagcugggagguauagcuccccuucaucugggcaaauguaacaucgccgggugguugcucggaaauccugagugcgaacugcuguuuacagucucuucauggaguuauauuguggagaccagcaacuccgacaauggcacuuguuacccaggugauuucaucaacuaugaggaacucagagagcaguuaucuucgguuaguagcuuugaaagguucgagauuuuuccgaagacaaguuccuggcccaaucacgaaaccaaccgcggggugacggcagccugcccuuacgcuggagcaaauucuuucuaucggaaccugaucuggcuugucaagaaaggcaauagcuacccaaaguuguccaaaucauaugugaacaacaagggcaaagagguacugguucuaugggggauacaucaucccccuacuucaaccgaccaacagagccucuaccagaaugccgaugcuuacguguuugucggaucuuccaaguauaaccgaaaguucaaaccagagaucgccgcgcgucccaaggugagaggucaggcaggcaggaugaauuacuauuggacacugauugaaccuggggacacuaucaccuuugaggccacaggaaaccuuguggucccacgguacgcuuucgccaugaaucgcggcccggguucagggauuaucauaagcgaugcacccguucacgacuguaacaccacgugccaaacuccuaaaggagcuauuaauacaagucugccauuucagaacauccaccccgugaccauuggcgaauguccuaaguauguaaaaucuacuaaguugagaauggccacaggccucaggaauaucccauccauccagagccgggggcuguucggagcgauugccgguuuuauagagggcggguggaccggaaugaucgauggcugguacgguuaucaccaucagaacgaacaagggucgggcuacgcagcugaccagaaaucuacgcagaaugccauugauggaaucaccaacaaggucaauuccgugauaaagaaaaugaacacacaguucacugcugugggcaaggaguucaaucacuuagagaaacgcauugaaaaccugaacaagaaaguugacgacggguuucucgauguguggaccuacaaugccgagcuucuggucuugcuagaaaacgagcgaacacuggacuuccacgauucaaaugugaagaaccucuaugaaaagguaagaagucaacugaggaauaacgcaaaagagaucggaaaugguugcuuugaguucuaccauaagugugacgauacuugcauggaaagcguuaaaaacggcaccuaugacuaccccaaguauuccgaggaaucuaaacuuaaucgggaggaaaucgauggggugaagcuggagagcacacguauuuaccagaucuuggccauuuauucaaccgcugcgaguucccucguccuguuagugagccugggagcaauaucuuuuuggaugugcucaaacggcagucuacagugucgcaucugcauuuga

SEQ ID NO: 133903 - RNA, 1683 nt, Artificial Sequence
  derived and/or modified sequence opt3 from hemagglutinin__InfluenzaA__AHN96323
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaacgcacaguggauuugggccaaugcggguuacugggaaccaucacuggcccaccgcagugugaccaguuucuagaguucucugcugaucucauaaucgaacgacgugaggguucagacguuugcuaccccgggaaguuugugaacgaggaagcccugagacagauucuuagggagaguggaggcaucgauaaagaagcaaugggcuucacauauagcgggauucggaccaauggagccacguccgcuugucgcagaucugguucgucauuuuacgcagagaugaaguggcuguugagcaacacugacaaugccgcuuucccucaaaugaccaagaguuauaaaaacacaaggaaguccccagcccucaucgucuggggcauacaccauucugugagcacugcggagcagaccaaacuguacggguccggaaauaagcugguaacaguuggcucaaguaacuaucagcagagcuuugugcccucuccuggugcacggccacaagucaaugggcucuccggacgcauugauuuccacugguuaaugcugaaccccaaugacaccgugacguuuucauucaacggcgccuuuaucgcuccugaucgagccagcuuccuuagaggcaaaaguauggggauucagucuggagugcaggucgacgcaaacugcgaaggugauuguuaccauuccggcgggacuaucaucagcaauuugccauuucagaacauugacucgagggcuguuggaaagugcccgcgguaugugaagcaacguucucugcuacucgccacaggcaugaaaaauguacccgagauaccuaagggucgcgggcuguucggcgcgaucgccggauucauugaaaacggcugggaggggcuuaucgauggaugguacgguuuuagacaccagaaugcacagggcgaagggaccgcugccgacuacaaauccacucaaucagcuauagaccagauuacaggaaagcugaacagguugaucgagaaaaccaaucagcaguucgagcucaucgauaacgaauuuaaugagguggaaaagcaaauuggcaacgucaucaauuggacgcgggacaguauuaccgagguguggagcuauaacgccgaacuguuaguugcaauggagaaucagcacacaauagaucuggccgacuccgagauggauaaacucuacgaacgagugaagcgccagcuuagagagaacgcugaagaggacgguacuggguguuucgaaaucuuucauaagugcgaugacgauuguauggcgucuauuaggaauaacaccuaugaccacagcaaauaccgggaggaggcaaugcagaaccgcauccaaaucgauccagucaagcugucaaguggcuauaaagacgugauuuugugguucuccuuuggagccagcugcuucauacuacuggcuaucguaaugggccucguuuuuauuugcgugaagaaugggaacaugagauguacaaucggaauuuga

SEQ ID NO: 133904 - RNA, 1701 nt, Artificial Sequence; identical to SEQ ID NO: 128998
  derived and/or modified sequence opt3 from hemagglutinin__InfluenzaA__AHN96442

SEQ ID NO: 133905 - RNA, 1701 nt, Artificial Sequence
  derived and/or modified sequence opt3 from hemagglutinin__InfluenzaA__AHN96443
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuauacuucguugaggucacucguggcaagcaguggcacacuggaauuuaauaacgaguccuucaauuggaccgguguuacgcagaacgggacuucuagcgccugcauccggcgcuccaauaacucauuuuucagucgacugaauuggcucacccacuuaaacuuuaaguacccagcucugaacgugacaaugcccaauaacgagcaguucgauaagcuguauauuuggggaguccaucacccuggcacugacaaagaucagaucuuuuuguacgcacaagccagcggccguauuaccgugucuacaaagagaucccagcaggcuguaaucccaaauauagggucaaggccccggguucgcaacauuccuagcagagugaguaucuauuggaccauugucaaaccaggagacauccugcuaaucaauucuacggguaaccucauugccccgaggggcuacuucaagauacgguccgggaaaagcucgaucaugcgcucugaugcgcccauuggaaaguguaauuccgcaugcaucacuccuaacggcucaauaccaaaugacaagcccuuucagaacgugaaucgaauuacauacggugccuguccuagauaugugaaacaaaacacccugaaacuugcuacugggaugaggaaugucccagaaaaacagacacggggaaucuucggcgccaucgcaggcuuuauugagaacgggugggaaggaaugguugacgguugguacggcuuccgucaccagaauagugaggggcgcggacaagcugccgaucuuaagagcacccaggcggccaucgaccagauuaacggcaaauugaacagacucauagguaagacgaaugagaaauuccaucagaucgaaaaggaguuuuccgaaguggaggggaggauucaagaucuggaaaaguauguagaggacaccaaaaucgauuuauggucuuacaacgcagagcugcucguggcucuugaaaaucagcacacaaucgaccugacugauagcgagaugaacaaguuguucgaaaagaccaagaaacagcuacgggagaaugccgaagacaugggcaacggaugcuuuaagauuuaucauaagugugauaaugcuugcauaggcucaauccgaaacgggacauacgaccacgaugucuaucgcgacgaggcccugaauaacagauuccagauuaaaggaguggagcucaagagugguuacaaagacuggauccuguggauuuccuuugcaaucagcugcuuccuucuguguguugccuugcucggcuuuauaaugugggcuugccaaaaggggaauaucagguguaacauuugcaucuga

SEQ ID NO: 133906 - RNA, 1701 nt, Artificial Sequence
  derived and/or modified sequence opt3 from hemagglutinin__InfluenzaA__AHN96444
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauaacuccuuuuucucacgucugaauuggcucacgcauuuaaacuuuaaguauccagcacugaacgugacuaugcccaauaaccagcaguucgacaaacuuuacaucuggggaguccaccauccuggcaccgauaaagaccagaucuuuuuguaugcccaaaguagcggcagaauuacagugucuacuaagaggucccagcaggcuguaauaccaaauauugggucacggccccgcaucagaaacauuccuagcaggaucaguaucuacuggaccauuguuaaaccaggagauauacugcuaaucaauucuacagguaaccucauugccccgcggggcuacuucaagauccgcuccgggaaaagcucgauaaugcgaucugacgcgcccauuggaaaguguaaguccgagugcaucaccccuaauggcucaaucccaaacgacaaacccuuucagaaugugaacagaauuacguauggugcauguccuagguacgucaagcaaaguacucugaaacuugccacagggaugcggaaugugccagaaaagcagacccguggaaucuucggcgcuauugccggcuuuauagagaacgggugggaaggaaugguggaugguugguauggcuuccgccaccagaauagcgaggggagaggacaagcagcugaccugaaauccacucaggccgcgaucgaucagauuaacggcaaguugaauaggcucaucgguaaaacaaacgagaaguuccaccagaucgaaaaggaguuuucugaagucgaggggcggauucaagaccuggaaaaauacguugaggauaccaagauagacuuauggagcuauaacgccgagcugcucguggcacuugaaaaucagcauacgaucgaucugaccgacucagagaugaacaaauuguucgaaaagacaaagaagcagcuacgagagaaugcugaagauaugggcaacggaugcuuuaagauuuaccacaaaugugacaaugccugcaucggcaguauucgcaacgggacuuaugaucaugacguauacagagacgaggcucugaauaacagguuccagaucaagggaauagagcucaaauccgguuacaaggauuggauccuguggauuagcuuugccaucucuugcuuccuucuguguguggcauugcucggcuuuauuaugugggccugccaaaaagggaauauccgguguaacauaugcauuuga

SEQ ID NO: 133907 - RNA, 1701 nt, Artificial Sequence
  derived and/or modified sequence opt3 from hemagglutinin__InfluenzaA__AHN96445
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauaacuccuuuuucucacgucugaauuggcucacgcauuuaaacuuuaaguauccagcacugaacgugacuaugcccaauaaccagcaguucgacaaacuuuacaucuggggaguccaccauccuggcaccgauaaagaccagaucuuuuuguaugcccaaaguagcggcagaauuacagugucuacuaagaggucccagcaggcuguaauaccaaauauugggucacggccccgcaucagaaacauuccuagcaggaucaguaucuacuggaccauuguuaaaccaggagauauacugcuaaucaauucuacagguaaccucauugccccgcggggcuacuucaagauccuguccgggaaaagcucgauaaugcgcucugacgcgcccauuggaaaguguaaguccgagugcaucaccccuaauggcucaaucccaaacgacaaacccuuucagaaugugaaccgaauuacguauggugcauguccuagauacgucaagcaaaguacucuuaaacuggccacagggaugaggaaugugccagaaaagcagacccggggaaucuucggcgcuauugccggcuuuauagagaacgggugggaaggaaugguggaugguugguauggcuuccgucaccagaauagcgaggggcgcggacaagcagcugacuugaaauccacucaggccgcgaucgaucagauuaacggcaagcucaauagacugaucgguaaaacaaacgagaaguuccaccagaucgaaaaggaguuuucugaagucgaggggaggauucaagacuuagaaaaauacguugaggauaccaagauagaccuguggagcuauaacgccgagcuccuuguggcacuggaaaaucagcauacgaucgauuugaccgacucagagaugaacaaacuauucgaaaagacaaagaagcagcugcgggagaaugcugaagauaugggcaacggaugcuuuaagauuuaccacaaaugugacaaugccugcaucggcaguauucgaaacgggacuuaugaucaugacguauaccgcgacgaggcucucaauaacagauuccagaucaagggaguggagcugaaauccgguuacaaggauuggauacuuuggaucagcuuugccauuucuugcuuccuguugugugucgcacuccugggcuuuaucaugugggccugccaaaaagggaauauuagguguaacaucugcauauga

SEQ ID NO: 133908 - RNA, 1701 nt, Artificial Sequence
  derived and/or modified sequence opt3 from hemagglutinin__InfluenzaA__AHN96447
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggauucaggaccuggagaaauacguugaggauacaaagauagacuuauggucauauaacgcagaacugcucguggcucuugagaaccaacauaccaucgaucugacggacagugaaaugaauaaauuguucgagaagaccaaaaagcagcuacgggaaaacgccgaggauaugggaaauggcugcuuuaagauuuaccacaaaugugacaacgcuugcaucggguccauucgaaauggaacauaugaucaugacguauaccgcgacgaggcccugaacaauagauuccagaucaaggguguggaacucaaaagcggcuacaaggauuggauacuguggaucucuuuugcaauuucaugcuuccuucugugugucguguugcucggguuuaucaugugggccugccagaaaggaaacauuagguguaauaucugcauauga

SEQ ID NO: 133909 - RNA, 1701 nt, Artificial Sequence
  derived and/or modified sequence opt3 from hemagglutinin__InfluenzaA__AHV83765
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccucaaaagcacccagaaugcuauugauaagaucacaaacaaaguuaauuccgugauagagaagaugaacacucaguuuaccgccguggguaaagaguucaaucaccuggagaagcggauugaaaacuuaaauaagaaagucgacgauggguuccuggacaucuggacauacaacgcugagcuccuugugcuguuggaaaaugagcgcacucuagauuaucaugacucuaacguaaagaaccuguacgagaaaguucgaaaucaacucaagaccaacgccaaagaaaucggcaauggauguuuugaguucuaucacaagugcgauaacacauguauggaaagcgugaagaauggcaccuacgacuauccuaaauacucagaggaagcaaagcugaacagagagaaaauugauggggucaaacuugagaguacuaggaucuaucagauucuggccauauacuccacgguggcuagcucuuugguccucgugguuucacugggagcgaucaguuuuuggaugugcagcaaugguuccuuacagugccggauuuguaucuga

SEQ ID NO: 133910 - RNA, 1701 nt, Artificial Sequence; identical to SEQ ID NO: 133037
  derived and/or modified sequence opt3 from hemagglutinin__InfluenzaA__AHV83766

SEQ ID NO: 133911 - RNA, 1701 nt, Artificial Sequence; identical to SEQ ID NO: 132056
  derived and/or modified sequence opt3 from hemagglutinin__InfluenzaA__AHV83767

SEQ ID NO: 133912 - RNA, 1701 nt, Artificial Sequence
  derived and/or modified sequence opt3 from hemagglutinin__InfluenzaA__AHV83768
augaaggccauccuggugguccuccuuuacaccuucacaacugcuaacgcagacacgcugugcauuggcuaucacgccaauaacagcaccgauacaguugacacuguguuggagaagaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaagaacucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuaucucaauccuauauaaacgauaagggcaaggaaguacugguucuuuggggcauccaccaccccucaacuaccgccgaccagcagagcuuguaccagaaugcugaugccuacguguucgucgggacaagucgcuauucuaaaaaguuuaaaccugagauugcgauccgaccaaaggugcgugaccaagagggaagaaugaacuacuauuggacucugcuagaacccggugauaaaauuaccuucgaggcaacaggcaaccucguggucccuagguacgccuuuaccauggaacggaaugcuggguccggaaucauaauuagcgacacgccaguucaugauugcaacacuacaugucagaccccggagggcgccaucaauacuucgcugcccuuccagaacauucacccuaucacaaucgguaagugcccaaaauaugugaagucuaccaaacuucgccuggcaacgggguugagaaauguacccuccauucagucaaggggacucuuuggcgcuauagccggcuucaucgaagggggauggaccgguaugguggacggcugguacggguaucaucaccaaaacgagcagggaaguggcuacgcggccgaccugaaaagcacacagaaugcaauugauaagaucacuaacaaagucaauuccgugauagagaagaugaacacccaguuuacagcuguugguaaagaguucaaucacuuagagaagcggauugaaaaccugaauaagaaaguggacgauggguuccucgacaucuggacuuacaacgccgagcuucuggucuugcuagaaaaugagcgcacccuggauuaucaugacucuaacgugaagaaccucuacgagaaaguacgaaaucaacugaagaacaaugcuaaagaaaucggcaacggauguuuugaguucuaucacaagugcgauaauacauguauggacagcguuaagaacggcaccuacgauuauccuaaauacucagaagaggccaaacuuaauagagaaaagauugacggggugaagcuggagaguacuaggaucuaucagauuuuggcaauauacuccacggucgccagcucucucgugcuggucgugucauuaggagcuaucaguuuuuggaugugcagcaacgguucccugcagugccggauuuguaucuga

SEQ ID NO: 133913 - RNA, 1701 nt, Artificial Sequence; identical to SEQ ID NO: 133014
  derived and/or modified sequence opt3 from hemagglutinin__InfluenzaA__AHV83770

SEQ ID NO: 133914 - RNA, 1701 nt, Artificial Sequence
  derived and/or modified sequence opt3 from hemagglutinin__InfluenzaA__AHV83771
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacuaccgaccagcagagcuuguaccagaaugcugaugccuacguguucgucgggacaagucgcuauucuaaaaaguuuaaaccugagauugcgauccgaccaaaggugcgugaccaagagggaagaaugaacuacuauuggacucugguggaacccggugauaaaauuaccuucgaggcaacaggcaaccuagucguuccuagguacgccuuuaccauggaacggaaugcuggguccggaaucauaauuagcgacacgccagugcaugauugcaacacuacaugucagaccccggagggcgccaucaauacuucgcuccccuuccagaacauucacccuaucacaaucgguaagugcccaaaauauguaaagucuaccaagcugcgccuugcaacggggcugagaaaugugcccuccauucagucaaggggauuguuuggcgcuauagccggcuucaucgaagggggauggaccgguauggucgacggcugguacggguaucaucaccaaaacgagcagggaaguggcuacgcggccgaccagaaaagcacacagaaugcaauugauaagaucacuaacaaaguuaauuccgugauagagaagaugaacacccaauuuacagcuguggguaaagaguucaaucaccucgagaagcggauugaaaaccugaauaagaaagucgacgauggguucuuagacaucuggacuuacaacgccgagcugcucgugcuucuggaaaaugagcgcaccuuggauuaucaugacucuaacguaaagaaccuauacgagaaaguucgaaaucagcugaagaacaaugcuaaagaaaucggcaacggauguuuugaguucuaucacaagugcgauaauacauguauggaaagcgugaagaacggcaccuacgacuauccuaaauacucagaggaagccaagcucaauagagagaaaauugauggggucaagcuggagaguacuaggaucuaucagauucuugcaauauacuccacgguggccagcucucuggucuuggugguuucacucggagcuaucaguuuuuggaugugcagcaacgguucccugcaaugccggauuuguaucuga

SEQ ID NO: 133915 - RNA, 1701 nt, Artificial Sequence; identical to SEQ ID NO: 132056
  derived and/or modified sequence opt3 from hemagglutinin__InfluenzaA__AHV83772

SEQ ID NO: 133916 - RNA, 1701 nt, Artificial Sequence; identical to SEQ ID NO: 132056
  derived and/or modified sequence opt3 from hemagglutinin__InfluenzaA__AHV83773

SEQ ID NO: 133917 - RNA, 1701 nt, Artificial Sequence; identical to SEQ ID NO: 132056
  derived and/or modified sequence opt3 from hemagglutinin__InfluenzaA__AHV83774

SEQ ID NO: 133918 - RNA, 1701 nt, Artificial Sequence
  derived and/or modified sequence opt3 from hemagglutinin__InfluenzaA__AHV83775
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaauauucccuccauacagucaaggggauuguuuggcgccaucgcgggcuucauugaagggggauggacggguaugguggacggcugguacggguaucaucaccaaaacgagcagggaaguggcuacgccgcagaccucaaaagcacccagaaugcuaucgauaagauaacaaacaaagucaauuccgugauugagaagaugaacacucaguuuaccgccguugguaaagaguucaaucaccuggagaagcggaucgaaaacuuaaauaagaaaguggacgauggguuccuggacaucuggacauacaacgcugagcuccuuguccuguuggaaaaugagcgcacucuagauuaucaugacucuaacgugaagaaccuguacgagaaaguacgaaaucaacucaagaacaaugccaaagaaauuggcaacggauguuuugaguucuaucacaagugcgauaauaccuguauggaaagcguuaagaacggcacauacgacuauccuaaauacucagaggaagcaaagcugaauagagagaaaaucgauggggugaaacuugagaguaccaggauuuaucagauacuggccaucuacuccacugucgcuagcucuuuggugcucgucgugucacugggagcgauuaguuuuuggaugugcagcaacgguuccuuacagugccggaucuguaucuga

SEQ ID NO: 133919 - RNA, 1701 nt, Artificial Sequence; identical to SEQ ID NO: 132056
  derived and/or modified sequence opt3 from hemagglutinin__InfluenzaA__AHV83776

SEQ ID NO: 133920 - RNA, 1701 nt, Artificial Sequence
  derived and/or modified sequence opt3 from hemagglutinin__InfluenzaA__AHV83777
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaauauucccuccauacagucaaggggauuguuuggcgccaucgcgggcuucauugaagggggauggacggguaugguggacggcugguacggguaucaucaccaaaacgagcagggaaguggcuacgccgcagaccucaaaagcacccagaaugcuaucgauaagauaacaaacaaagucaauuccgugauugagaagaugaacacucaguuuaccgccguugguaaagaguucaaucaccuggagaagcggaucgaaaacuuaaauaagaaaguggacgauggguuccuggacaucuggacauacaacgcugagcuccuuguccuguuggaaaaugagcgcacucuagauuaucaugacucuaacgugaagaaccuguacgagaaaguacgaaaucaacucaagaacaaugccaaagaaauuggcaacggauguuuugaguucuaucacaagugcgauaauaccuguauggaaagcguuaagaacggcacauacgacuauccuaaauacucagaggaagcaaagcugaauagagagaaaaucgauggggugaaacuugagaguaccaggauuuaucagauacuggccaucuacuccacugucgcuagcucuuuggugcucgucgugucacugggagcgauuugcuuuuggaugugcaguaacgguagcuuacagugucggaucugcaucuga

SEQ ID NO: 133921 - RNA, 1701 nt, Artificial Sequence
  derived and/or modified sequence opt3 from hemagglutinin__InfluenzaA__AHV83778
augaaggccauccuggugguccuccuuuacaccuucacaacugcuaacgcagacacgcugugcauuggcuaucacgccaauaacagcaccgauacaguugacacuguguuggagaagaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaagaacucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuaucucaauccuauauaaacgauaagggcaaggaaguacugguucuuuggggcauccaccaccccucaacuaccgccgaccagcagagcuuguaccagaaugcugaugccuacguguucgucgggacaagucgcuauucuaaaaaguuuaaaccugagauugcgauccgaccaaaggugcgugaccaagagggaagaaugaacuacuauuggacucugguggaacccggugauaaaauuaccuucgaggcaacaggcaaccuagucguuccuagguacgccuuuaccauggaacggaaugcuggguccggaaucauaauuagcgacacgccaguguaugauugcaacacuacaugucagaccccggagggcgccaucaauacuucgcuccccuuccagaacauucauccuaucacaaucgguaagugcccaaaauacguaaagucuaccaagcugcgccuugcaacggggcugagaaaugugcccuccauucagucaaggggauuguuuggcgcuauagccggcuucaucgaagggggauggaccgguauggucgacggcugguauggguaccaccaucaaaacgagcagggaaguggcuacgcggccgaccucaaaagcacacagaaugcaauugauaagaucacuaacaaaguuaauuccgugauagagaagaugaacacccaguuuacagcuguggguaaagaguucaaucaccuggagaagcggauugaaaacuuaaauaagaaagucgacgauggguuccuggacaucuggacuuauaacgccgagcuccuugugcuguuggaaaaugagcgcacccuagauuaccacgacucuaacguaaagaaccuguaugagaaaguucgaaaucaacucaagaacaaugcuaaagaaaucggcaacggauguuuugaguucuaccauaagugcgauaauacauguauggaaagcgugaagaacggcaccuaugacuacccuaaauauucagaggaagccaagcugaauagagagaaaauugauggggucaaacuugagaguacuaggaucuaccagauucuggcaauauacuccacgguggccagcucuuugguccucgugguuucacugggagcuaucaguuuuuggaugugcagcaacgguuccuuacagugccggauuuguaucuga

SEQ ID NO: 133922 - RNA, 1701 nt, Artificial Sequence
  derived and/or modified sequence opt3 from hemagglutinin__InfluenzaA__AHV83779
augaaggccauccuggugguccuccuuuacaccuucgcuacaacuaacgcagacacgcugugcauuggcuaucacgccaauaacagcaccgauacaguugacacuguguuggagaagaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaagaacucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuaucucaauccuauauaaacgauaagggcaaggaaguacugguucuuuggggcauccaccaccccucaacuaccgccgaccagcagagcuuguaccagaaugcugaugccuacguguucgucgggacaagucgcuauucuaaaaaguuuaaaccugagauugcgauccgaccaaaggugcgugaccaagagggaagaaugaacuacuauuggacucugguggaacccggugauaaaauuaccuucgaggcaacaggcaaccuagucguuccuagguacgccuuuaccauggaacggaaugcuggguccggaaucauaauuagcgacacgccagugcaugauugcaacacuacaugucagaccccggagggcgccaucaauacuucgcuccccuuccagaacauucacccuaucacaaucgguaagugcccaaaauauguaaagucuaccaagcugcgccuugcaacggggcugagaaaugugcccuccauucagucaaggggauuguuuggcgcuauagccggcuucaucgaagggggauggaccgguauggucgacggcugguacggguaucaucaccaaaacgagcagggaaguggcuacgcggccgaccucaaaagcacacagaaugcaauugauaagaucacuaacaaaguuaauuccgugauagagaagaugaacacccaguuuacagcuguggguaaagaguucaaucaccuggagaagcggauugaaaacuuaaauaagaaagucgacgauggguuccuggacaucuggacuuacaacgccgagcuccuugugcuguuggaaaaugagcgcacccuagauuaucaugacucuaacguaaagaaccuguacgagaaaguucgaaaucaacucaagaacaaugcuaaagaaacaggcaacggauguuuugaguucuaucacaagugcgauaauaccuguauggaaagcgugaagaacggcacuuacgacuauccuaaauacucagaggaagccaagcugaauagagagaaaaucgauggggucaaacuugagaguacgaggauuuaucagauccuggcaauuuacuccacaguggccagcucuuugguccucgugguuucacugggagcuauaaguuuuuggaugugcagcaacgguuccuuacagugccggaucuguauuuga

SEQ ID NO: 133923 - RNA, 1701 nt, Artificial Sequence
  derived and/or modified sequence opt3 from hemagglutinin__InfluenzaA__AHV83780
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuacgccaaucuuauauaaacgauaagggcaaggaaguacugguucuuuggggcauccaccaccccuccacgacuaccgaccagcagucauuguaccagaaugcugaugccuacguguucgucgggacaagccgauauaguaaaaaguuuaaaccugagauugcgauccguccaaaggugagagaccaagagggaaggaugaacuacuauuggacucugguggaacccggugauaaaauuaccuucgaggcaacaggcaaccuagucguuccucgguacgccuuuaccauggaacgcaaugcugggucuggaaucauaauuuccgacacgccagugcaugauugcaacacuacaugucagaccccggagggcgccaucaauacuagccuccccuuccagaacauucacccuaucacaaucgguaagugcccaaaauauguaaagucgaccaagcugagacuugcaacggggcugaggaaugugcccucuauucagucccggggauuguuuggcgcuauagccggcuucaucgaagggggauggaccgguauggucgacggcugguacggguaucaucaccaaaacgagcagggaucaggcuacgcggccgaccucaaaaguacacagaaugcaauugauaagaucacuaacaaagugaauagcguuauagagaagaugaacacccaguuuacagcuguggguaaagaguucaaucaccuggagaagcgcauugaaaacuuaaauaagaaagucgacgauggguuccuggacaucuggacuuacaacgccgagcuccuugugcuguuggaaaaugagcgaacccuagauuaucaugacuccaacguaaagaaccuguacgagaaaguuagaaaucaacucaagaacaaugcuaaagaaaucggcaacggauguuuugaguucuaucacaagugcgauaauacauguauggaaucugugaagaacggcaccuacgacuauccuaaauacagcgaggaagccaagcugaauagggagaaaauugauggggucaaacuugagucaacucggaucuaucagauucuggcaauauacaguacgguggccuccagcuugguccucgugguuucucugggagcuaucucauuuuggaugugcaguaacgguagcuuacagugccguauuuguaucuga

SEQ ID NO: 133924 - RNA, 1701 nt, Artificial Sequence; identical to SEQ ID NO: 132056
  derived and/or modified sequence opt3 from hemagglutinin__InfluenzaA__AHV83781

SEQ ID NO: 133925 - RNA, 1701 nt, Artificial Sequence
  derived and/or modified sequence opt3 from hemagglutinin__InfluenzaA__AHV83782
augaaggccauccuggugguccuccuuuacacccuggcuacagcaaacgccgacacuuugugcauuggcuaucacgcgaauaacagcacggauaccguugacacaguguuagagaaaaauguaacugugacccauuccgucaaccugcuagaagauaagcacaaugggaaacucuguaagcugagaggaguggcuccccuucaucuggguaaaugcaacauagccggcuggaucuuggggaauccugagugugaaucucucucaacagcaaguagcugguccuacauuguugagaccucuucgucagacaacggaacuugcuauccaggcgauuucaucaauuacgaggaacugagggagcagcugagcaguguguccucuuuugaacgguucgagauuuuuccgaagacaagcuccuggcccaaccacgacucaaauaagggugucaccgccgcuuguccucaugcaggggccaaaaguuucuauaagaaccucaucugguuagugaaaaagggaaauagcuacccaaaacugucucaauccuauauaaacgauaagggcaaggaaguacuuguuuuguggggcauccaccaccccucaacgacugcugaccagcagagccuguaccagaaugccgaugcguacguguuugucgggaccagucgcuauucuaaaaaguucaaaccugagauugcaauccgaccaaaggugcgugaccaagagggaagaaugaacuacuauuggacacuuguggaacccggugauaaaauuacuuuugaggccaccggcaaccucgucgcuccuagguacgccuucacaauggaacggaaugcaggguccggaaucauaauuagcgacaccccaguucaugauugcaacacgacuugucagacaccggagggcgcuaucaauaccucgcugcccuuucagaacauucacccuaucacuaucgguaagugcccaaaauaugugaagucuacaaagcuacgccuggccaccggguugagaaauguacccuccauucagucaaggggacucuucggcgcgauagccggcuuuaucgaagggggauggacggguaugguggacggcugguacggguaucaucaccaaaacgagcagggaaguggcuacgcagcugaccugaaaagcacccagaaugccauugauaagaucacaaacaaagucaauuccgugauagagaagaugaacacucaguucaccgcuguugguaaagaauuuaaucacuuagagaagcggauugaaaaccugaauaagaaaguggacgauggguuccucgacaucuggacauacaacgccgagcuucuggucuugcuagaaaaugagcgcacucuggauuaucaugacucuaacgugaagaaccucuacgagaaaguacgaaaucaacugaagaacaaugcaaaagaaaucggcaacggauguuucgaguuuuaucacaagugcgauaauaccuguauggaaagcguuaagaacggcacauacgacuauccuaaauacucagaggaagccaaacuuaauagagagaagauugauggggugaagcuggagaguaccaggaucuaucagauuuuggcuauauacuccacugucgcgagcucucucgugcuggucgugucauuaggagcaaucaguuucuggaugugcagcaacgguucccugcagugccggauuuguaucuga

SEQ ID NO: 133926 - RNA, 1701 nt, Artificial Sequence
  derived and/or modified sequence opt3 from hemagglutinin__InfluenzaA__AHV83783
augaaggccauccuggugguccuccuuuacaccuucgcuacagcaaacgccgacacucugugcauuggcuaucacgcgaauaacagcacggauaccguugacacaguguuggagaagaauauaacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauuaauuacgaagaacucagggagcagcugagcaguguuuccucuuucgaacgguuugagaucuucccgaagacaagcuccuggcccaaccacgacucaaauaagggugugaccgccgcuuguccucaugcaggggccaaaggauuuuauaagaaccugauauggcucgucaaaaagggcaauaguuacccaaaauuacgccaaagcuauaucaacgauaagggcaaggaagugcugguacuuugggggauucaccaccccucuacgacuaccgaccagcaguccuuguaccagaaugcugaugccuacguuuucgugggaacaucacgauauagcaaaaaguuuaaaccugagaucgcgauucguccaaaggucagagaccaagaggguaggaugaacuacuauuggacucugguggaacccggcgauaaaaucaccuucgaggcaacagggaaccuaguggucccucgguacgccuuuaccauggaacgcaaugcuggaaguggcauaauuaucucugacacgccaguucaugauugcaacacuacaugucagaccccggagggugccauuaauacuucccuccccuuccagaacauccacccuaucacaauugggaagugcccaaaauauguaaagagcaccaagcugagacuugcaacgggacugaggaaugugcccucgauacagucucggggcuuguuuggcgcuaucgccggguucauugaaggagguuggaccggcaugguggacgggugguacggauaucaucaccaaaacgagcagggcuccgguuacgcggccgaccucaaaucaacacagaaugcaaucgauaagauaacuaacaaagucaauagugugauugagaagaugaacacccaguuuacagcuguugggaaagaguucaaucaccuggagaagcgcaucgaaaacuuaaauaagaaaguggacgauggcuuccuggacaucuggacuuacaacgccgagcuccuuguccuguuggaaaaugagcgaacccuagauuaucaugacagcaacgugaagaaccuguacgagaaaguaagaaaucaacucaagaacaaugcuaaagaaauuggaaacggcuguuuugaguucuaucacaagugcgauaauacauguauggaauccguuaagaacgggaccuacgacuauccuaaauacucugaggaagccaagcugaauagggagaaaaucgauggagugaaacuugagagcacucggauuuaucagauacuggcaaucuacucaacggucgccaguuccuuggugcucgucgugagccugggugcuauuucuuuuuggaugugcucaaacggcaguuuacagugccguaucuguaucuga

SEQ ID NO: 133927 - RNA, 1701 nt, Artificial Sequence; identical to SEQ ID NO: 132056
  derived and/or modified sequence opt3 from hemagglutinin__InfluenzaA__AHV83784

SEQ ID NO: 133928 - RNA, 1701 nt, Artificial Sequence; identical to SEQ ID NO: 132056
  derived and/or modified sequence opt3 from hemagglutinin__InfluenzaA__AHV83785

SEQ ID NO: 133929 - RNA, 1701 nt, Artificial Sequence; identical to SEQ ID NO: 132056
  derived and/or modified sequence opt3 from hemagglutinin__InfluenzaA__AHV83787

SEQ ID NO: 133930 - RNA, 1701 nt, Artificial Sequence
  derived and/or modified sequence opt3 from hemagglutinin__InfluenzaA__AHV83788
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggagugucuccccugcaucuugguaaaugcaacauagcuggcuggauccuggggaauccugagugugaaucauugaguacagccagcuccuggucuuacauuguugagaccucgucaagcgacaacggaacuugcuauccaggcgauuuugugaauuacgaagaacucagggagcagcugaguuccgucucuagcuucgaacgguuugagaucuucccgaagacauccucauggcccaaccacgacaguaauaagggugugaccgcagccuguccucaugcuggggcaaagagcuuuuauaagaaccugauuuggcucguuaaaaagggaaauucuuacccaaaauuaucccaaucauauaucaacgauaagggcaaggaaguacuggugcuuuggggcauacaccaccccagcacgacugccgaccagcagaguuuguaccagaaugcugaugccuacgucuucguggggaccucucgcuauuccaaaaaguuuaaaccugagaucgcgauucgaccaaaggugcgugaccaagagggaagaaugaacuacuauuggacacuggucgaacccggugauaaaaucacuuucgaggcaaccggcaaccuaguugugccuagguacgccuuuacaauggaacggaaugcugggagcggaauuaucauaucggacaccccaguacaugauugcaacacgacuugucagacaccggagggcgccauuaauaccucucuccccuuccagaacauccacccuauuacuaucgguaagugcccaaaauaugugaaguccacaaagcugcgccuugcaaccgggcugagaaauguccccucaauccagaguaggggauuguuuggcgcuauugccggcuucauagaagggggauggacggguaugguggacggcugguacggguaucaucaccaaaacgagcagggaagcggcuacgcggccgaccucaaauccacccagaaugcaaucgauaagauuacaaacaaaguuaauucugugaucgagaagaugaacacucaguuuaccgcugucgguaaagaguucaaucaccuggagaagcggauagaaaacuuaaauaagaaaguggacgauggguuccuggacauuuggacauacaacgccgagcuccuuguacuguuggaaaaugagcgcacucuagauuaucaugacagcaacguuaagaaccuguacgagaaagugcgaaaucaacucaagaacaaugcuaaagaaaucggcaacggauguuuugaguucuaucacaagugcgauaauaccuguauggaaucagucaagaacggcacauacgacuauccuaaauacagugaggaagccaagcugaauagagagaaaaucgauggggugaaacuugaguccaccaggauuuaucagauccuggcaauuuacagcacugucgccucuucauuggugcucguugugagucugggagcuaucagcuuuuggaugugcuccaacgguucuuuacagugccggauauguauuuga

SEQ ID NO: 133931 - RNA, 1701 nt, Artificial Sequence; identical to SEQ ID NO: 133918
  derived and/or modified sequence opt3 from hemagglutinin__InfluenzaA__AHV83789

SEQ ID NO: 133932 - RNA, 1701 nt, Artificial Sequence; identical to SEQ ID NO: 132056
  derived and/or modified sequence opt3 from hemagglutinin__InfluenzaA__AHV83790

SEQ ID NO: 133933 - RNA, 1701 nt, Artificial Sequence; identical to SEQ ID NO: 132056
  derived and/or modified sequence opt3 from hemagglutinin__InfluenzaA__AHV83791

SEQ ID NO: 133934 - RNA, 1701 nt, Artificial Sequence; identical to SEQ ID NO: 132056
  derived and/or modified sequence opt3 from hemagglutinin__InfluenzaA__AHV83792

SEQ ID NO: 133935 - RNA, 1701 nt, Artificial Sequence
  derived and/or modified sequence opt3 from hemagglutinin__InfluenzaA__AHV83793
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaaaaguuugagauuuucccgaagacaagcuccuggcccaaccacgacucaaauaaaggugucaccgccgcuuguccucaugcaggggccaagaguuuuuauaaaaaccugaucuggcucgugaagaaaggaaauagcuacccaaaguuaucucaauccuauauaaacgauaagggcaaagaaauccugguacuuuggggcauucaccaccccucaacgacugcugaccagcagagcuuguaccagaaugccgaugcguacguuuucguggggaccagucgguauucuaagaaauuuaagccugagaucgcaauucgcccaaaaguccgagaccaagagggacguaugaacuacuauuggacacugguggaacccggugauaagaucacuuucgaggccaccggcaaccuaguggucccuagauacgcuuuuacaauggaaaggaaugccggguccggaauaauuaucagcgacaccccaguucaugauugcaacacgacuugucagacaccggagggcgcaauuaauaccucgcuccccuuccagaacauccacccuaucacuauugguaaaugcccaaaguaugugaagucuacaaaacugcggcuugcuaccgggcugcgcaauguacccuccauacagucaagaggauuguuuggcgccaucgcgggcuucauugaagggggauggacggguaugguggacggcugguacggguaucaucaccaaaacgagcagggaaguggcuacgccgcagaccaaaagagcacccagaaugcuaucgauaaaauaacaaacaaggucaauuccgugauugagaaaaugaacacucaguuuaccgccguugguaaggaguucaaucaccucgagaagaggaucgaaaaccugaauaaaaagguggacgauggguucuuagacaucuggacauacaacgcugagcugcucguccuucuggaaaaugagcggacuuuggauuaucaugacucuaacgugaaaaaccuauacgagaagguacgcaaucagcugaaaaacaaugccaaggaaauuggcaacggauguuuugaguucuaucacaagugcgauaauaccuguauggaaagcguuaaaaacggcacauacgacuauccuaaguacucagaggaagcaaaacucaaucgagagaagaucgauggggugaaacuggagaguaccagaauuuaucagauacuugccaucuacuccacugucgcuagcucucugguguuggucgugucacucggagcgauuaguuuuuggaugugcagcaacgguucccugcaaugcaggaucuguaucuga

SEQ ID NO: 133936 - RNA, 1701 nt, Artificial Sequence
  derived and/or modified sequence opt3 from hemagglutinin__InfluenzaA__AHV83794
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccagaaaagcacccagaaugcuauugauaagaucacaaacaaaguuaauuccgugauagagaagaugaacacucaauuuaccgccguggguaaagaguucaaucaccucgagaagcggauugaaaaccugaauaagaaagucgacgauggguucuuagacaucuggacauacaacgcugagcugcucgugcuucuggaaaaugagcgcacuuuggauuaucaugacucuaacguaaagaaccuauacgagaaaguucgaaaucagcugaagaacaaugccaaagaaaucggcaacggauguuuugaguucuaucacaagugcgauaauaccuguauggaaagcgugaagaacggcacauacgacuauccuaaauacucagaggaagcaaagcucaauagagagaaaauugauggggucaagcuggagaguaccaggaucuaucagauucuugccauauacuccacuguggcuagcucucuggucuuggugguuucacucggagcgaucaguuuuuggaugugcagcaacgguucccugcaaugccggauuuguaucuga

SEQ ID NO: 133937 - RNA, 1701 nt, Artificial Sequence
  derived and/or modified sequence opt3 from hemagglutinin__InfluenzaA__AHV83795
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucagcagccaguagcugguccuacauuguugagacaucuucgucagacaacggaaccugcuauccaggcgauuuuaucaauuacgaagaacucagggagcagcugagcaguguguccucuuucgaacgguuugagauuuucccgaagacuagcuccuggcccaaccacgacucaaauaagggugucacagcugcauguccucaugccggggcuaaaaguuuuuauaagaaccugaucuggcucgugaaaaagggaaauagcuacccaaaauuaucucaauccuauauaaacgauaagggcaaggaaguacugguucuuuggggcauccaccaccccucaaccacggccgaccagcagagcuuguaccagaaugcggauacuuacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccagaaaagcacccagaaugcuauugauaagaucacaaacaaaguuaauuccgugauagagaagaugaacacucaauuuaccgccguggguaaagaguucaaucaccucgagaagcggauugaaaaccugaauaagaaagucgacgauggguucuuagacaucuggacauacaacgcugagcugcucgugcuucuggaaaaugagcgcacuuuggauuaucaugacucuaacguaaagaaccuauacgagaaaguucgaaaucagcugaagaacaaugccaaagaaaucggcaacggauguuuugaguucuaucacaagugcgauaauaccuguauggaaagcgugaagaacggcacauacgacuauccuaaauacucagaggaagcaaagcucaauagagagaaaauugauggggucaagcuggagaguaccaaaaucuaucagauucuugccauauacuccacuguggcuagcucucuggucuuggugguuucacucggagcgaucaguuuuuggaugugcagcaacgguucccugcaaugcaggauuuguaucuga

SEQ ID NO: 133938 - RNA, 1701 nt, Artificial Sequence; identical to SEQ ID NO: 133936
  derived and/or modified sequence opt3 from hemagglutinin__InfluenzaA__AHV83796

SEQ ID NO: 133939 - RNA, 1701 nt, Artificial Sequence; identical to SEQ ID NO: 132056
  derived and/or modified sequence opt3 from hemagglutinin__InfluenzaA__AHV83798

SEQ ID NO: 133940 - RNA, 1701 nt, Artificial Sequence; identical to SEQ ID NO: 132056
  derived and/or modified sequence opt3 from hemagglutinin__InfluenzaA__AHV83799

SEQ ID NO: 133941 - RNA, 1701 nt, Artificial Sequence
  derived and/or modified sequence opt3 from hemagglutinin__InfluenzaA__AHV83800
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccucaaaagcacccagaaugcuauugauaagaucacaaacaaaguaaauuccguuauagagaagaugaacacucaguuuaccgccguggguaaagaguucaaucaccuggagaagcggauugaaaacuuaaauaagaaagucgacgauggguuccuggacaucuggacauacaacgcugagcuccuugugcuguuggaaaaugagaagacucuagauuaucaugacucuaacgugaaaaaccuguacgagaagguucgcaaucaacucaaaaacaaugccaaggaaaucggcaacggauguuuugaguucuaucacaagugcgauaauaccuguauggaaagcgugaaaaacggcacauacgacuauccuaaguacucagaggaagcaaaacugaaucgagagaagauugauggggucaaacuugagaguaccagaaucuaucagauucuggccauauacuccacuguggcuagcucuuugguccucgugguuucacugggagcgaucaguuuuuggaugugcagcaacgguuccuuacagugcaggauuuguaucuga

SEQ ID NO: 133942 - RNA, 1701 nt, Artificial Sequence
  derived and/or modified sequence opt3 from hemagglutinin__InfluenzaA__AHV83801
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccagaaaagcacccagaaugcuauugauaagaucacaaacaaaguuaauuccgugauagagaagaugaacacucaauuuaccgccguggguaaagaguucaaucaccucgagaagcggauugaaaaccugaauaagaaagucgacgauggguucuuagacaucuggacauacaacgcugagcugcucgugcuucuggaaaaugagcgcacuuuggauuaucaugacucuaacguaaagaaccuauacgagaaaguucgaaaucagcugaagaacaaugccaaagaaaucggcaacggauguuuugaguucuaucacaagugcgauaauaccuguauggaaagcgugaagaacggcacauacgacuauccuaaauacucagaggaagcaaagcucaauagagagaaaauugauggggucaagcuggagaguaccaaaaucuaucagauucuugccauauacuccacuguggcuagcucucuggucuuggugguuucacucggagcgaucaguuuuuggaugugcagcaacgguucccugcaaugcaggauuuguaucuga

SEQ ID NO: 133943 - RNA, 1701 nt, Artificial Sequence
  derived and/or modified sequence opt3 from hemagglutinin__InfluenzaA__AHV83802
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagggguuguaccagaauguggaugccuacgucuucgugggaaccagccgcuauaguaaaaaguuuaaaccugagauugcgauccgaccaaaggugcgugaccaagaggguagaaugaacuacuauuggacacuggucgaacccggcgauaaaauuacuuucgaggcaaccgggaaccuaguugugccuagguacgccuuuacaauggaacggaaugcuggaucuggcaucauaauuuccgacaccccaguacaugauugcaacacgacuugucagacaccggagggugccaucaauaccagccuccccuuccagaacauucacccuaucacuaucgggaagugcccaaaauaugugaagucgacaaagcugcgccuugcaaccggacugagaaauguccccucuauucaguccaggggcuuguuuggcgcuauagccggguucaucgaaggagguuggacgggcaugguggacgggugguacggauaucaucaccaaaacgagcagggcucagguuacgcggccgaccucaaaaguacccagaaugcaauugauaagaucacaaacaaaguuaauagcgugauagagaagaugaacacucaguuuaccgcugucgggaaagaguucaaucaccuggagaagcggauugaaaacuuaaauaagaaaguggacgauggcuuccuggacaucuggacauacaacgccgagcuccuuguacuguuggaaaaugagcgcacucuagauuaucaugacuccaacguuaagaaccuguacgagaaagugcgaaaucaacucaagaacaaugcuaaagaaaucggaaacggcuguuuugaguucuaucacaagugcgauaauaccuguauggaaucugucaagaacgggacauacgacuauccuaaauacagcgaggaagccaagcugaauagagagaaaauugauggagugaaacuugagucaaccaggaucuaucagauucuggcaauauacaguacugucgccuccagcuuggugcucguugugucucugggugcuaucucauuuuggaugugcaguaacggcagcuuacagugccggauuuguaucuga

SEQ ID NO: 133944 - RNA, 1701 nt, Artificial Sequence; identical to SEQ ID NO: 132056
  derived and/or modified sequence opt3 from hemagglutinin__InfluenzaA__AHV83803

SEQ ID NO: 133945 - RNA, 1701 nt, Artificial Sequence; identical to SEQ ID NO: 132056
  derived and/or modified sequence opt3 from hemagglutinin__InfluenzaA__AHV83804

SEQ ID NO: 133946 - RNA, 1701 nt, Artificial Sequence; identical to SEQ ID NO: 132056
  derived and/or modified sequence opt3 from hemagglutinin__InfluenzaA__AHV83805

SEQ ID NO: 133947 - RNA, 1701 nt, Artificial Sequence; identical to SEQ ID NO: 133936
  derived and/or modified sequence opt3 from hemagglutinin__InfluenzaA__AHV83806

SEQ ID NO: 133948 - RNA, 1701 nt, Artificial Sequence
  derived and/or modified sequence opt3 from hemagglutinin__InfluenzaA__AHV83807
augaaggccauccuggugguccuccuuuacaccuucgcuacagcaaacgccgacacucugugcauuggcuaucacgcgaauaacagcacggauaccguugacacaguguuggagaaggauguaacugugacccauuccgucaauuuacuggaagacaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucaacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucucaauccuauauaaaugacaagggcaaggaaguacugguucuuuggggcauccaccaccccucaacgacugcugaucagcagagcuuguaccagaacgccgacgcguacguguucgucgggaccagucgcuauucuaaaaaguuuaaaccugagauugcaauccgaccaaaggugcgugaucaagagggaagaaugaauuacuauuggacacugguggaacccggugacaaaauuacuuucgaggccaccggcaaccuagucguuccuagguacgcuuuuacaauggaacggaacgccggguccggaaucauaauuagcgauaccccagugcaugacugcaauacgacuugucagacaccggagggcgcaaucaacaccucgcuccccuuccagaauauucacccuaucacuaucgguaagugcccaaaauauguaaagucuacaaagcugcgccuugcuaccgggcugagaaacgugcccuccauucagucaaggggauuguuuggcgccauagcgggcuucaucgaagggggauggacggguauggucgacggcugguacggguaucaucaccaaaaugagcagggaaguggcuacgccgcagaucucaaaagcacccagaacgcuauugacaagaucacaaauaaagugaacuccguuauagagaagaugaauacucaguuuaccgccguggguaaagaguucaaccaccuggagaagcggauugaaaauuuaaacaagaaagucgaugacggguuccuggauaucuggacauacaaugcugagcuccuugugcuguuggaaaacgagcgcacucuagacuaucaugauucuaauguaaagaaccuguacgagaaaguucgaaaccaacucaagaauaacgccaaagaaaucggcaauggauguuuugaguucuaucacaagugcgacaacaccuguauggaaagcgugaagaauggcacauacgauuauccuaaauacucagaggaagcaaagcugaacagagagaaaauugacggggucaaacuugagaguaccaggaucuaucagauucuggccauauacuccacuguggcuagcucuuugguccucgugguuucacugggagcgaucaguuuuuggaugugcagcaaugguuccuuacagugccggauuuguaucuga

SEQ ID NO: 133949 - RNA, 1701 nt, Artificial Sequence
  derived and/or modified sequence opt3 from hemagglutinin__InfluenzaA__AHV83808
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaggcguacguguucgucgggaccagucgcuauucuaaaaaguuuaaaccugagauugcaauccgaccaaaggugcgugaucaagaaggaagaaugaacuacuauuggacacugguggagcccggugacaaaauuacuuucgaagccaccggcaaccuagucguuccuagguacgcuuuuacaauggagcggaaugccggguccggaaucauaauuagcgauaccccagugcaugacugcaacacgacuugucagacaccggaaggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgauggcugguacggguaucaucaccaaaacgagcagggaaguggcuacgccgcagaccucaaaagcacccagaaugcuauugacaagaucacaaacaaaguuaauuccgugauagaaaagaugaacacucaguuuaccgccguggguaaagaguucaaucaccuggaaaagcggauugagaacuuaaauaagaaagucgaugacggguuccuggauaucuggacauacaacgcugaacuccuugugcuguuggagaaugagcgcacucuagacuaucaugauucuaacguaaagaaccuguacgaaaaaguucgaaaucaacucaagaacaaugccaaagagaucggcaacggauguuuugaguucuaucacaagugcgacaauauguguauggaaagcgugaagaacggcaccuacgauuauccuaaauacucagaagaggcaaagcugaauagagagaaaauugacggggucaaacuugaaaguacaaggaucuaucagauucuggccauauacuccaccguggcuagcucuuugguccucgugguuucacugggagcgaucaguuuuuggaugugcagcaacgguuccuuacagugccggauuuguaucuga

SEQ ID NO: 133950 - RNA, 1701 nt, Artificial Sequence; identical to SEQ ID NO: 132056
  derived and/or modified sequence opt3 from hemagglutinin__InfluenzaA__AHV83809

SEQ ID NO: 133951 - RNA, 1701 nt, Artificial Sequence; identical to SEQ ID NO: 133037
  derived and/or modified sequence opt3 from hemagglutinin__InfluenzaA__AHV83810

SEQ ID NO: 133952 - RNA, 1701 nt, Artificial Sequence
  derived and/or modified sequence opt3 from hemagglutinin__InfluenzaA__AHV83812
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaagaacucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuaucucaauccuauauaaacgauaagggcaaggaaguacugguucuuuggggcauccaccaccccucaacuaccgccgaccagcagagcuuguaccagaaugcugaugccuacguguucgucgggacaagucgcuauucuaaaaaguuuaaaccugagauugcgauccgaccaaaggugcgugaccaagagggaagaaugaacuacuauuggacucugguggaacccggugauaaaauuaccuucgaggcaacaggcaaccuagucguuccuagguacgccuuuaccauggaacggaaugcuggguccggaaucauaauuagcgacacgccagugcaugauugcaacacuacaugucagaccccggagggcgccaucaauacuucgcuccccuuccagaacauucacccuaucacaaucgguaagugcccaaaauauguaaagucuaccaagcugcgccuugcaacggggcugagaaaugugcccuccauucagucaaggggauuguuuggcgcuauagccggcuucaucgaagggggauggaccgguauggucgacggcugguacggguaucaucaccaaaacgagcagggaaguggcuacgcggccgaccucaaaagcacacagaaugcaauugauaagaucacuaacaaaguuaauuccgugauagagaagaugaacacccaguuuacagcuguggguaaagaguucaaucaccuggagaagcggauugaaaacuuaaauaagaaagucgacgauggguuccuggacaucuggacuuacaacgccgagcuccuugugcuguuggaaaaugagcgcacccuagauuaucaugacucuaacguaaagaaccuguacgagaaaguucgaaaucaacucaagaacaaugcuaaagaaaucggcaacggauguuuugaguucuaucacaagugcgauaauacauguauggaaagcgugaagaacggcaccuacgaguauccuaaauacucagaagaggccaagcugaauagagagaaaauugacggggucaaacuugaaaguacuaagaucuaucagauucuggcaauauacuccacgguggccagcucuuugguccucgugguuucacugggagcuaucaguuuuuggaugugcagcaacgguuccuuacagugcaggauuuguaucuga

SEQ ID NO: 133953 - RNA, 1701 nt, Artificial Sequence; identical to SEQ ID NO: 132056
  derived and/or modified sequence opt3 from hemagglutinin__InfluenzaA__AHV83813

SEQ ID NO: 133954 - RNA, 1701 nt, Artificial Sequence
  derived and/or modified sequence opt3 from hemagglutinin__InfluenzaA__AHV83814
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccucaaaagcacccagaaugcuauugauaagaucacaaacaaaguuaauuccgugauagagaagaugaacacucaguuuaccgccguggguaaagaguucaaucaccuggagaagcggauugaaaacuuaaauaagaaagucgacgauggguuccuggacaucuggacauacaacgcugagcuccuugugcuguuggaaaaugagcgcaaccuagauuaucaugacucuaacguaaagaaucuguacgagaaaguucgaaaccaacucaagacuaaugccaaagaaaucggcaacggauguuuugaguucuaucacaagugcgauaauaccuguauggaaagcgugaagaacggcacauacgacuauccuaaauacucagaggaagcaaagcugaauagagagaaaauugauggggucaaacuugagaguaccaggaucuaucagauucuggccauauacuccacuguggcuagcucuuugguccucgugguuucacugggagcgaucaguuuuuggaugugcagcaacgguuccuuacagugccggauuuguaucuga

SEQ ID NO: 133955 - RNA, 1701 nt, Artificial Sequence; identical to SEQ ID NO: 133037
  derived and/or modified sequence opt3 from hemagglutinin__InfluenzaA__AHV83815

SEQ ID NO: 133956 - RNA, 1701 nt, Artificial Sequence; identical to SEQ ID NO: 132056
  derived and/or modified sequence opt3 from hemagglutinin__InfluenzaA__AHV83816

SEQ ID NO: 133957 - RNA, 1701 nt, Artificial Sequence
  derived and/or modified sequence opt3 from hemagglutinin__InfluenzaA__AHV83817
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugguguggcucguaaagaagggaaauagcuacccaaaauuaucucaauccuauaucaacgauaagggcaaggaaguucuggugcuuuggggcauacaccaccccucaacgacugcugaccagcagagcuuguaccagaaugccgaugcguacgucuucguggggaccagucgcuauucuaaaaaguuuaaaccugagaucgcaauucgaccaaaggugcgugaccaagagggaagaaugaacuacuauuggacacuggucgaacccggugauaaaaucacuuucgaggccaccggcaaccuaguugugccuagguacgcuuuuacaauggaacggaaugccggguccggaauuaucauaagcgacaccccaguacaugauugcaacacgacuugucagacaccggagggcgcaauuaauaccucgcuccccuuccagaacauccacccuauuacuaucgguaagugcccaaaauaugugaagucuacaaagcugcgccuugcuaccgggcugagaaauguccccuccauccagucaaggggauuguuuggcgccauugcgggcuucauagaagggggauggacggguaugguggacggcugguacggguaucaucaccaaaacgagcagggaaguggcuacgccgcagaccucaaaagcacccagaaugcuaucgauaagauuacaaacaaaguuaauuccgugaucgagaagaugaacacucaguuuaccgccgucgguaaagaguucaaucaccuggagaagcggauagaaaacuuaaauaagaaaguggacgauggguuccuggacauuuggacauacaacgcugagcuccuuguacuguuggaaaaugagcgcacucuagauuaucaugacucuaacguuaagaaccuguacgagaaagugcgaaaucaacucaagaacaaugccaaagaaaucggcaacggauguuuugaguucuaucacaagugcgauaauaccuguauggaaagcgucaagaacggcacauacgacuauccuaaauacucagaggaagcaaagcugaauagagagaaaaucgauggggugaaacuugagaguaccaggauuuaucagauccuggccauuuacuccacugucgcuagcucuuuggugcucguugugucacugggagcgauaaguuuuuggaugugcagcaacgguuccuuacagugccggaucuguauuuga

SEQ ID NO: 133958 - RNA, 1701 nt, Artificial Sequence; identical to SEQ ID NO: 133936
  derived and/or modified sequence opt3 from hemagglutinin__InfluenzaA__AHV83818

SEQ ID NO: 133959 - RNA, 1701 nt, Artificial Sequence; identical to SEQ ID NO: 133918
  derived and/or modified sequence opt3 from hemagglutinin__InfluenzaA__AHV83819

SEQ ID NO: 133960 - RNA, 1701 nt, Artificial Sequence
  derived and/or modified sequence opt3 from hemagglutinin__InfluenzaA__AHV83821
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggagugucuccccugcaucuugguaaaugcaacauagcuggcuggauccuggggaauccugagugugaaucauugaguacagccagcuccuggucuuacauuguugagaccucgucaagcgacaacggaacuugcuauccaggcgauuuugugaauuacgaagaacucagggagcagcugaguuccgucucuagcuucgaacgguuugagaucuucccgaagacauccucauggcccaaccacgacaguaauaagggugugaccgcagccuguccucaugcuggggcaaagagcuuuuauaagaaccugauuuggcucguuaaaaagggaaauucuuacccaaaauuaucccaaucauauaucaacgauaagggcaaggaaguacuggugcuuuggggcauacaccaccccagcacgacugccgaccagcagaguuuguaccagaaugcugaugccuacgucuucguggggaccucucgcuauuccaaaaaguuuaaaccugagaucgcgauucgaccaaaggugcgugaccaagagggaagaaugaacuacuauuggacacuggucgaacccggugauaaaaucacuuucgaggcaaccggcaaccuaguugugccuagguacgccuuuacaauggaacggaaugcugggagcggaauuaucauaucggacaccccaguacauaacugcaauacgacuugucagacaccggagggcgccauuaacaccucucuccccuuccagaauauccacccuauuacuaucgguaagugcccaaaauaugugaaguccacaaagcugcgccuugcaaccgggcugagaaacguccccucaauccagaguaggggauuguuuggcgcuauugccggcuucauagaagggggauggacggguaugguggauggcugguacggguaucaucaccaaaaugagcagggaagcggcuacgcggccgaccucaaauccacccagaacgcaaucgacaagauuacaaauaaaguuaacucugugaucgagaagaugaauacucaguuuaccgcugucgguaaagaguucaaccaccuggagaagcggauagaaaauuuaaacaagaaaguggaugacggguuccuggauauuuggacauacaaugccgagcuccuuguacuguuggaaaacgagcgcacucuagacuaucaugauagcaacguuaagaaucuguacgagaaagugcgaaaccaacucaagaauaacgcuaaagaaaucggcaauggauguuuugaguucuaucacaagugcgacaacaccuguauggaaucagucaagaauggcacauacgauuauccuaaauacagugaggaagccaagcugaacagagagaaaaucgacggggugaaacuugaguccaccaggauuuaucagauccuggcaauuuacagcacugucgccucuucauuggugcucguugugagucugggagcuaucagcuuuuggaugugcuccaaugguucuuuacagugccggauauguauuuga

SEQ ID NO: 133961 - RNA, 1701 nt, Artificial Sequence
  derived and/or modified sequence opt3 from hemagglutinin__InfluenzaA__AHV83822
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggagugucuccccugcaucuugguaaaugcaacauagcuggcuggauccuggggaauccugagugugaaucauugaguacagccagcuccuggucuuacauuguugagaccucgucaagcgacaacggaacuugcuauccaggcgauuuugugaauuacgaagaacucagggagcagcugaguuccgucucuagcuucgaacgguuugagaucuucccgaagacauccucauggcccaaccacgacaguaauaagggugugaccgcagccuguccucaugcuggggcaaagagcuuuuauaagaaccugauuuggcucguuaaaaagggaaauucuuacccaaaauuaucccaaucauauaucaacgauaagggcaaggaaguacuggugcuuuggggcauacaccaccccagcacgacugccgaccagcagaguuuguaccagaaugcugaugccuacgucuucguggggaccucucgcuauuccaaaaaguuuaaaccugagaucgcgauucgaccaaaggugcgugaccaagagggaagaaugaacuacuauuggacacuggucgaacccggugauaaaaucacuuucgaggcaaccggcaaccuaguugugccuagguacgccuuuacaauggaacggaaugcugggagcggaauuaucauaucggacaccccaguacaugauugcaacacgacuugucagacaccggagggcgccauuaauaccucucuccccuuccagaacauccacccuauuacuaucgguaagugcccaaaauaugugaaguccacaaagcugcgccuugcaaccgggcugagaaauguccccucaauccagaguaggggauuguuuggcgcuauugccggcuucauagaagggggauggacggguaugguggacggcugguacggguaucaucaccaaaacgagcagggaagcggcuacgcggccgaccucaaauccacccagaaugcaaucgauaagauuacaaacaaaguuaauucuaucauagagaagaugaacacucaguuuaccgcuguggguaaagaguucaaucaccuggagaagcggauugaaaacuuaaauaagaaagucgacgauggguuccuggacaucuggacauacaacgccgagcuccuugugcuguuggaaaaugagcgcacucuagauuaucaugacagcaacguaaagaaccuguacgagaaaguucgaaaucaacucaagaacaaugcuaaagaaaucggcaacggauguuuugaguucuaucacaagugcgauaauaccuguauggaaucagugaagaacggcacauacgacuauccuaaauacagugaggaagccaagcugaauagagagaaaauugauggggucaaacuugaguccaccaggaucuaucagauucuggcaauauacagcacuguggccucuucauugguccucgugguuagucugggagcuaucagcuuuuggaugugcuccaacgguucuuuacagugccggauuuguaucuga

SEQ ID NO: 133962 - RNA, 1701 nt, Artificial Sequence
  derived and/or modified sequence opt3 from hemagglutinin__InfluenzaA__AHV83823
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaaauaucucaauccuauaucaacgauaagggcaaggaaguauuaguucuguggggcauucaccaccccucaacgacugcugaccagcagagccuuuaccagaaugccgaugcguacguguucgucgggaccagucgcuauucuaaaaaguuuaaaccugagaucgcaauucgaccaaaggugcgugaccaagagggaagaaugaacuacuauuggacauugguggaacccggugauaaaaucacuuucgaggccaccggcaaccuggucguuccuagguacgcuuuuacaauggaacggaauaccggguccggaauaauuaucagcgacacgccagugcaugauugcaacacuacaugucagaccccggagggcgccauuaauacuucgcuacccuuccagaacauccacccuaucacaauugguaagugcccaaaauauguaaagucuaccaagcuccgccuggcaacggggcuuagaaaugugcccuccauacagucaaggggacuguuuggcgcuaucgccggcuucauugaagggggauggaccgguauggucgacggcugguacggguaucaucaccaaaacgagcagggaaguggcuacgcggccgacuugaaaagcacacagaaugcaaucgauaagauaacuaacaaaguuaauuccgugauugagaagaugaacacccaguuuacagcuguggguaaagaguucaaucaccucgagaagcggaucgaaaaccugaauaagaaagucgacgauggguucuuagacaucuggacuuacaacgccgagcugcucgugcuucuggaaaaugagcgcaccuuggauuaucaugacucuaacguaaagaaccuauacgagaaaguucgaaaucaacugaagaacaaugcuaaagaaauuggcaacggauguuuugaguucuaucacaagugcgauaauacauguauggaaagcgugaagaacggcaccuacgacuauccuaaauacucagaggaagccaagcucaauagagagaaaaucgauggggucaagcuggagaguacuaggauuuaucagauacuugcaaucuacuccacgguggccagcucucuggucuuggugguuucacucggagcuauuaguuuuuggaugugcagcaacgguucccugcagugccggaucuguaucuga

SEQ ID NO: 133963 - RNA, 1701 nt, Artificial Sequence
  derived and/or modified sequence opt3 from hemagglutinin__InfluenzaA__AHV83824
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuacgccaaucuuauauaaacgauaagggcaaggaaguacugguucuuuggggcauccaccaccccuccacgacuaccgaccagcagucauuguaccagaaugcugaugccuacguguucgucgggacaagccgauauaguaaaaaguuuaaaccugagauugcgauccguccaaaggugagagaccaagagggaaggaugaacuacuauuggacucugguggaacccggugauaaaauuaccuucgaggcaacaggcaaccuagucguuccucgguacgccuuuaccauggaacgcaaugcugggucuggaaucauaauuuccgacacgccagugcaugauugcaacacuacaugucagaccccggagggcgccaucaauacuagccuccccuuccagaacauucacccuaucacaaucgguaagugcccaaaauauguaaagucgaccaagcugagacuugcaacggggcugaggaaugugcccucuauucagucccggggauuguuuggcgcuauagccggcuucaucgaagggggauggaccgguauggucgacggcugguacggguaucaucaccaaaacgagcagggaucaggcuacgcggccgaccucaaaaguacacagaaugcaauugauaagaucacuaacaaagugaauagcguuauagagaagaugaacacccaguuuacagcuguggguaaagaguucaaucaccuggagaagcgcauugaaaacuuaaauaagaaagucgacgauggguuccuggacaucuggacuuacaacgccgagcuccuugugcuguuggaaaaugagcgaaaccuagauuaucaugacuccaacguaaagaaucuguacgagaaaguuagaaaccaacucaagaauaacgcuaaagaaaucggcaauggauguuuugaguucuaucacaagugcgauaacaccuguauggaaucugugaagaauggcacauacgacuauccuaaauacagcgaggaagccaagcugaacagggagaaaauugauggggucaaacuugagucaacccggaucuaucagauucuggcaauauacaguacuguggccuccagcuugguccucgugguuucucugggagcuaucucauuuuggaugugcaguaaugguagcuuacagugccguauuuguaucuga

SEQ ID NO: 133964 - RNA, 1701 nt, Artificial Sequence; identical to SEQ ID NO: 133936
  derived and/or modified sequence opt3 from hemagglutinin__InfluenzaA__AHV83825

SEQ ID NO: 133965 - RNA, 1701 nt, Artificial Sequence
  derived and/or modified sequence opt3 from hemagglutinin__InfluenzaA__AHV83826
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauuucaacgauaagggcaaggaaguacugguucuuuggggcauacaccaccccucaacgacugcugaccagcagagcuuguaccagaaugccgaugcguacguguuugucgggaccagucgcuauucuaaaaaguucaaaccugagaucgcaauucgaccaaaggugcgugaccaagagggaagaaugaacuacuauuggacacugguggaacccggugauaaaaucacuuuugaggccaccggcaaccuagucguuccuagguacgcuuucacaauggaacggaaugccggguccggaauuaucauaagcgacaccccagugcaugauugcaacacgacuugucagacaccggagggcgcaauuaauaccucgcuccccuuucagaacauccacccuauuacuaucgguaagugcccaaaauauguaaagucuacaaagcugcgccuugcuaccgggcugagaaaugugcccuccauccagucaaggggauuguucggcgccauugcgggcuuuauagaagggggauggacggguauggucgacggcugguacggguaucaucaccaaaacgagcagggaaguggcuacgccgcagaccucaaaagcacccagaaugcuaucgauaagauuacaaacaaaguuaauuccgugaucgagaagaugaacacucaguucaccgccguggguaaagaguucaaucaccuggagaagcggauagaaaacuuaaauaagaaagucgacgauggguuucuggacauuuggacauacaacgcugagcuccuugugcuguuggaaaaugagcgcacucuagauuaucaugacucuaacguaaagaaccuguacgagaaaguucgaaaucaacucaagaacaaugccaaagaaaucggcaacggauguuucgaguuuuaucacaagugcgauaauaccuguauggaaagcgugaagaacggcacauacgacuauccuaaauacucagaggaagcaaagcugaauagagagaaaaucgauggggucaaacuugagaguaccaggauuuaucagauccuggccauuuacuccacugcugcgagcucuuuggugcucgucgugucacugggagcaauaaguuucuggaugugcagcaacgguuccuuacagugccggaucuguauuuga

SEQ ID NO: 133966 - RNA, 1701 nt, Artificial Sequence; identical to SEQ ID NO: 132056
  derived and/or modified sequence opt3 from hemagglutinin__InfluenzaA__AHV83827

SEQ ID NO: 133967 - RNA, 1701 nt, Artificial Sequence; identical to SEQ ID NO: 132056
  derived and/or modified sequence opt3 from hemagglutinin__InfluenzaA__AHV83828

SEQ ID NO: 133968 - RNA, 1701 nt, Artificial Sequence
  derived and/or modified sequence opt3 from hemagglutinin__InfluenzaA__AHV83829
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucaauuacgaggagcucagggaacagcugagcaguguguccucuuucgagcgguuugaaauuuucccgaaaacaagcuccuggcccaaccacgacucaaauaagggugucaccgccgcuuguccucaugcaggggccaagaguuuuuauaaaaaccugaucuggcucgugaagaaaggaaauagcuacccaaagauaucucaauccuauaucaacgauaaaggcaaggagguauuaguucuguggggcauucaccaccccucaacgacugcugaccagcagagccuuuaccagaaugccgaugcguacguguucgucgggaccagucgcuauucuaagaaauuuaagccugagaucgcaauucgaccaaaagugcgugaccaagaaggaagaaugaacuacuauuggacauugguggagcccggugauaagaucacuuucgaagccaccggcaaccuggucguuccuagguacgcuuuuacaauggagcggaaugccggguccggaauaauuaucagcgacaccccagugcaugauugcaacacgacuugucagacaccggaaggcgcaauuaauaccucgcuacccuuccagaacauccacccuaucacuauugguaaaugcccaaaguauguaaaaucuacaaagcuccgccuggcuaccgggcuuagaaaugugcccuccauacagucaaggggacuguuuggcgccaucgcgggcuucauugaagggggauggacggguauggucgacggcugguacggguaucaucaccaaaacgagcagggaaguggcuacgccgcagacuugaaaagcacccagaaugcuaucgauaaaauaacaaacaagguaaauuccguuauugaaaagaugaacacucaguuuaccgccguggguaaggaguucaaucaccucgaaaaacggaucgagaaccugaauaagaaggucgacgauggguucuuagacaucuggacauacaacgcugaacugcucgugcuucuggagaaugagcgcacuuuggauuaucaugacucuaacgugaaaaaccuauacgaaaagguucgaaaucaacugaaaaacaaugccaaggagauuggcaacggauguuuugaguucuaucacaaaugcgauaauaccuguauggagagcgugaagaacggcacauacgacuauccuaaguacucagaagaggcaaaacucaauagagagaagaucgauggggucaaacuggaaaguaccaggauuuaucagauacuugccaucuacuccacuguggcuagcucucuggucuuggugguuucacucggagcgauuaguuuuuggaugugcagcaacgguucccugcagugccggaucuguaucuga

SEQ ID NO: 133969 - RNA, 1701 nt, Artificial Sequence; identical to SEQ ID NO: 132056
  derived and/or modified sequence opt3 from hemagglutinin__InfluenzaA__AHV83830

SEQ ID NO: 133970 - RNA, 1701 nt, Artificial Sequence
  derived and/or modified sequence opt3 from hemagglutinin__InfluenzaA__AHV83831
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgauugcugaccagcagagcuuguaccagaaugccgaugcguacguguucgucgggaccagucgcuauucuaaaaaguuuaaaccugagaucgcaauucgaccaaaggugcgugaccaagagggaagaaugaacuacuauuggacucugguggaacccggugauaaaaucacauucgaggccacuggcaaccuagucguuccuagguacgcuuuuaccauggaacggaaugccggguccggaauaauugugagcgacacaccaguacaugauugcaacaccacgugucagacuccggagggcgcaaucaauacaucgcuccccuuccagaacauucacccuaucaccaucgguaagugcccaaaauaugugaagucuacuaagcugcgccuugcuacagggcugagaaauguccccuccauucagucaaggggauuguuuggcgccauagcgggcuucaucgaagggggauggaccgguaugguggacggcugguacggguaucaucaccaaaacgagcagggaaguggcuacgccgcagaccucaaaagcacgcagaaugcuauugauaagaucaccaacaaaguuaauuccgugauagagaagaugaacacacaguuuacugccgucgguaaagaguucaaucaccuggagaagcggauugaaaacuuaaauaagaaaguggacgauggguuccuggacaucuggaccuacaacgcugagcuccuuguacuguuggaaaaugagcgcacacuagauuaucaugacucuaacguuaagaaccuguacgagaaagugcgaaaucaacucaagaacaaugccaaagaaaucggcaacggauguuuugaguucuaucacaagugcgauaauacuuguauggaaagcgucaagaacggcaccuacgacuauccuaaauacucagaggaagcaaagcugaauagagagaaaauugauggggugaaacuugagaguacaaggaucuaucagauucuggccauauacuccaccgucgcuagcucuuuggugcucguugugucacugggagcgaucaguuuuuggaugugcagcaacgguuccuuacagugccggauuuguaucuga

SEQ ID NO: 133971 - RNA, 1701 nt, Artificial Sequence; identical to SEQ ID NO: 133019
  derived and/or modified sequence opt3 from hemagglutinin__InfluenzaA__AHV83832

SEQ ID NO: 133972 - RNA, 1701 nt, Artificial Sequence; identical to SEQ ID NO: 132056
  derived and/or modified sequence opt3 from hemagglutinin__InfluenzaA__AHV83833

SEQ ID NO: 133973 - RNA, 1701 nt, Artificial Sequence; identical to SEQ ID NO: 133037
  derived and/or modified sequence opt3 from hemagglutinin__InfluenzaA__AHV83834

SEQ ID NO: 133974 - RNA, 1701 nt, Artificial Sequence
  derived and/or modified sequence opt3 from hemagglutinin__InfluenzaA__AHV83836
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaaggaaaauagcuacccaaaauuacgccaaucuuauauaaacgauaagggaaaggagguacugguucuuuggggcauccaccaccccuccacgacuaccgaccagcagucauuguaccagaaugcugaugccuacguguucgucggcacaagccgauauaguaaaaaguuuaaaccugagauugcgauccguccaaaggugagagaccaagaagggaggaugaacuacuauuggacucugguggagcccggagauaaaauuaccuucgaagcaacagguaaccuagucguuccucgguacgccuuuaccauggagcgcaaugcuggcucugggaucauaauuuccgacacgccagugcaugauugcaacacuacaugucagaccccggaaggagccaucaauacuagccuccccuuccagaacauucacccuaucacaaucggcaagugcccaaaauauguaaagucgaccaagcugagacuugcaacgggucugaggaaugugcccucuauucagucccggggguuguuuggagcuauagccggcuucaucgagggcggguggaccggaauggucgacgguugguacggcuaucaucaccaaaacgagcaggggucaggauacgcggccgaccucaaaaguacacagaaugcaauugauaagaucacuaacaaagugaauagcguuauagaaaagaugaacacccaguuuacagcugugggcaaagaguucaaucaccuggaaaagcgcauugagaacuuaaauaagaaagucgacgaugguuuccuggacaucuggacuuacaacgccgaacuccuugugcuguuggagaaugagcgaacccuagauuaucaugacuccaacguaaagaaccuguacgaaaaaguuagaaaucaacucaagaacaaugcuaaagagaucgggaacggcuguuuugaguucuaucacaagugcgauaauacauguauggagucugugaagaacggaaccuacgacuauccuaaauacagcgaagaggccaagcugaauagggagaaaauugauggcgucaaguuagaaucaacucggaucuaucagauucuggcaauauacaguacgguggccuccagcuugguccucgugguuucucugggggcuaucucauuuuggaugugcaguaacggaagccuucagugccguauuuguaucuga

SEQ ID NO: 133975 - RNA, 1701 nt, Artificial Sequence; identical to SEQ ID NO: 133923
  derived and/or modified sequence opt3 from hemagglutinin__InfluenzaA__AHV83837

SEQ ID NO: 133976 - RNA, 1701 nt, Artificial Sequence; identical to SEQ ID NO: 132056
  derived and/or modified sequence opt3 from hemagglutinin__InfluenzaA__AHV83838

SEQ ID NO: 133977 - RNA, 1701 nt, Artificial Sequence; identical to SEQ ID NO: 133019
  derived and/or modified sequence opt3 from hemagglutinin__InfluenzaA__AHV83839

SEQ ID NO: 133978 - RNA, 1701 nt, Artificial Sequence; identical to SEQ ID NO: 133037
  derived and/or modified sequence opt3 from hemagglutinin__InfluenzaA__AHV83840

SEQ ID NO: 133979 - RNA, 1701 nt, Artificial Sequence
  derived and/or modified sequence opt3 from hemagglutinin__InfluenzaA__AHV83841
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuacgccaaucuuauauaaacgauaagggcaaggaaguacugguucuuuggggcauccaccaccccuccacgacuaccgaccagcagucauuguaccagaaugcugaugccuacguguucgucgggacaagccgauauaguaaaaaguuuaaaccugagauugcgauccguccaaaggugagagaccaagagggaaggaugaacuacuauuggacucugguggaacccggugauaaaauuaccuucgaggcaacaggcaaccuagucguuccucgguacgccuuuaccauggaacgcaaugcugggucuggaaucauaauuuccgacacgccagugcauaacugcaauacuacaugucagaccccggagggcgccaucaacacuagccuccccuuccagaauauucacccuaucacaaucgguaagugcccaaaauauguaaagucgaccaagcugagacuugcaacggggcugaggaacgugcccucuauucagucccggggauuguuuggcgcuauagccggcuucaucgaagggggauggaccgguauggucgauggcugguacggguaucaucaccaaaaugagcagggaucaggcuacgcggccgaccucaaaaguacacagaacgcaauugacaagaucacuaauaaagugaacagcguuauagagaagaugaauacccaguuuacagcuguggguaaagaguucaaccaccuggagaagcgcauugaaaauuuaaacaagaaagucgaugacggguuccuggauaucuggacuuacaaugccgagcuccuugugcuguuggaaaacgagcgaacccuagacuaucaugauuccaacguaaagaaucuguacgagaaaguuagaaaccaacucaagaauaacgcuaaagaaaucggcaauggauguuuugaguucuaucacaagugcgacaacacauguauggaaucugugaagaauggcaccuacgauuauccuaaauacagcgaggaagccaagcugaacagggagaaaauugacggggucaaacuugagucaacucggaucuaucagauucuggcaauauacaguacgguggccuccagcuugguccucgugguuucucugggagcuaucucauuuuggaugugcaguaaugguagcuuacagugccguauuuguaucuga

SEQ ID NO: 133980 - RNA, 1701 nt, Artificial Sequence; identical to SEQ ID NO: 132056
  derived and/or modified sequence opt3 from hemagglutinin__InfluenzaA__AHV83842

SEQ ID NO: 133981 - RNA, 1701 nt, Artificial Sequence; identical to SEQ ID NO: 132056
  derived and/or modified sequence opt3 from hemagglutinin__InfluenzaA__AHV83843

SEQ ID NO: 133982 - RNA, 1701 nt, Artificial Sequence; identical to SEQ ID NO: 132056
  derived and/or modified sequence opt3 from hemagglutinin__InfluenzaA__AHV83844

SEQ ID NO: 133983 - RNA, 1701 nt, Artificial Sequence
  derived and/or modified sequence opt3 from hemagglutinin__InfluenzaA__AHV83845
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaucccccuacgacugcugaccagcagucauuguaccagaaugccgaugcguacguguucgucgggaccagccgcuauaguaaaaaguuuaaaccagagauugcaauccgacccaaggugcgugaccaagagggaagaaugaacuacuauuggacacugguggaaccuggugauaaaauuacuuucgaggccaccggcaaccuagucguuccaagguacgcuuuuacaauggaacggaaugccgggucuggaaucauaauuuccgacaccccggugcacgauugcaacacgacuugucagacacccgagggcgcaaucaauaccagccucccuuuccagaacauucacccaaucacuaucgguaagugccccaaauauguaaagucgacaaagcugcgccuugcuaccgggcugagaaaugugccuucuauucaguccaggggauuguuuggcgccauagcgggcuucaucgaagggggauggacggguauggucgacggcugguacggguaucaucaccaaaacgagcagggaucaggcuacgccgcagaccucaaaaguacccagaaugcuauugauaagaucacaaacaaagugaauagcguuauagagaagaugaacacucaguuuaccgccguggguaaagaguucaaucaccuggagaagcggauugaaaacuuaaauaagaaagucgacgauggguuccuggacaucuggacauacaacgcugagcuccuugugcuguuggaaaaugagcgcacucuagauuaucaugacuccaacguaaagaaccuguacgagaaaguucgaaaucaacucaagaacaaugccaaagaaaucggcaacggauguuuugaguucuaucacaagugcgauaauaccuguauggaaucugugaagaacggcacauacgacuauccaaaauacagcgaggaagcaaagcugaauagagagaaaauugauggggucaaacuugagucaaccaggaucuaucagauucuggccauauacaguacugcugcguccagcuuggugcucgucgugucucugggagcaaucucauuuuggaugugcaguaacgguagcuuacagugccggauuuguaucuga

SEQ ID NO: 133984 - RNA, 1701 nt, Artificial Sequence; identical to SEQ ID NO: 132056
  derived and/or modified sequence opt3 from hemagglutinin__InfluenzaA__AHV83846

SEQ ID NO: 133985 - RNA, 1701 nt, Artificial Sequence; identical to SEQ ID NO: 132056
  derived and/or modified sequence opt3 from hemagglutinin__InfluenzaA__AHV83847

SEQ ID NO: 133986 - RNA, 1701 nt, Artificial Sequence; identical to SEQ ID NO: 132056
  derived and/or modified sequence opt3 from hemagglutinin__InfluenzaA__AHV83848

SEQ ID NO: 133987 - RNA, 1701 nt, Artificial Sequence; identical to SEQ ID NO: 133909
  derived and/or modified sequence opt3 from hemagglutinin__InfluenzaA__AHV83849

SEQ ID NO: 133988 - RNA, 1701 nt, Artificial Sequence
  derived and/or modified sequence opt3 from hemagglutinin__InfluenzaA__AHV83850
augaaggccauccuggugguccuccuuuacaccuucgcuacaacuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaaggccaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaaaggugucaccgcagccuguccucaugcuggggcaaagaguuuuuauaaaaaccugaucuggcucgugaagaaaggaaauagcuacccaaaguuaucucaauccuauauaaacgauaagggcaaagaaguacugguucuuuggggcauccaccaccccucaacgacugccgaccagcagagcuuguaccagaaugcugaugccuacguguucgucgggaccagucgcuauucuaagaaauuuaagccugagauugcgauccgaccaaaagugcgugaccaagagggaagaaugaacuacuauuggacacugguggaacccggugauaagauuacuuucgaggcaaccggcaaccuagucguuccuagguacgccuuuacaauggaacggaaugcuggguccggaaucauaauuagcgacaccccagugcaugauugcaacacgacuugucagacaccggagggcgccaucaauaccucgcuccccuuccagaacauucacccuaucacuaucgguaaaugcccaaaguauguaaagucuacaaaacugcgccuugcaaccgggcugagaaaugugcccuccauucagucaaggggauuguuuggcgcuauagccggcuucaucgaagggggauggacggguauggucgacggcugguacggguaucaucaccaaaacgagcagggaaguggcuacgcggccgaccucaagagcacccagaaugcaauugauaaaaucacaaacaagguaaauuccguuauagagaaaaugaacacucaguuuaccgcuguggguaaggaguucaaucaccuggagaagcggauugaaaacuuaaauaaaaaggucgacgauggguuccuggacaucuggacauacaacgccgagcuccuugugcuguuggaaaaugagcgcacucuagauuaucaugacucuaacgugaaaaaccuguacgagaagguucgaaaucaacucaaaaacaaugcuaaggaaaucggcaacggauguuuugaguucuaucacaagugcgauaauaccuguauggaaagcgugaaaaacggcacauacgacuauccuaaguacucagaggaagccaaacugaauagagagaagauugauggggucaaacuugagaguaccaggaucuaucagauucuggcaauauacuccacuguggccagcucuuugguccucgugguuucacugggagcuaucaguuuuuggaugugcagcaacgguuccuuacagugccggauuuguaucuga

SEQ ID NO: 133989 - RNA, 1701 nt, Artificial Sequence; identical to SEQ ID NO: 132056
  derived and/or modified sequence opt3 from hemagglutinin__InfluenzaA__AHV83851

SEQ ID NO: 133990 - RNA, 1701 nt, Artificial Sequence; identical to SEQ ID NO: 132056
  derived and/or modified sequence opt3 from hemagglutinin__InfluenzaA__AHV83852

SEQ ID NO: 133991 - RNA, 1701 nt, Artificial Sequence
  derived and/or modified sequence opt3 from hemagglutinin__InfluenzaA__AHV83853
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaacauugucuaccgcaucaaguuggagcuacauuguugagacuuccucuucggacaacggaacaugcuauccaggcgauuuuaucgacuacgaagaacucagggagcagcugucaagcgugaguuccuucgaacgguuugagauuuucccgaagaccucuagcuggcccaaucacgauuccaacaagggugucacggccgcuuguccucaugcaggggccaaaggauuuuauaagaaucugaucuggcucgugaaaaagggcaacucauacccaaaauuaaguaagagcuauauaaaugacaagggcaaagaaguacugguucuuugggggauccaccaccccucuacuaccgcugaucaacaguccuuguaccagaacgccgacacauacguguucgucggaacuucacgcuauagcaagaaauuuaagccugagauugcgauccgaccaaaagugcgugaucaggaggguagaaugaauuacuauuggacccugguggaacccggcgacaagauuacauucgaggcaaccgggaaccuagucguuccuagguacgccuuugcuauggaacgggaugccggaaguggcaucauaauuucugacacgccagugcaugacugcaacacuacaugucaaaccccgaaaggugcaaucaauacuucccuccccuuccagaacauucacccuaucacaaucgggaagugcccaaaguauguaaaaagcaccaagcugcgccuugcuacgggacugagaaaugugcccucgauucagucuaggggcuuguuuggcgccauagcgggguucaucgagggagguuggaccggcauggucgaugggugguacggauaucaucaccagaacgaacaaggcuccgguuacgccgcagaccucaaaucaacacagaaugcuauugauaagaucacuaacaaagugaauaguguuauagagaagaugaacacccaguuuacagccguggggaaggaguucaaucaccuggaaaaacggauugagaacuuaaauaagaaagucgacgauggcuuccuggacaucuggacuuacaacgcugaacuccuugugcuguuggagaaugaacgcacccuagauuaucaugacagcaacguaaagaaucuguacgagaaaguucgaacacagcucaagaacaacgccaaggagaucggaaauggcuguuuugaguucuaucacaaaugcgauaacaccuguauggaguccgugaagaaugggacuuacgacuauccuaaauacucugaagaggcaaagcugaacagagaagagauugauggagucaaacuugagagcacgaggaucuaucaaauucuggccauauacucaacagcugcgaguuccuuggugcucgucgugagccugggugcaaucucuuuuuggaugugcucaaauggcaguuuacagugccggauuuguaucuga

SEQ ID NO: 133992 - RNA, 1701 nt, Artificial Sequence; identical to SEQ ID NO: 133918
  derived and/or modified sequence opt3 from hemagglutinin__InfluenzaA__AHV83855

SEQ ID NO: 133993 - RNA, 1701 nt, Artificial Sequence
  derived and/or modified sequence opt3 from hemagglutinin__InfluenzaA__AHV83856
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccucaaaagcacccagaaugcuauugauaagaucacaaacaaaguuaauuccgugauagagaagaugaacacucaguuuaccgccguggguaaagaguucaaucaccuggagaagcggauugaaaacuuaaauaagaaagucgacgauggguuccuggacaucuggacauacaacgcugagcuccuugugcuguuggaaaaugagcgcacucuagauuaucaugacucuaacguaaagaaccuguacgagaaaguucgaaaucaacucaagaacaaugccaaagaaaucggcaacggauguuuugaguucuaucacaagugcgauaauaccuguauggaaauugugaagaacggcacauacgacuauccuaaauacagcgaggaagcaaagcugaauagagagaaaaucgauggggucaaacuugagucaaccaggauuuaucagauacuggccaucuacaguacuguggcuuccagcuugguccucgugguuucucugggagcgauuucauuuuggaugugcaguaacgguagcuuacagugccggaucuguaucuga

SEQ ID NO: 133994 - RNA, 1701 nt, Artificial Sequence; identical to SEQ ID NO: 133918
  derived and/or modified sequence opt3 from hemagglutinin__InfluenzaA__AHV83857

SEQ ID NO: 133995 - RNA, 1701 nt, Artificial Sequence
  derived and/or modified sequence opt3 from hemagglutinin__InfluenzaA__AHV83858
augaaggccauccuggugguccuccuuuacaccuucgcuacagcaaacacugacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaagaacucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuaucucaauccuauauaaacgauaagggcaaggaaguacugguucuuuggggcauccaccaccccucaacuaccgccgaccagcagagcuuguaccagaaugcugaugccuacguguucgucgggacaagucgcuauucuaaaaaguuuaaaccugagauugcgauccgaccaaaggugcgugaccaagagggaagaaugaacuacuauuggacucugguggaacccggugauaaaauuaccuucgaggcaacaggcaaccuagucguuccuagguacgccuuuaccauggaacggaaugcuggguccggaaucauaauuagcgacacgccagugcaugauugcaacacuacaugucagaccccggagggcgccaucaauacuucgcuccccuuccagaacauucacccuaucacaaucgguaagugcccaaaauauguaaagucuaccaagcugcgccuugcaacggggcugagaaaugugcccuccauucagucaaggggauuguuuggcgcuauagccggcuucaucgaagggggauggaccgguauggucgacggcugguacggguaucaucaccaaaacgagcagggaaguggcuacgcggccgaccagaaaagcacacagaaugcaauugauaagaucacuaacaaaguuaauuccgugauagagaagaugaacacccaauuuacagcuguggguaaagaguucaaucaccucgagaagcggauugaaaaccugaauaagaaagucgacgauggguucuuagacaucuggacuuacaacgccgagcugcucgugcuucuggaaaaugagcgcaccuuggauuaucaugacucuaacguaaagaaccuauacgagaaaguucgaaaucagcugaagaacaaugcuaaagaaaucggcaacggauguuuugaguucuaucacaagugcgauaauacauguauggaaagcgugaagaacggcaccuacgacuauccuaaauacucagaggaagccaagcucaauagagagaaaauugauggggucaagcuggagaguacuaggaucuaucagauucuugcaauauacuccacgguggccagcucucuggucuuggugguuucacucggagcuaucaguuuuuggaugugcagcaacgguucccugcaaugccggauuuguaucuga

SEQ ID NO: 133996 - RNA, 1701 nt, Artificial Sequence; identical to SEQ ID NO: 132056
  derived and/or modified sequence opt3 from hemagglutinin__InfluenzaA__AHV83859

SEQ ID NO: 133997 - RNA, 1701 nt, Artificial Sequence
  derived and/or modified sequence opt3 from hemagglutinin__InfluenzaA__AHV83861
augaaggccauccuggugguccuccuuuacaccuucacaacugcuaacgcagacacgcugugcauuggcuaucacgccaauaacagcaccgauacaguugacacuguguuggagaagaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaagaacucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuaucucaauccuauauaaacgauaagggcaaggaaguacugguucuuuggggcauccaccaccccucaacuaccgccgaccagcagagcuuguaccagaaugcugaugccuacguguucgucgggacaagucgcuauucuaaaaaguuuaaaccugagauugcgauccgaccaaaggugcgugaccaagagggaagaaugaacuacuauuggacucugguggaacccggugauaaaauuaccuucgaggcaacaggcaaccuagucguuccuagguacgccuuuaccauggaacggaaugcuggguccggaaucauaauuagcgacacgccagugcaugauugcaacacuacaugucagaccccggagggcgccaucaauacuucgcuccccuuccagaacauucacccuaucacaaucgguaagugcccaaaauauguaaagucuaccaagcugcgccuugcaacggggcugagaaaugugcccuccauucagucaaggggauuguuuggcgcuauagccggcuucaucgaagggggauggaccgguauggucgacggcugguacggguaucaucaccaaaacgagcagggaaguggcuacgcggccgaccucaaaagcacacagaaugcaauugauaagaucacuaacaaaguuaauuccgugauagagaagaugaacacccaguuuacagcuguggguaaagaguucaaucaccuggagaagcggauugaaaacuuaaauaagaaagucgacgauggguuccuggacaucuggacuuacaacgccgagcuccuugugcuguuggaaaaugagcgcacccuagauuaucaugacucuaacguaaagaaccuguacgagaaaguucgaaaucaacucaagaacaaugcuaaagaaaucggcaacggauguuuugaguucuaucacaagugcgauaauacauguauggaaagcgugaagaacggcaccuacgacuauccuaaauacucagaggaagccaagcugaauagagagaaaauugauggggucaaacuugagaguacuaggaucuaucagauucuggcaauauacuccacgguggccagcucuuugguccucgugguuucacugggagcuaucaguuuuuggaugugcagcaacgguuccuuacagugccggauuuguaucuga

SEQ ID NO: 133998 - RNA, 1701 nt, Artificial Sequence; identical to SEQ ID NO: 133997
  derived and/or modified sequence opt3 from hemagglutinin__InfluenzaA__AHV83862

SEQ ID NO: 133999 - RNA, 1701 nt, Artificial Sequence; identical to SEQ ID NO: 132056
  derived and/or modified sequence opt3 from hemagglutinin__InfluenzaA__AHV83863

SEQ ID NO: 134000 - RNA, 1701 nt, Artificial Sequence; identical to SEQ ID NO: 132056
  derived and/or modified sequence opt3 from hemagglutinin__InfluenzaA__AHV83864

SEQ ID NO: 134001 - RNA, 1701 nt, Artificial Sequence
  derived and/or modified sequence opt3 from hemagglutinin__InfluenzaA__AHV83866
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccaauccaugauugcaacacgacuugucagacaccggagggcgcaauuaauaccucgcuccccuuccagaacauccacccuaucacuauugguaagugcccaaaauaugugaagucuacaaagcugcgccuugcuaccgggcugagaaauguacccuccauacagucaaggggauuguuuggcgccaucgcgggcuucauugaagggggauggacggguaugguggacggcugguacggguaucaucaccaaaacgagcagggaaguggcuacgccgcagaccucaaaagcacccagaaugcuaucgauaagauaacaaacaaagucaauuccgugauugagaagaugaacacucaguuuaccgccguugguaaagaguucaaucaccuggagaagcggaucgaaaacuuaaauaagaaaguggacgauggguuccuggacaucuggacauacaacgcugagcuccuuguccuguuggaaaaugagcgcacucuagauuaucaugacucuaacgugaagaaccuguacgagaaaguacgaaaucaacucaagaacaaugccaaagaaauuggcaacggauguuuugaguucuaucacaagugcgaugacaccuguauggaaagcguuaagaauggcacauacgauuauccuaaauacucagaggaagcaaagcugaacagagagaaaaucgacggggugaaacuugagaguaccaggauuuaucagauacuggccaucuacuccacugucgcuagcucuuuggugcucgucgugucacugggagcgauuaguuuuuggaugugcagcaaugguuccuuacagugccggaucuguaucuga

SEQ ID NO: 134002 - RNA, 1701 nt, Artificial Sequence
  derived and/or modified sequence opt3 from hemagglutinin__InfluenzaA__AHV83867
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccucaaaagcacccagaaugcuauugauaagaucacaaacaaaguuaauuccgugauagagaagaugaacacucaguuuaccgccguggguaaagaguucaaucaccuggagaagcggauugaaaacuuaaauaagaaagucgacgauggguuccuggacaucuggacauacaacgcugagcuccuugugcuguuggaaaaugagcgcacucuagauuaucaugacucuaacguaaagaaccuguacgagaaaguucgaaaucaacucaagaacaaugccaaagaaaucggcaacggauguuuugaguucuaucacaagugcgaugacaccuguauggaaagcgugaagaauggcacauacgauuauccuaaauacucagaggaagcaaagcugaacagagagaaaauugacggggucaaacuugagaguaccaggaucuaucagauucuggccauauacuccacuguggcuagcucuuugguccucgugguuucacugggagcgaucaguuuuuggaugugcagcaaugguuccuuacagugccggauuuguaucuga

SEQ ID NO: 134003 - RNA, 1701 nt, Artificial Sequence; identical to SEQ ID NO: 132056
  derived and/or modified sequence opt3 from hemagglutinin__InfluenzaA__AHV83868

SEQ ID NO: 134004 - RNA, 1701 nt, Artificial Sequence
  derived and/or modified sequence opt3 from hemagglutinin__InfluenzaA__AHV83869
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaaacagcuggcccaaucacgacuccaacaagggugucaccgccgcuuguccucaugcaggggccaaaucauuuuauaagaaucugaucuggcucgugaaaaagggaaacaguuacccaaaauuaagccaaucuuauauaaaugauaagggcaaggaaguacugguucuuuggggcauccaccaccccuccacgacugcugaccagcagucauuguaccagaacgccgaugcguacguguucgucgggaccagccgcuauaguaaaaaguuuaaaccugagauugcaauccgaccaaaggugcgugaccaagagggaagaaugaacuacuauuggacacugguggaacccggugauaaaauuacuuucgaggccaccggcaaucuagucguuccuagguacgcuuuuacaauggaacggaacgccgggucuggaaucauaauuuccgacaccccagugcaugauugcaauacgacuugucagacaccggagggcgcaaucaacaccagccuccccuuccagaauauucacccuaucacuaucgguaagugcccaaaauauguaaagucgacaaagcugcgccuugcuaccgggcugagaaacgugcccucuauucaguccaggggauuguuuggcgccauagcgggcuucaucgaagggggauggacggguauggucgacggcugguacggguaucaucaccaaaaugagcagggaucaggcuacgccgcagaccucaaaaguacccagaacgcuauugauaagaucacaaauaaagugaacagcguuauagagaagaugaauacucaguuuaccgccguggguaaagaguucaaccaccuggagaagcggauugaaaauuuaaacaagaaagucgacgauggguuccuggacaucuggacauacaaugcugagcuccuugugcuguuggaaaacgagcgcacucuagauuaucaugacuccaacguaaagaaucuguacgagaaaguucgaaaccaacucaagaauaacgccaaagaaaucggcaauggauguuuugaguucuaucacaagugcgauaacaccuguauggaaucugugaagaauggcacauacgacuauccuaaauacagcgaggaagcaaagcugaacagagagaaaauugauggggucaaacuugagucaaccaggaucuaucagauucuggccauauacaguacuguggcuuccagcuugguccucgugguuucucugggagcgaucucauuuuggaugugcaguaaugguagcuuacagugccggauuuguaucuga

SEQ ID NO: 134005 - RNA, 1701 nt, Artificial Sequence; identical to SEQ ID NO: 132056
  derived and/or modified sequence opt3 from hemagglutinin__InfluenzaA__AHV83870

SEQ ID NO: 134006 - RNA, 1701 nt, Artificial Sequence; identical to SEQ ID NO: 132056
  derived and/or modified sequence opt3 from hemagglutinin__InfluenzaA__AHV83871

SEQ ID NO: 134007 - RNA, 1701 nt, Artificial Sequence; identical to SEQ ID NO: 132056
  derived and/or modified sequence opt3 from hemagglutinin__InfluenzaA__AHV83872

SEQ ID NO: 134008 - RNA, 1701 nt, Artificial Sequence
  derived and/or modified sequence opt3 from hemagglutinin__InfluenzaA__AHV83873
augaaggccauccuggugguccuccuuuacaccuucgcuacaacuaacgcagacacgcugugcauuggcuaucacgccaauaacagcaccgauacaguugacacuguguuggagaagaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaagaacucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuaucucaauccuauauaaacgauaagggcaaggaaguacugguucuuuggggcauccaccaccccucaacuguggccgaccagcagagcuuguaccagaaugcugaugccuacgucuucguggggaccagucgcuauucuaaaaaguuuaaaccugagauugcgauccgaccaaaggugcgugaccaagagggaagaaugaacuacuauuggacacuggucgaacccggugauaaaauuacuuucgaggcaaccggcaaccuaguugugccuagguacgccuuuacaauggaacggaaugcuggguccggaaucauaauuagcgacaccccaguacaugauugcaacacgacuugucagacaccggagggcgccaucaauaccucgcuccccuuccagaacauucacccuaucacuaucgguaagugcccaaaauaugugaagucuacaaagcugcgccuugcaaccgggcugagaaauguccccuccauucagucaaggggauuguuuggcgcuauagccggcuucaucgaagggggauggacggguaugguggacggcugguacggguaucaucaccaaaacgagcagggaaguggcuacgcggccgaccucaaaagcacccagaaugcaauugauaagaucacaaacaaaguuaauuccgugauagagaagaugaacacucaguuuaccgcugucgguaaagaguucaaucaccuggagaagcggauugaaaacuuaaauaagaaaguggacgauggguuccuggacaucuggacauacaacgccgagcuccuuguacuguuggaaaaugagcgcacucuagauuaucaugacucuaacguuaagaaccuguacgagaaagugcgaaaucaacucaagaacaaugcuaaagaaaucggcaacggauguuuugaguucuaucacaagugcgauaauaccuguauggaaagcgucaagaacggcacauacgacuauccuaaauacucagaggaagccaagcugaauagagagaaaauugauggggugaaacuugagaguaccaggaucuaucagauucuggcaauauacuccacugucgccagcucuuuggugcucguugugucacugggagcuaucaguuuuuggaugugcagcaacgguuccuuacagugccggauuuguaucuga

SEQ ID NO: 134009 - RNA, 1701 nt, Artificial Sequence; identical to SEQ ID NO: 132056
  derived and/or modified sequence opt3 from hemagglutinin__InfluenzaA__AHV83874

SEQ ID NO: 134010 - RNA, 1701 nt, Artificial Sequence; identical to SEQ ID NO: 132056
  derived and/or modified sequence opt3 from hemagglutinin__InfluenzaA__AHV83875

SEQ ID NO: 134011 - RNA, 1701 nt, Artificial Sequence; identical to SEQ ID NO: 132056
  derived and/or modified sequence opt3 from hemagglutinin__InfluenzaA__AHV83876

SEQ ID NO: 134012 - RNA, 1701 nt, Artificial Sequence
  derived and/or modified sequence opt3 from hemagglutinin__InfluenzaA__AHV83877
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucaagcgguuugaaauuuucccgaagacaagcuccuggcccaaccacgacucaaauaaaggugucaccgccgcuuguccucaugcaggggccaagaguuuuuauaaaaaccugaucuggcucgugaagaaaggaaauagcuacccaaaguuaucucaauccuauauaaacgauaagggcaaagagguacugguucuuuggggcauccaccaccccucaacgacugcugaccagcagagcuuguaccagaaugccgaugcguacguguucgucgggaccagucgcuauucuaagaaauuuaagccugaaauugcaauccgaccaaaagugcgugaccaagagggaagaaugaacuacuauuggacacugguggagcccggugauaagauuacuuucgaagccaccggcaaccuagucguuccuagguacgcuuuuacaauggagcggaaugccggguccggaaucauaauuagcgacaccccagugcaugauugcaacacgacuugucagacaccggaaggcgcaaucaauaccucgcuccccuuccagaacauucacccuaucacuaucgguaaaugcccaaaguauguaaagucuacaaaacugcgccuugcuaccgggcugagaaaugugcccuccauucagucaaggggauuguuuggcgccauagcgggcuucaucgaagggggauggacggguauggucgacggcugguacggguaucaucaccaaaacgaacagggaaguggcuacgccgcagaccucaagagcacccagaaugcuauugauaaaaucacaaacaagguaaauuccguuauagagaaaaugaacacucaguuuaccgccguggguaaggaguucaaucaccuggaaaagcggauugagaacuuaaauaaaaaggucgacgauggguuccuggacaucuggacauacaacgcugaacuccuugugcuguuggagaaugaacgcacucuagauuaucaugacucuaacgugaaaaaccuguacgagaagguucgaaaucaacucaaaaacaaugccaaggagaucggcaacggauguuuugaguucuaucacaagugcgauaauaccuguauggaaagcgugaaaaacggcacauacgacuauccuaaguacucagaagaggcaaaacugaauagagaaaagauugauggggucaaacuugagaguaccaggaucuaucagauucuggccauauacuccacuguggcuagcucuuugguccucgugguuucacugggagcgaucaguuuuuggaugugcagcaacgguuccuuacagugccggauuuguaucuga

SEQ ID NO: 134013 - RNA, 1701 nt, Artificial Sequence; identical to SEQ ID NO: 133923
  derived and/or modified sequence opt3 from hemagglutinin__InfluenzaA__AHV83878

SEQ ID NO: 134014 - RNA, 1701 nt, Artificial Sequence; identical to SEQ ID NO: 133923
  derived and/or modified sequence opt3 from hemagglutinin__InfluenzaA__AHV83879

SEQ ID NO: 134015 - RNA, 1701 nt, Artificial Sequence
  derived and/or modified sequence opt3 from hemagglutinin__InfluenzaA__AHV83881
augaaggccacccuggugguccuccuuuacacauucgcuacugcaaacgccgacacgcugugcaucggcuaucacgcgaauaacagcaccgauacaguugacacuguguuggagaagaauguaaccgugacacauuccgucaacuuacuggaagauaagcacaaugggaaacuauguaagcucagaggaguggcuccccugcaucuugguaaaugcaacauugccggcuggauacuggggaauccugagugugaaucuuugucaaccgcaaguagcugguccuacaucguugagacuucuucgucagacaacggaacaugcuauccaggcgauuuuauuaauuacgaagaacucagggagcagcugagcaguguguccucuuucgaacgguuugagaucuucccgaagaccagcuccuggcccaaccacgacucaaauaagggugucacggccgcuuguccucaugcaggggccaaaaguuuuuauaagaaccugauuuggcucgugaaaaagggaaauagcuacccaaaauuaucucaauccuauaucaacgauaagggcaaggaaguacugguucuuuggggcauacaccaccccucaacuaccgcugaccagcagagcuuguaccagaaugccgaugcguacguguucgucgggacaagucgcuauucuaaaaaguuuaaaccugagaucgcaauucgaccaaaggugcgugaccaagagggaagaaugaacuacuauuggacucugguggaacccggugauaaaaucaccuucgaggccacaggcaaccuagucguuccuagguacgcuuuuaccauggaacggaaugccggguccggaauuaucauaagcgacacgccagugcaugauugcaacacuacaugucagaccccggagggcgcaauuaauacuucgcuccccuuccagaacauccacccuauuacaaucgguaagugcccaaaauauguaaagucuaccaagcugcgccuugcuacggggcugagaaaugugcccuccauccagucaaggggauuguuuggcgccauugcgggcuucauagaagggggauggaccgguauggucgacggcugguacggguaucaucaccaaaacgagcagggaaguggcuacgccgcagaccucaaaagcacacagaaugcuaucgauaagauuacuaacaaaguuaauuccgugaucgagaagaugaacacccaguuuacagccguggguaaagaguucaaucaccuggagaagcggauagaaaacuuaaauaagaaagucgacgauggguuccuggacauuuggacuuacaacgcugagcuccuugugcuguuggaaaaugagcgcacccuagauuaucaugacucuaacguaaagaaccuguacgagaaaguucgaaaucaacucaagaacaaugccaaagaaaucggcaacggauguuuugaguucuaucacaagugcgauaauacauguauggaaagcgugaagaacggcaccuacgacuauccuaaauacucagaggaagcaaagcugaauagagagaaaaucgauggggucaaacuugagaguacuaggauuuaucagauccuggccauuuacuccacgguggcuagcucuuugguccucgugguuucacugggagcgauaaguuuuuggaugugcagcaacgguuccuuacagugccggaucuguauuuga

SEQ ID NO: 134016 - RNA, 1701 nt, Artificial Sequence; identical to SEQ ID NO: 133037
  derived and/or modified sequence opt3 from hemagglutinin__InfluenzaA__AHV83882

SEQ ID NO: 134017 - RNA, 1701 nt, Artificial Sequence; identical to SEQ ID NO: 133019
  derived and/or modified sequence opt3 from hemagglutinin__InfluenzaA__AHV83883

SEQ ID NO: 134018 - RNA, 1701 nt, Artificial Sequence; identical to SEQ ID NO: 132056
  derived and/or modified sequence opt3 from hemagglutinin__InfluenzaA__AHV83884

SEQ ID NO: 134019 - RNA, 1701 nt, Artificial Sequence
  derived and/or modified sequence opt3 from hemagglutinin__InfluenzaA__AHV83885
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccaguguaugauugcaacacgacuugucagacaccggagggcgcaaucaauaccucgcuccccuuccagaacauucauccuaucacuaucgguaagugcccaaaauacguaaagucuacaaagcugcgccuugcuaccgggcugagaaaugugcccuccauucagucaaggggauuguuuggcgccauagcgggcuucaucgaagggggauggacggguauggucgacggcugguauggguaccaccaucaaaacgagcagggaaguggcuacgccgcagaccucaaaagcacccagaaugcuauugauaagaucacaaacaaaguuaauuccgugauagagaagaugaacacucaguuuaccgccguggguaaagaguucaaucaccuggagaagcggauugaaaacuuaaauaagaaagucgacgauggguuccuggacaucuggacauauaacgcugagcuccuugugcuguuggaaaaugagcgcacucuagauuaccacgacucuaacguaaagaaccuguaugagaaaguucgaaaucaacucaagaacaaugccaaagaaaucggcaacggauguuuugaguucuaccauaagugcgauaauaccuguauggaaagcgugaagaacggcacauaugacuacccuaaauauucagaggaagcaaagcugaauagagagaaaauugauggggucaaacuugagaguaccaggaucuaccagauucuggccauauacuccacuguggcuagcucuuugguccucgugguuucacugggagcgaucaguuuuuggaugugcagcaacgguuccuuacagugccggauuuguaucuga

SEQ ID NO: 134020 - RNA, 1701 nt, Artificial Sequence; identical to SEQ ID NO: 133936
  derived and/or modified sequence opt3 from hemagglutinin__InfluenzaA__AHV83887

SEQ ID NO: 134021 - RNA, 1701 nt, Artificial Sequence; identical to SEQ ID NO: 132056
  derived and/or modified sequence opt3 from hemagglutinin__InfluenzaA__AHV83888

SEQ ID NO: 134022 - RNA, 1701 nt, Artificial Sequence
  derived and/or modified sequence opt3 from hemagglutinin__InfluenzaA__AHV83889
augaaggccauccuggugguccuccuucacacccuggcuacagcaaacgccgacacuuugugcauuggcuaccaugcgaauaacagcacggauaccguugacacaguguuagagaaaaauguaacugugacccacuccgucaaccugcuagaagauaagcauaaugggaaacucuguaagcugagaggaguggcuccccuucaccuggguaaaugcaacauagccggcuggaucuuggggaauccugagugugaaucucucucaacagcaaguagcugguccuauauuguugagaccucuucgucagacaacggaacuugcuacccaggcgauuucaucaauuaugaggaacugagggagcagcugagcaguguguccucuuuugaacgguucgagauuuuuccgaagacaagcuccuggcccaaccaugacucaaauaagggugucaccgccgcuuguccucacgcaggggccaaaaguuucuacaagaaccucaucugguuagugaaaaagggaaauagcuauccaaaacugucucaauccuacauaaacgauaagggcaaggaaguacuuguuuuguggggcauccaccaucccucaacgacugcugaccagcagagccuguaucagaaugccgaugcguacguguuugucgggaccagucgcuacucuaaaaaguucaaaccugagauugcaauccgaccaaaggugcgugaccaagagggaagaaugaacuauuacuggacacuuguggaacccggugauaaaauuacuuuugaggccaccggcaaccucgucguuccuagguaugcuuucacaauggaacggaaugccggguccggaaucauaauuagcgacaccccagugcacgauugcaacacgacuugucagacaccggagggcgcaaucaauaccucgcugcccuuucagaacauucauccuaucacuaucgguaagugcccaaaauacguaaagucuacaaagcuacgccuggcuaccggguugagaaaugugcccuccauucagucaaggggacucuucggcgccauagcgggcuuuaucgaagggggauggacggguauggucgacggcugguauggguaccaccaccaaaacgagcagggaaguggcuaugccgcagaccugaaaagcacccagaaugcuauugauaagaucacaaacaaaguuaauuccgugauagagaagaugaacacucaguucaccgccguggguaaagaauuuaaucauuuagagaagcggauugaaaaccugaauaagaaagucgacgauggguuccucgacaucuggacauacaacgcugagcuucugguguugcuagaaaaugagcgcacucuggauuaccacgacucuaacguaaagaaccucuaugagaaaguucgaaaucaacugaagaacaaugccaaagaaaucggcaacggauguuucgaguuuuaccauaagugcgauaauaccuguauggaaagcgugaagaacggcacauaugacuacccuaaauauucagaggaagcaaaacuuaauagagagaagauugauggggucaagcuggagaguaccaggaucuaccagauuuuggccauauauuccacuguggcuagcucucucguccuggugguuucauuaggagcgaucaguuucuggaugugcagcaacgguucccugcagugccggauuuguaucuga

SEQ ID NO: 134023 - RNA, 1701 nt, Artificial Sequence; identical to SEQ ID NO: 132056
  derived and/or modified sequence opt3 from hemagglutinin__InfluenzaA__AHV83890

SEQ ID NO: 134024 - RNA, 1701 nt, Artificial Sequence; identical to SEQ ID NO: 132056
  derived and/or modified sequence opt3 from hemagglutinin__InfluenzaA__AHV83891

SEQ ID NO: 134025 - RNA, 1701 nt, Artificial Sequence; identical to SEQ ID NO: 132056
  derived and/or modified sequence opt3 from hemagglutinin__InfluenzaA__AHV83893

SEQ ID NO: 134026 - RNA, 1701 nt, Artificial Sequence; identical to SEQ ID NO: 132056
  derived and/or modified sequence opt3 from hemagglutinin__InfluenzaA__AHV83894

SEQ ID NO: 134027 - RNA, 1701 nt, Artificial Sequence
  derived and/or modified sequence opt3 from hemagglutinin__InfluenzaA__AHV83895
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccucaaaagcacccagaaugcuauugauaagaucacaaacaaaguuaauuccgugauagagaagaugaacacucaguuuaccgccguggguaaagaguucaaucaccuggagaagcggauugaaaacuuaaauaagaaagucgacgauggguuccuggacaucuggacauacaacgcugagcuccuugugcuguuggaaaaugagcgcacucuagauuaucaugacucuaacguaaagaaccuguacgagaaaguucgaaaucaacucaagaacaaugccaaagaaaucggcaacggauguuuugaguucuaucacaagugcgauaauaccuguauggaaagcgugaagaacggcacauacgacuauccuaaauacucagaggaaaccaagcugaauagagagaaaauugauggggucaaacuugagaguacuaggaucuaucagauucuggcaauauacuccacgguggccagcucuuugguccucgugguuucacugggagcuaucaguuuuuggaugugcagcaacgguuccuuacagugccggauuuguaucuga

SEQ ID NO: 134028 - RNA, 1701 nt, Artificial Sequence; identical to SEQ ID NO: 132056
  derived and/or modified sequence opt3 from hemagglutinin__InfluenzaA__AHV83896

SEQ ID NO: 134029 - RNA, 1701 nt, Artificial Sequence; identical to SEQ ID NO: 132056
  derived and/or modified sequence opt3 from hemagglutinin__InfluenzaA__AHV83897

SEQ ID NO: 134030 - RNA, 1701 nt, Artificial Sequence
  derived and/or modified sequence opt3 from hemagglutinin__InfluenzaA__AHV83898
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugugaccgggcugagaaauguccccuccauucagucaaggggauuguuuggcgcuauagccggcuucaucgaagggggauggacggguaugguggacggcugguacggguaucaucaccaaaacgagcagggaaguggcuacgcggccgaccucaaaagcacccagaaugcaauugauaagaucacaaacaaaguuaauuccgugauagagaagaugaacacucaguuuaccgcugucgguaaagaguucaaucaccuggagaagcggauugaaaacuuaaauaagaaaguggacgauggguuccuggacaucuggacauacaacgccgagcuccuuguacuguuggaaaaugagcgcacucuagauuaucaugacucuaacguuaagaaccuguacgagaaagugcgaaaucaacucaagaacaaugcuaaagaaaucggcaacggauguuuugaguucuaucacaagugcgauaauaccuguauggaaagcgucaagaacggcacauacgacuauccuaaauacucagaggaagccaagcugaauagagagaaaauugauggggugaaacuugagaguaccaggaucuaucagauucuggcaauauacuccacugucgccagcucuuuggugcucguugugucacugggagcuaucaguuuuuggaugugcagcaacgguuccuuacagugccggauuuguaucuga

SEQ ID NO: 134031 - RNA, 1701 nt, Artificial Sequence; identical to SEQ ID NO: 132056
  derived and/or modified sequence opt3 from hemagglutinin__InfluenzaA__AHV83899

SEQ ID NO: 134032 - RNA, 1701 nt, Artificial Sequence; identical to SEQ ID NO: 132056
  derived and/or modified sequence opt3 from hemagglutinin__InfluenzaA__AHV83900

SEQ ID NO: 134033 - RNA, 1701 nt, Artificial Sequence; identical to SEQ ID NO: 132056
  derived and/or modified sequence opt3 from hemagglutinin__InfluenzaA__AHV83901

SEQ ID NO: 134034 - RNA, 1701 nt, Artificial Sequence; identical to SEQ ID NO: 132056
  derived and/or modified sequence opt3 from hemagglutinin__InfluenzaA__AHV83902

SEQ ID NO: 134035 - RNA, 1701 nt, Artificial Sequence; identical to SEQ ID NO: 132056
  derived and/or modified sequence opt3 from hemagglutinin__InfluenzaA__AHV83903

SEQ ID NO: 134036 - RNA, 1701 nt, Artificial Sequence; identical to SEQ ID NO: 132056
  derived and/or modified sequence opt3 from hemagglutinin__InfluenzaA__AHV83904

SEQ ID NO: 134037 - RNA, 1701 nt, Artificial Sequence
  derived and/or modified sequence opt3 from hemagglutinin__InfluenzaA__AHV83905
augaaggccauccuggugguccuccuuuacacccugacaacugcuaacgcagacacguugugcauuggcuaucacgccaauaacagcaccgauacaguugacacuguguuagagaaaaauguaaccgugacacauuccgucaaccugcuagaagauaagcacaaugggaaacucuguaagcugagaggaguggcgccccuucaucuggguaaaugcaacauagcuggcuggaucuuggggaauccugagugugaaucucucucaaccgccaguagcugguccuacauuguugagacuucuucgucagacaacggaacaugcuauccaggcgauuucaucaauuacgaggaacugagggagcagcugagcaguguguccucuuuugaacgguucgagauuuuuccgaagaccagcuccuggcccaaccacgacucaaauaagggugucacggcagccuguccucaugcuggggcaaaaaguuucuauaagaaccucaucugguuagugaaaaagggaaauagcuacccaaaacugucucaauccuauauaaacgauaagggcaaggaaguacuuguuuuguggggcauccaccaccccucaacuaccgccgaccagcagagccuguaccagaaugcugaugccuacguguuugucgggacaagucgcuauucuaaaaaguucaaaccugagauugcgauccgaccaaaggugcgugaccaagagggaagaaugaacuacuauuggacucuaguggaacccggugauaaaauuaccuuugaggcaacaggcaaccucgucguuccuagguacgccuucaccauggaacggaaugcuggguccggaaucauaauuagcgacacgccagugcaugauugcaacacuacaugucagaccccggagggcgccaucaauacuucgcugcccuuucagaacauucacccuaucacaaucgguaagugcccaaaauauguaaagucuaccaagcugcgccuugcaacgggguugagaaaugugcccuccauucagucaaggggacucuucggcgcuauagccggcuuuaucgaagggggauggaccgguauggucgacggcugguacggguaucaucaccaaaacgagcagggaaguggcuacgcggccgaccugaaaagcacacagaaugcaauugauaagaucacuaacaaaguuaauuccgugauagagaagaugaacacccaguucacagcuguggguaaagaauuuaaucacuuagagaagcggauugaaaaccugaauaagaaagucgacgauggguuccucgacaucuggacuuacaacgccgagcuucugguguugcuagaaaaugagcgcacccuggauuaucaugacucuaacguaaagaaccucuacgagaaaguucgaaaucaacugaagaacaaugcuaaagaaaucggcaacggauguuucgaguuuuaucacaagugcgauaauacauguauggaaagcgugaagaacggcaccuacgacuauccuaaauacucagaggaagccaaacuuaauagagagaagauugauggggucaagcuggagaguacuaggaucuaucagauuuuggcaauauacuccacgguggccagcucucucguccuggugguuucauuaggagcuaucaguuucuggaugugcagcaacgguucccugcagugccggauuuguaucuga

SEQ ID NO: 134038 - RNA, 1701 nt, Artificial Sequence; identical to SEQ ID NO: 132056
  derived and/or modified sequence opt3 from hemagglutinin__InfluenzaA__AHV83906

SEQ ID NO: 134039 - RNA, 1701 nt, Artificial Sequence; identical to SEQ ID NO: 132056
  derived and/or modified sequence opt3 from hemagglutinin__InfluenzaA__AHV83907

SEQ ID NO: 134040 - RNA, 1701 nt, Artificial Sequence
  derived and/or modified sequence opt3 from hemagglutinin__InfluenzaA__AHV83908
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaccauugucuacagcaucaaguuggagcuacauuguugagaccuccucuucggacaacggaacuugcuauccgggcgauuuuaucaauuacgaggagcucagggagcagcugucaagcgugaguuccuucgaacgguuugagauuuuccccaagacaucuagcuggccuaaccacgacuccaauaagggugucaccgccgcuuguccacaugcaggggccaaaucauuuuauaagaaccugaucuggcucgugaaaaagggaaauaguuaccccaaauuaagccaaucuuauauaaacgauaagggcaagaaaguacugguucuuuggggcauccaccacccuuccacgacugcugaccagcagucauuguaccagaaugccgaugcguacguguucgucgggaccagccgcuauaguaagaaauuuaagccagaaauugcaauccgacccaaagugcgugaccaagagggaagaaugaacuacuauuggacacugguggagccuggugauaagauuacuuucgaagccaccggcaaccuagucguuccaagguacgcuuuuacaauggagcggaaugccgggucuggaaucauaauuuccgacaccccggugcaugauugcaacacgacuugucagacacccgaaggcgcaaucaauaccagccucccuuuccagaacauucacccaaucacuaucgguaaaugccccaaguauguaaagucgacaaaacugcgccuugcuaccgggcugagaaaugugccuucuauucaguccaggggauuguuuggcgccauagcgggcuucaucgaagggggauggacggguauggucgacggcugguacggguaucaucaccaaaacgaacagggaucaggcuacgccgcagaccucaagaguacccagaaugcuauugauaaaaucacaaacaaggugaauagcguuauagagaaaaugaacacucaguuuaccgccguggguaaggaguucaaucaccuggaaaagcggauugagaacuuaaauaaaaaggucgacgauggguuccuggacaucuggacauacaacgcugaacuccuugugcuguuggagaaugaacgcacucuagauuaucaugacuccaacguuaaaaaccuguacgagaagguacgaaaucaacucaaaaacaaugccaaggagaucggcaacggauguuuugaguucuaucacaagugcgauaauaccuguauggaaucugugaaaaacggcacauacgacuauccaaaguacagcgaagaggcaaaacugaauagagaaaagauugauggggucaaacuugagucaaccaggaucuaucagauucuggccauauacaguacuguggcuuccagcuugguccucgugguuucucugggagcgaucucauuuuggaugugcaguaacgguagcuuacagugccggauuuguaucuga

SEQ ID NO: 134041 - RNA, 1701 nt, Artificial Sequence
  derived and/or modified sequence opt3 from hemagglutinin__InfluenzaA__AHV83911
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaccauugucuacagcaucaaguuggagcuacauuguugagaccuccucuucggacaacggaacuugcuauccgggcgauuuuaucaauuacgaagaacucagggagcagcugucaagcgugaguuccuucgaacgguuugagauuuuccccaagacaucuagcuggccuaaccacgacuccaauaagggugucaccgccgcuuguccacaugcaggggccaaaucauuuuauaagaaccugaucuggcucgugaaaaagggaaauaguuaccccaaauuaagccaaucuuauauaaacgauaagggcaaggaaguacugguucuuuggggcauccaccacccuuccacgacugcugaccagcagucauuguaccagaaugccgaugcguacguguucgucgggaccagccgcuauaguaaaaaguuuaaaccagagauugcaauccgacccaaggugcgugaccaagagggaagaaugaacuacuauuggacacugguggaaccuggugauaaaauuacuuucgaggccaccggcaaccuagucguuccaagguacgcuuuuacaauggaacggaaugccgggucuggaaucauaauuuccgacaccccggugcaugauugcaacacgacuugucagacacccgagggcgcaaucaauaccagccucccuuuccagaacauucacccaaucacuaucgguaagugccccaaauauguaaagucgacaaagcugcgccuugcuaccgggcugagaaaugugccuucuauucaguccaggggauuguuuggcgccauagcgggcuucaucgaagggggauggacggguauggucgacggcugguacggguaucaucaccaaaacgagcagggaucaggcuacgccgcagaccucaaaaguacccagaaugcuauugauaagaucacaaacaaagugaauagcguuauagagaagaugaacacucaguuuaccgccguggguaaagaguucaaucaccuggagaagcggauugaaaacuuaaauaagaaagucgacgauggguuccuggacaucuggacauacaacgcugagcuccuugugcuguuggaaaaugagcgcacucuagauuaucaugacuccaacguaaagaaccuguacgagaaaguucgaaaucaacucaagaacaaugccaaagaaaucggcaacggauguuuugaguucuaucacaagugcgauaauaccuguauggaaucugugaagaacggcacauacgacuauccaaaauacagcgaggaagcaaagcugaauagagagaaaauugauggggucaaacuugagucaaccaggaucuaucagauucuggccauauacaguacuguggcuuccagcuugguccucgugguuucucugggagcgaucucauuuuggaugugcaguaacgguagcuuacagugccggauuuguaucuga

SEQ ID NO: 134042 - RNA, 1701 nt, Artificial Sequence; identical to SEQ ID NO: 132056
  derived and/or modified sequence opt3 from hemagglutinin__InfluenzaA__AHV83912

SEQ ID NO: 134043 - RNA, 1701 nt, Artificial Sequence; identical to SEQ ID NO: 132056
  derived and/or modified sequence opt3 from hemagglutinin__InfluenzaA__AHV83913

SEQ ID NO: 134044 - RNA, 1701 nt, Artificial Sequence; identical to SEQ ID NO: 132056
  derived and/or modified sequence opt3 from hemagglutinin__InfluenzaA__AHV83915

SEQ ID NO: 134045 - RNA, 1701 nt, Artificial Sequence; identical to SEQ ID NO: 132056
  derived and/or modified sequence opt3 from hemagglutinin__InfluenzaA__AHV83916

SEQ ID NO: 134046 - RNA, 1701 nt, Artificial Sequence; identical to SEQ ID NO: 134041
  derived and/or modified sequence opt3 from hemagglutinin__InfluenzaA__AHV83917

SEQ ID NO: 134047 - RNA, 1701 nt, Artificial Sequence; identical to SEQ ID NO: 133019
  derived and/or modified sequence opt3 from hemagglutinin__InfluenzaA__AHV83919

SEQ ID NO: 134048 - RNA, 1701 nt, Artificial Sequence; identical to SEQ ID NO: 133936
  derived and/or modified sequence opt3 from hemagglutinin__InfluenzaA__AHV83920

SEQ ID NO: 134049 - RNA, 1701 nt, Artificial Sequence; identical to SEQ ID NO: 133037
  derived and/or modified sequence opt3 from hemagglutinin__InfluenzaA__AHV83921

SEQ ID NO: 134050 - RNA, 1701 nt, Artificial Sequence
  derived and/or modified sequence opt3 from hemagglutinin__InfluenzaA__AHV83922
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccucaaaagcacccagaaugcuauugauaagaucacaaacaaaguuaauuccgugauagagaagaugaacacucaguuuaccgccguggguaaagaguucucucaccuggagaagcggauugaaaauuuaaacaagaaagucgacgauggguuccuggacaucuggacauacaaugcugagcuccuugugcuguuggaaaacgagcgcacucuagauuaucaugacagcaauguaaagaaccuguacgagaaaguucgaaaccaacucaagaauaacgccaaagaaaucggcaauggauguuuugaguucuaucacaagugcgauaacaccuguauggaaucagugaagaauggcacauacgacuauccuaaauacagugaggaagcaaagcugaacagagagaaaauugauggggucaaacuugaguccaccaggaucuaucagauucuggccauauacagcacuguggcuucuucauugguccucgugguuagucugggagcgaucagcuuuuggaugugcuccaaugguucuuuacagugccggauuuguaucuga

SEQ ID NO: 134051 - RNA, 1701 nt, Artificial Sequence; identical to SEQ ID NO: 133952
  derived and/or modified sequence opt3 from hemagglutinin__InfluenzaA__AHV83923

SEQ ID NO: 134052 - RNA, 1701 nt, Artificial Sequence; identical to SEQ ID NO: 133936
  derived and/or modified sequence opt3 from hemagglutinin__InfluenzaA__AHV83924

SEQ ID NO: 134053 - RNA, 1701 nt, Artificial Sequence; identical to SEQ ID NO: 133952
  derived and/or modified sequence opt3 from hemagglutinin__InfluenzaA__AHV83925

SEQ ID NO: 134054 - RNA, 1701 nt, Artificial Sequence; identical to SEQ ID NO: 133936
  derived and/or modified sequence opt3 from hemagglutinin__InfluenzaA__AHV83926

SEQ ID NO: 134055 - RNA, 1701 nt, Artificial Sequence; identical to SEQ ID NO: 134041
  derived and/or modified sequence opt3 from hemagglutinin__InfluenzaA__AHV83927

SEQ ID NO: 134056 - RNA, 1701 nt, Artificial Sequence
  derived and/or modified sequence opt3 from hemagglutinin__InfluenzaA__AHV83928
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaagaacucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuaucucaauccuauauaaacgauaagggcaaggaaguacugguucuuuggggcauccaccaccccucaacuaccgccgaccagcagagcuuguaccagaaugcugaugccuacguguucgucgggacaagucgcuauucuaaaaaguuuaaaccugagauugcgauccgaccaaaggugcgugaccaagagggaagaaugaacuacuauuggacucugguggaacccggugauaaaauuaccuucgaggcaacaggcaaccuagucguuccuagguacgccuuuaccauggaacggaaugcuggguccggaaucauaauuagcgacacgccagugcaugauugcaacacuacaugucagaccccggagggcgccaucaauacuucgcuccccuuccagaacauucacccuaucacaaucgguaagugcccaaaauauguaaagucuaccaagcugcgccuugcaacggggcugagaaaugugcccuccauucagucaaggggauuguuuggcgcuauagccggcuucaucgaagggggauggaccgguauggucgacggcugguacggguaucaucaccaaaacgagcagggaaguggcuacgcggccgaccagaaaagcacacagaaugcaauugauaagaucacuaacaaaguuaauuccgugauagagaagaugaacacccaauuuacagcuguggguaaagaguucaaucaccucgagaagcggauugaaaaccugaauaagaaagucgacgauggguucuuagacaucuggacuuacaacgccgagcugcucgugcuucuggaaaaugagcgcaccuuggauuaucaugacucuaacguaaagaaccuauacgagaaaguucgaaaucagcugaagaacaaugcuaaagaaaucggcaacggauguuuugaguucuaucacaagugcgauaauacauguauggaaagcgugaagaacggcaccuacgacuauccuaaauacucagaggaagccaagcucaauagagagaaaauugauggggucaagcuggagaguacuaggaucuaucagauucuugcaauauacuccacgguggccagcucucuggucuuggugguuucacucggagcuaucaguuuuuggaugugcagcaacgguucccugcaaugccggauuuguaucuga

SEQ ID NO: 134057 - RNA, 1701 nt, Artificial Sequence; identical to SEQ ID NO: 133936
  derived and/or modified sequence opt3 from hemagglutinin__InfluenzaA__AHV83929

SEQ ID NO: 134058 - RNA, 1701 nt, Artificial Sequence
  derived and/or modified sequence opt3 from hemagglutinin__InfluenzaA__AHV83930
augaaggccauccuggugauucuccuuuacaccuucgcuacagcaaacgccgacacucugugcauaggcuaucacgcgaauaacagcacggauaccgucgacacaguuuuggagaagaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauuaauuacgaagaacucagggagcagcugagcaguguuuccucuuucgaacgguuugagaucuucccgaagacaagcuccuggcccaaccacgacucaaauaagggugugaccgccgcuuguccucaugcaggggccaaaaguuuuuauaagaaccugauauggcucgucaaaaagggaaauagcuacccaaaauuaucucaauccuauaucaacgauaagggcaaggaagugcugguacuuuggggcauucaccaccccucaacgacugcugaccagcagagcuuguaccagaaugccgaugcguacguuuucguggggaccagucgcuauucuaaaaaguuuaaaccugagaucgcaauucgaccaaagguccgugaccaagagggaagaaugaacuacuauuggacacugguggaacccggugauaaaaucacuuucgaggccaccggcaaccuaguggucccuagguacgcuuuuacaauggaacggaaugccggguccggaauaauuaucagcgacaccccaguucaugauugcaacacgacuugucagacaccggagggcgcaauuaauaccucgcuccccuuccagaacauccacccuaucacuauugguaagugcccaaaauaugugaagucuacaaagcugcgccuugcuaccgggcugagaaauguacccuccauacagucaaggggauuguuuggcgccaucgcgggcuucauugaagggggauggacggguaugguggacggcugguacggguaucaucaccaaaacgagcagggaaguggcuacgccgcagaccucaaaagcacccagaaugcuaucgauaagauaacaaacaaagucaauuccgugauugagaagaugaacacucaguuuaccgccguugguaaagaguucaaucaccuggagaagcggaucgaaaacuuaaauaagaaaguggacgauggguuccuggacaucuggacauacaacgcugagcuccuuguccuguuggaaaaugagcgcacucuagauuaucaugacucuaacgugaagaaccuguacgagaaaguacgaaaucaacucaagaacaaugccaaagaaauuggcaacggauguuuugaguucuaucacaagugcgauaauaccuguauggaaagcguuaagaacggcacauacgacuauccuaaauacucagaggaagcaaagcugaauagagagaaaaucgauggggugaaacuugagaguaccaggauuuaucagauacuggccaucuacuccacugucgcuagcucuuuggugcucgucgugucacugggagcgauuaguuuuuggaugugcagcaacgguuccuuacagugccggaucuguaucuga

SEQ ID NO: 134059 - RNA, 1701 nt, Artificial Sequence; identical to SEQ ID NO: 133936
  derived and/or modified sequence opt3 from hemagglutinin__InfluenzaA__AHV83931

SEQ ID NO: 134060 - RNA, 1701 nt, Artificial Sequence; identical to SEQ ID NO: 132056
  derived and/or modified sequence opt3 from hemagglutinin__InfluenzaA__AHV83932

SEQ ID NO: 134061 - RNA, 1701 nt, Artificial Sequence
  derived and/or modified sequence opt3 from hemagglutinin__InfluenzaA__AHV83933
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggagugacaccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaagaacucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuaucucaauccuauauaaacgauaagggcaaggaaguacugguucuuuggggcauccaccaccccucaacuaccgccgaccagcagagcuuguaccagaaugcugaugccuacguguucgucgggacaagucgcuauucuaaaaaguuuaaaccugagauugcgauccgaccaaaggugcgugaccaagagggaagaaugaacuacuauuggacucugguggaacccggugauaaaauuaccuucgaggcaacaggcaaccuagucguuccuagguacgccuuuaccauggaacggaaugcuggguccggaaucauaauuagcgacacgccagugcaugauugcaacacuacaugucagaccccggagggcgccaucaauacuucgcuccccuuccagaacauucacccuaucacaaucgguaagugcccaaaauauguaaagucuaccaagcugcgccuugcaacggggcugagaaaugugcccuccauucagucaaggggauuguuuggcgcuauagccggcuucaucgaagggggauggaccgguauggucgacggcugguacggguaucaucaccaaaacgagcagggaaguggcuacgcggccgaccagaaaagcacacagaaugcaauugauaagaucacuaacaaaguuaauuccgugauagagaagaugaacacccaauuuacagcuguggguaaagaguucaaucaccucgagaagcggauugaaaaccugaauaagaaagucgacgauggguucuuagacaucuggacuuacaacgccgagcugcucgugcuucuggaaaaugagcgcaccuuggauuaucaugacucuaacguaaagaaccuauacgagaaaguucgaaaucagcugaagaacaaugcuaaagaaaucggcaacggauguuuugaguucuaucacaagugcgauaauacauguauggaaagcgugaagaacggcaccuacgacuauccuaaauacucagaggaagccaagcucaauagagagaaaauugauggggucaagcuggagaguacuaggaucuaucagauucuugcacuguacuccacgguggccagcucuuugguccucgugguuucacugggagcuauaaguuuuuggaugugcagcaacgguuccuuacaaugccggaucuguauuuga

SEQ ID NO: 134062 - RNA, 1701 nt, Artificial Sequence; identical to SEQ ID NO: 133019
  derived and/or modified sequence opt3 from hemagglutinin__InfluenzaA__AHV83934

SEQ ID NO: 134063 - RNA, 1701 nt, Artificial Sequence; identical to SEQ ID NO: 132056
  derived and/or modified sequence opt3 from hemagglutinin__InfluenzaA__AHV83935

SEQ ID NO: 134064 - RNA, 1701 nt, Artificial Sequence; identical to SEQ ID NO: 132056
  derived and/or modified sequence opt3 from hemagglutinin__InfluenzaA__AHV83937

SEQ ID NO: 134065 - RNA, 1701 nt, Artificial Sequence
  derived and/or modified sequence opt3 from hemagglutinin__InfluenzaA__AHV83938
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaaauaucucaauccuauaucaacgauaagggcaaggaaguauuaguucuguggggcauucaccaccccucaacgacugcugaccagcagagccuuuaccagaaugccgaugcguacguguucgucgggaccagucgcuauucuaaaaaguuuaaaccugagaucgcaauucgaccaaaggugcgugaccaagagggaagaaugaacuacuauuggacauugguggaacccggugauaaaaucacuuucgaggccaccggcaaccuggucguuccuagguacgcuuuuacaauggaacggaaugccggguccggaauaauuaucagcgacaccccagugcaugauugcaacacgacuugucagacaccggagggcgcaauuaauaccucgcuacccuuccagaacauccacccuaucacuauugguaagugcccaaaauauguaaagucuacaaagcuccgccuggcuaccgggcuuagaaaugugcccuccauacagucaaggggacuguuuggcgccaucgcgggcuucauugaagggggauggacggguauggucgacggcugguacggguaucaucaccaaaacgagcagggaaguggcuacgccgcagaccagaaaagcacccagaaugcuaucgauaagauaacaaacaaaguuaauuccgugauugagaagaugaacacucaauuuaccgccguggguaaagaguucaaucacuuggagaagcggaucgaaaaccucaauaagaaagucgacgauggguuccuggacaucuggacauacaacgcugaguuacuggugcuccuugaaaaugagcgcacucuggauuaucaugacucuaacguaaagaacuuguacgagaaaguucgaaaucagcuaaagaacaaugccaaagaaauuggcaacggauguuuugaguucuaucacaagugcgauaauaccuguauggaaagcgugaagaacggcacauacgacuauccuaaauacucagaggaagcaaagcugaauagagagaaaaucgauggggucaagcucgagaguaccaggauuuaucagauacuggccaucuacuccacuguggcuagcucucuuguccuggugguuucauugggagcgauuaguuuuuggaugugcagcaacgguucccuccaaugccggaucuguaucuga

SEQ ID NO: 134066 - RNA, 1701 nt, Artificial Sequence; identical to SEQ ID NO: 134065
  derived and/or modified sequence opt3 from hemagglutinin__InfluenzaA__AHV83939

SEQ ID NO: 134067 - RNA, 1701 nt, Artificial Sequence
  derived and/or modified sequence opt3 from hemagglutinin__InfluenzaA__AHV83940
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccagaaaagcacccagaaugcuauugauaagaucacaaacaaaguuaauuccgugauagagaagaugaacacucaauuuaccgccguggguaaagaguucaaucaccucgagaagcggauugaaaaccugaauaagaaagucgacgauggguucauggacaucuggacauacaacgcugaguuacuggugcuccuugaaaaugagcgcacucuggauuaucaugacucuaacguaaagaacuuguacgagaaaguucgaaaucagcuaaagaacaaugccaaagaaaucggcaacggauguuuugaguucuaucacaagugcgauaauaccuguauggaaagcgugaagaacggcacauacgacuauccuaaauacucagaggaagcaaagcugaauagagagaaaauugauagggucaagcucgagaguacccggaucuaucagauucuggccauauacuccacuguggcuagcucucuuguccuggugguuucauugggggcgaucaguuuuuggaugugcagcaacggaucccuccaaugccguauuuguaucuga

SEQ ID NO: 134068 - RNA, 1701 nt, Artificial Sequence; identical to SEQ ID NO: 132056
  derived and/or modified sequence opt3 from hemagglutinin__InfluenzaA__AHV83941

SEQ ID NO: 134069 - RNA, 1701 nt, Artificial Sequence
  derived and/or modified sequence opt3 from hemagglutinin__InfluenzaA__AHV83943
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccucaaaagcacccagaaugcuauugauaagaucacaaacaaaguuaauuccgugauagagaagaugaacacucaguuuaccgccguggguaaagaguucaaucaccuggagaagcggauugaaaacuuaaauaagaaagucgacgauggguuccuggacaucuggacauacaacgcugagcuccuugugcuguuggaaaaugagcgcacucuagauuaucaugacucuaacguaaagaaccuguacgagaaaguucgaaaucaacucaagaacaaugccaaagaaaucggcaacggauguuuugaguucuaucacaagugcgauaauauguguauggaaagcgugaagaacggcaccuacgacuauccuaaauacucagaggaagcaaagcugaauagagagaaaauugauggggucaaacuugagaguacaaggaucuaucagauucuggccauauacuccaccguggcuagcucuuugguccucgugguuucacugggagcgaucaguuuuuggaugugcagcaacgguuccuuacagugccggauuuguaucuga

SEQ ID NO: 134070 - RNA, 1701 nt, Artificial Sequence
  derived and/or modified sequence opt3 from hemagglutinin__InfluenzaA__AHV83944
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagaugagcacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucaauuacgaggagcucagggaacagcugagcaguguguccucuuucgagcgguuugaaauuuucccgaaaacaagcuccuggcccaaccacgacucaaauaagggugucaccgccgcuuguccucaugcaggggccaagaguuuuuauaaaaaccugaucuggcucgugaagaaaggaaauagcuacccaaaguuaucucaauccuauauaaacgauaaaggcaaggagguacugguucuuuggggcauccaccaccccucaacgacugcugaccagcagagcuuguaccagaaugccgaugcguacguguucgucgggaccagucgcuauucuaagaaauuuaagccugagauugcaauccgaccaaaagugcgugaccaagaaggaagaaugaacuacuauuggacacugguggagcccggugauaagauuacuuucgaagccaccggcaaccuagucguuccuagguacgcuuuuacaauggagcggaaugccggguccggaaucauaauuagcgacaccccagugcaugauugcaacacgacuugucagacaccggaaggcgcaaucaauaccucgcuccccuuccagaacauucacccuaucacuaucgguaaaugcccaaaguauguaaaaucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccucaagagcacccagaaugcuauugauaaaaucacaaacaagguaaauuccguuauagagaaaaugaacacucaguuuaccgccguggguaaggaguucaaucaccuggaaaaacggauugagaacuuaaauaagaaggucgacgauggguuccuggacaucuggacauacaacgcugaacuccuugugcuguuggagaaugagcgcacucuagauuaucaugacucuaacgugaaaaaccuguacgaaaagguucgaaaucaacucaaaaacaaugccaaggagaucggcaacggauguuuugaguucuaucacaaaugcgauaauaccuguauggaaagcgugaagaacggcacauacgacuauccuaaguacucagaagaggcaaaacugaauagagagaagauugauggggucaaacuugaaaguaccaggaucuaucagauucuggccauauacuccacuguggcuagcucuuugguccucgugguuucacugggagcgaucaguuuuuggaugugcagcaacgguuccuuacagugccggauuuguaucuga

SEQ ID NO: 134071 - RNA, 1701 nt, Artificial Sequence
  derived and/or modified sequence opt3 from hemagglutinin__InfluenzaA__AHV83945
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacuaccgaccagcagagcuuguaccagaaugcugaugccuacguguucgucgggacaagucgcuauucuaaaaaguuuaaaccugagauugcgauccgaccaaaggugcgugaccaagagggaagaaugaacuacuauuggacucugguggaacccggugauaaaauuaccuucgaggcaacaggcaaccuagucguuccuagguacgccuuuaccauggaacggaaugcuggguccggaaucauaauuagcgacacgccagugcaugauugcaacacuacaugucagaccccggagggcgccaucaauacuucgcuccccuuccagaacauucacccuaucacaaucgguaagugcccaaaauauguaaagucuaccaagcugcgccuugcaacggggcugagaaaugugcccuccauucagucaaggggauuguuuggcgcuauagccggcuucaucgaagggggauggaccgguauggucgacggcugguacggguaucaucaccaaaacgagcagggaaguggcuacgcggccgaccucaaaagcacacagaaugcaauugauaagaucacuaacaaaguuaauuccgugauagagaagaugaacacccaguuuacagcuguggguaaagaguucaaucaccuggagaagcggauugaaaacuuaaauaagaaagucgacgauggguuccuggacaucuggacuuacaacgccgagcuccuugugcuguuggaaaaugagcgcacccuagauuaucaugacucuaacguaaagaaccuguacgagaaaguucgaaaucaacucaagaacaaugcuaaagaaaucggcaacggauguuuugaguucuaucacaagugcgauaauacauguauggaaagcgugaagaacggcaccuacgacuauccuaaauacucagaggaagccaagcugaauagagagaaaauugauggggucaaacuugagaguacuaggaucuaucagauucuggcaauauacuccacgguggccagcucuuugguccucgugguuucacugggagcuaucaguuuuuggaugugcagcaacgguuccuuacagugccggauuuguaucuga

SEQ ID NO: 134072 - RNA, 1701 nt, Artificial Sequence
  derived and/or modified sequence opt3 from hemagglutinin__InfluenzaA__AHV83947
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacagugaagcggaaugccggguccggaaucauaauuagcgacaccccaguacaugauugcaacacgacuugucagacaccggaaggcgcaaucaauaccucgcuccccuuccagaacauucacccuaucacuaucgguaaaugcccaaaguaugugaagucuacaaaacugcgccuugcuaccgggcugagaaauguccccuccauucagucaaggggauuguuuggcgccauagcgggcuucaucgaagggggauggacggguaugguggacggcugguacggguaucaucaccaaaacgaacagggaaguggcuacgccgcagaccaaaagagcacccagaaugcuauugauaaaaucacaaacaagguuaauuccgugauagagaaaaugaacacucaguuuaccgccgucgguaaggaguucaaucaccucgaaaagcggauugagaaccugaauaaaaagguggacgauggguucuuagacaucuggacauacaacgcugaacugcucguacuucuggagaaugaacgcacuuuggauuaucaugacucuaacguuaaaaaccuauacgagaaggugcgaaaucagcugaaaaacaaugccaaggagaucggcaacggauguuuugaguucuaucacaagugcgauaauaccuguauggaaagcgucaaaaacggcacauacgacuauccuaaguacucagaagaggcaaaacucaauagagaaaagauugauggggugaaacuggagaguaccaggaucuaucagauucuugccauauacuccacugucgcuagcucucugguguugguugugucacucggagcgaucaguuuuuggaugugcagcaacgguucccugcaaugccggauuuguaucuga

SEQ ID NO: 134073 - RNA, 1701 nt, Artificial Sequence; identical to SEQ ID NO: 132056
  derived and/or modified sequence opt3 from hemagglutinin__InfluenzaA__AHV83948

SEQ ID NO: 134074 - RNA, 1701 nt, Artificial Sequence; identical to SEQ ID NO: 132056
  derived and/or modified sequence opt3 from hemagglutinin__InfluenzaA__AHV83949

SEQ ID NO: 134075 - RNA, 1701 nt, Artificial Sequence; identical to SEQ ID NO: 132056
  derived and/or modified sequence opt3 from hemagglutinin__InfluenzaA__AHV83950

SEQ ID NO: 134076 - RNA, 1701 nt, Artificial Sequence
  derived and/or modified sequence opt3 from hemagglutinin__InfluenzaA__AHV83953
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugauggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgagguggaaggcaggauucaggaccuggagaaauacgucgaggauacaaagauagacuuauggucauauaacgcagaacugcucguugcucuugagaaccaacauaccaucgaucugacggacagugaaaugaauaaauuguucgagaagaccaaaaagcagcuacgggaaaacgccgaggaucugggaaauggcugcuuuaagauuuaccacaaaugugacaacgcuugcaucggguccauucgaaauggaacauaugaucaugacguguaccgcgacgaggcccucaacaauagauuccagaucaaggguguagaacugaaaagcggcuacaaggauuggauacuuuggaucucuuuugcaauuucaugcuuccuguuguguguggcccuccugggguuuaucaugugggcuugccagaaaggaaacauuagguguaauaucugcauauga

SEQ ID NO: 134077 - RNA, 1701 nt, Artificial Sequence; identical to SEQ ID NO: 133908
  derived and/or modified sequence opt3 from hemagglutinin__InfluenzaA__AHV83954

SEQ ID NO: 134078 - RNA, 1701 nt, Artificial Sequence
  derived and/or modified sequence opt3 from hemagglutinin__InfluenzaA__AHV83956
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaauuucaacugggcugguguuacucaaaaugggacaaguuccgcaugcauucgcggaucuaacagcuccuuuuucucacgacugaauuggcucacccauuuaaacuuuaaguauccagcccugaacgugacgaugcccaauaacgagcaguucgacaaguuguacaucuggggcguccaccauccuggcacugauaaagaccagauuuuucuuuaugcucagaguagcgggcguaucaccgugucuacaaagagaucccaacaggccguaauaccaaauauuggaucaaggccccggauccgcaacauuccuagcagaaucaguaucuacuggacuauuguuaaaccaggugauauacugcuaaucaauucuaccggcaaccucauugcgccgaggggguacuucaagauccgguccggaaaaagcucgauaaugcgcucugacgcacccauuggcaaguguaaguccgaaugcaucacaccuaaugguucaaucccaaacgacaaacccuuucagaaugugaaccgaauuaccuauggggccuguccuagauacgucaagcagaguacgcugaaacuugcuacuggaaugaggaaugugcaagagaagcagacacggggcaucuucggcgccauugcaggguuuauagaaaacggaugggaggguaugaaagauggcugguauggguuccgucaccagaauagcgagggacgcggccaagcugccgaccugaaguccacccaggcggccaucgaucagauuaacgguaaauugaauagacucaucgggaagacuaacgaaaaguuccaccagaucgagaaagaauuuucugagguggaaggcaggauucaagaccuggagaaguacgucgaggauacaaaaauagacuuauggagcuauaacgcagaacugcucguugcucuugagaaucagcauaccaucgaucugacggacucagaaaugaacaaguuguucgagaaaaccaagaagcagcuacgggaaaaugccgaggauaugggaaacggcugcuuuaaaauuuaccacaagugugacaaugcuugcaucgggaguauucgaaacggaacauaugaucaugacguguaccgcgacgaggcccugaauaacagauuccagaucaaagguguagaacucaaguccggcuacaaagauuggauacuguggaucagcuuugcaauuucuugcuuccuucuguguguggccuugcucggguuuaucaugugggcuugccaaaagggaaauauuagguguaacaucugcauauga

SEQ ID NO: 134079 - RNA, 1701 nt, Artificial Sequence
  derived and/or modified sequence opt3 from hemagglutinin__InfluenzaA__AHZ13523
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuucucuaauuguuaucccuacgacgucccugauuaugcaucguugcgcucacucguggccagcaguggcacucuggaguuuauaaacgaagguuucaauuggacagggguuacccaguccggaggcucuuacgcuugcaagcgaggcagcgugaacuccuuuuucucacgucugaauuggcucuauaagagugagagcaaauacccagucuuaaacgugacgaugcccaauaacgggaaguuugacaaacuguauaucuggggaguacaccauccuucuacugauaaggagcaaaccaaucuuuacguuagagcauccgguagggugacagucucaacuaaacggagccagcagaccgugauuccaaacaucggcagucgccccugggugagaggguugucuuccaggauuagcaucuacuggacaauagucaagccuggagacauucugcuaaucaacucgaccggcaaucucauugccccacgggguuauuucaagauccgcacggggaaaucuuccaucaugcgaucagaugcuccgauuggaacuuguaguuacgaaugcauaacacccaacggcagcaucccuaaugacaagccauuucagaacguuaauaaaauuaccuauggcgccugucccagauacgugaagcaaaacacucugaaacuugcgacagggaugaggaauguaccugagaagcagacccggggaaucuucggugcaauagccggcuuuauugaaaacgggugggagggaaugguggacggcugguaugguuuccgucaccaaaauuccgaggggacgggccaggcugccgaucugaaaucuacccaggcagcuaucgaccagaucaacggaaaguugaaucgccucauugaaaagacaaacgagaaauuccaccagaucgaaaaggaguuuagcgaagucgagggcaggauucaagaucuggagaaauacguggaagacacuaagauagauuuauggucauauaaugccgagcugcucguugcgcuugaaaaccagcauaccaucgaccugacagauagugagaugaauaaauuguucgaaaagacuagaaagcagcuacgggagaacgccgaggacauggggaacggaugcuuuaaaauuuaccacaagugugauaaugcaugcaucgguuccauccgaaacggcaccuacaaucaugacguguaucgcgaugaagcucugaacaauagauuccagauuaaaggggucgagcucaagagcggauacaaagacuggauacuguggaucucuuuugccauuucaugcuuccuucugugugugguauugcucggcuuuaucaugugggcuugccaaaaggguaacauuagguguaauaucugcauauga

SEQ ID NO: 134080 - RNA, 1698 nt, Artificial Sequence; identical to SEQ ID NO: 125632
  derived and/or modified sequence opt3 from hemagglutinin__InfluenzaA__AHZ13582

SEQ ID NO: 134081 - RNA, 1701 nt, Artificial Sequence
  derived and/or modified sequence opt3 from hemagglutinin__InfluenzaA__AHZ35584
augaagaccaucauugcccugagcuacauacucugccuuaucuucgcucaggagauucccggcaacgacaauuccacagcaacucuguguuuggggcaccaugccgugccuaacggaacgaucgucaaaaccauuacaaaugaucaaaucgaaguuacuaacgcgaccgaguuagugcagucuucaaguacaggugaaauaugcaauagcccacaccagauccuggacggcgagaacuguacccuaauugaugcucuccugggggacccgcagugcgaugacuuucaaaauaagaaaugggaucuuuucguagaaagauccaaggcccauucuaacuguuaucccuacgacgugccugauuaugcaucgcugaggucauuggucgccagcaguggaacucucgaguuuaauaacgaguccuucaauuggacaggcgugacccagaacgguacgucuagcgcuugcauccggcgcuccaauaacucauuuuucagucgacugaauuggcugacucaccucaacuuuaaauacccagcauuaaacguuaccaugcccaauaacgaacaguucgacaagcuguauauuuggggagugcaucacccugggacagauaaggaccagaucuuucuuuacgcccaagcuagcggccguauaacugucucuaccaaaagaucccagcaggccgugauuccaaauaucggcucaaggccccggguacgcaacauuccuagcagaguuaguaucuauuggacaaucgugaagccaggggauauuuugcugauaaauucuaccggaaaccuaaucgcgccgagggguuacuucaaaauucgguccggcaagagcucgaucaugcgcucugacgcacccauagggaaauguaauuccgccugcauuacgccuaacggaucaaucccaaaugacaagcccuuucagaacgucaaucgaaucacuuacggcgcuuguccuagauaugugaagcaaaacacacucaaacuggccaccgguaugaggaaugugccagagaagcagacucgggggauuuucggagcaaucgcuggcuuuauugaaaacggcugggaggggauggucgauggaugguacgguuuccgucaccagaauagugagggccgcgggcaagccgcggaccuuaaaagcacacaggccgcaauagaucagaucaacggaaagcugaacagauugauuggcaaaaccaaugaaaaguuccaucagaucgagaaagaauuuuccgagguugaagguaggauccaagaccucgagaaguauguggaggauacgaagauugaccuguggucuuacaacgcugaauuacugguagcccucgagaaucagcacaccauagaucuuacagacagcgaaaugaacaaacuguucgagaagacuaaaaagcaguugcgggaaaaugcugaggauauggggaacggcugcuuuaaaaucuaucauaagugugacaaugccugcauuggaucaauccgaaacggcaccuacgaucacgacguguaucgcgacgaggcacuaaauaacagauuccagauuaagggggucgaacugaaaaguggauacaaggauuggauccucuggauauccuuugccaucagcugcuuccugcuuuguguggcucuguuggguuuuauuaugugggcgugccaaaaaggcaauaucagguguaacauuugcaucuga

SEQ ID NO: 134082 - RNA, 1701 nt, Artificial Sequence
  derived and/or modified sequence opt3 from hemagglutinin__InfluenzaA__AHZ35608
augaagaccaucauugcccugagcuacauacucugccuuaucuucgcucaggagauucccggcaacgacaauuccacagcaacucuguguuuggggcaccaugccgugccuaacggaacgaucgucaaaaccauuacaaaugaucaaaucgaaguuacuaacgcgaccgaguuagugcagucuucaaguacaggugaaauaugcaauagcccacaccagauccuggacggcgagaacuguacccuaauugaugcucuccugggggacccgcagugcgaugacuuucaaaauaaggaaugggaucuuuucguagagagauccaaagcccauucuaacuguuaucccuacgacgugccugauuaugcaucgcugaggucauuggucgccagcaguggaacucucgaguuuaauaacgaauccuucaauuggacaggcgugacccagaacgguacgucuagcgcuugcauccggcgcuccaauaacucauuuuucagucgacugaauuggcugacucaccucaacuuuaaguacccagcauuaaacguuaccaugcccaauaacgagcaguucgacaaacuguauauuuggggagugcaucacccugggacagauaaggaccagaucuuucuuuacgcccaagcuagcggccguauaacugucucuaccaagagaucccagcaggccgugauuccaaauaucggcucaaggccccggguacgcaacauuccuagcagaguuaguaucuauuggacaaucgugaaaccaggggauauuuugcugauaaauucuaccggaaaccuaaucgcgccgagggguuacuucaagauucgguccggcaaaagcucgaucaugcgcucugacgcacccauagggaaguguaauuccgccugcauuacgccuaacggaucaaucccaaaugacaaacccuuucagaacgucaaucgaaucacuuacggcacauguccuagauaugugaagcaaaacacccucaagcuggcuacugguaugaggaaugugccagaaaaacagacacgggggauuuucggagccaucgcaggcuuuauugagaacggcugggaggggauggucgauggaugguacgguuuccgucaccagaauagugaaggccgcgggcaagcugccgaccuuaagagcacccaggcggccauagaucagaucaacggaaaacugaacagauugauuggcaagacgaaugagaaauuccaucagaucgaaaaggaguuuuccgaaguugaggguaggauccaagaccucgagaaauauguggaagauaccaagauugaccuguggucuuacaacgcagaguuacugguagcucucgaaaaucagcacacaauagaucuuacugacagcgagaugaacaagcuguucgagaaaaccaagaaacaguugcgggaaaaugccgaggauauggggaacggcugcuuuaagaucuaucauaaaugugacaaugcuugcauuggaucaauccgaaacggcacauacgaucacgacguguaucgcgacgaagcccuaaauaacagauuccagauuaagggggucgagcugaagaguggauacaaagauuggauccucuggauauccuuugcaaucagcugcuuccugcuuuguguggcccuguuggguuuuauuaugugggcuugccaaaagggcaauaucagguguaacauuugcaucuga

SEQ ID NO: 134083 - RNA, 1701 nt, Artificial Sequence; identical to SEQ ID NO: 134081
  derived and/or modified sequence opt3 from hemagglutinin__InfluenzaA__AHZ35620

SEQ ID NO: 134084 - RNA, 1701 nt, Artificial Sequence; identical to SEQ ID NO: 134081
  derived and/or modified sequence opt3 from hemagglutinin__InfluenzaA__AHZ35632

SEQ ID NO: 134085 - RNA, 1701 nt, Artificial Sequence; identical to SEQ ID NO: 134081
  derived and/or modified sequence opt3 from hemagglutinin__InfluenzaA__AHZ35644

SEQ ID NO: 134086 - RNA, 1701 nt, Artificial Sequence; identical to SEQ ID NO: 134081
  derived and/or modified sequence opt3 from hemagglutinin__InfluenzaA__AHZ35656

SEQ ID NO: 134087 - RNA, 1701 nt, Artificial Sequence; identical to SEQ ID NO: 134081
  derived and/or modified sequence opt3 from hemagglutinin__InfluenzaA__AHZ35668

SEQ ID NO: 134088 - RNA, 1701 nt, Artificial Sequence; identical to SEQ ID NO: 134082
  derived and/or modified sequence opt3 from hemagglutinin__InfluenzaA__AHZ35680

SEQ ID NO: 134089 - RNA, 1701 nt, Artificial Sequence; identical to SEQ ID NO: 134081
  derived and/or modified sequence opt3 from hemagglutinin__InfluenzaA__AHZ35692

SEQ ID NO: 134090 - RNA, 1701 nt, Artificial Sequence; identical to SEQ ID NO: 134081
  derived and/or modified sequence opt3 from hemagglutinin__InfluenzaA__AHZ35716

SEQ ID NO: 134091 - RNA, 1701 nt, Artificial Sequence; identical to SEQ ID NO: 134082
  derived and/or modified sequence opt3 from hemagglutinin__InfluenzaA__AHZ35728

SEQ ID NO: 134092 - RNA, 1701 nt, Artificial Sequence; identical to SEQ ID NO: 134081
  derived and/or modified sequence opt3 from hemagglutinin__InfluenzaA__AHZ35740

SEQ ID NO: 134093 - RNA, 1701 nt, Artificial Sequence; identical to SEQ ID NO: 134081
  derived and/or modified sequence opt3 from hemagglutinin__InfluenzaA__AHZ35752

SEQ ID NO: 134094 - RNA, 1701 nt, Artificial Sequence; identical to SEQ ID NO: 134081
  derived and/or modified sequence opt3 from hemagglutinin__InfluenzaA__AHZ35764

SEQ ID NO: 134095 - RNA, 1701 nt, Artificial Sequence; identical to SEQ ID NO: 134081
  derived and/or modified sequence opt3 from hemagglutinin__InfluenzaA__AHZ35776

SEQ ID NO: 134096 - RNA, 1701 nt, Artificial Sequence
  derived and/or modified sequence opt3 from hemagglutinin__InfluenzaA__AHZ35823
augaaggccauccuggugguccuccuuuacaccuucgcuauugcaaacgccgacacacugugcauaggcuaucacgcgaauaacagcacugauacgguugacaccguguuggagaaaaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauuaauuacgaggagcucagggagcagcugagcaguguguccucuuucgaacgguuugagauguucccgaagacuagcuccuggcccaaccacgacucaaauaagggugucacagccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaaccacggcugaccaacagagcuuguaccagaaugccgaugcguacguguucgucgggacuucccgcuauucuaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcaggguccggaaucauaauuagcgacaccccagugcaugauugcaacacaaccugucaaacgccgaaaggcgcuaucaauacuucgcuccccuuccagaacauucacccuaucacaaucgguaagugcccaaaguauguaaaaucuaccaagcugcgccuugccacugggcugagaaaugugcccuccauucagucaaggggauuguuuggcgcgauagccggcuucaucgaagggggauggacagguauggucgacggcugguacggguaucaucaccagaacgaacaaggaaguggcuacgcagcugaccucaaaagcacccagaaugccauugauaagaucacgaacaaagugaauaguguuauagagaagaugaacacccaguuuacagcuguggguaaggaguucaaucaccuggaaaaacggauugagaacuuaaauaagaaagucgacgauggguuccuggacaucuggacuuacaacgccgaacuccuugugcuguuggagaaugaacgcacccuagauuaucaugacucuaacguaaagaaccuguacgagaaaguucgaaaucagcucaagaacaaugcaaaggagaucggcaacggauguuuugaguucuaucacaaaugcgauaauacauguauggaaagcgugaagaacggcacuuacgacuauccuaaauacucagaagaggccaagcugaauagagaagagauugauggggucaaacuugagaguaccaggaucuaucaaauucuggcuauauacuccacaguggcgagcucuuugguccucgugguuucacugggagcaaucaguuuuuggaugugcagcaacgguuccuuacagugccggauuuguaucuga

SEQ ID NO: 134097 - RNA, 1701 nt, Artificial Sequence; identical to SEQ ID NO: 134096
  derived and/or modified sequence opt3 from hemagglutinin__InfluenzaA__AHZ35834

SEQ ID NO: 134098 - RNA, 1701 nt, Artificial Sequence; identical to SEQ ID NO: 134096
  derived and/or modified sequence opt3 from hemagglutinin__InfluenzaA__AHZ35845

SEQ ID NO: 134099 - RNA, 1701 nt, Artificial Sequence; identical to SEQ ID NO: 134096
  derived and/or modified sequence opt3 from hemagglutinin__InfluenzaA__AHZ35856

SEQ ID NO: 134100 - RNA, 1701 nt, Artificial Sequence
  derived and/or modified sequence opt3 from hemagglutinin__InfluenzaA__AHZ35867
augaagaccaacaucgcccugagcuacauucucugccuuguguccgcucagaaacugcccggcaaugacaacucuacagcaacuuuguguuuagggcaccaugccgucccuaauggaacgauaguuaagaccaucacaaacgaucaaauugaggugacuaaugcgaccgaacugguacagucaaguagcacaggugagaucugcaacuccccacaccagauucuagacggcgaaaauuguacccucaucgaugcucugcuuggggacccgcagugcgauggauuccaaaacaaaaagugggaccuguuuguggagagaucuaaagcccauucgaauuguuaucccuacgaugucccugacuaugcaucauugaggagccucguggccaguuccggcacucuggaguucaacaaugaaucuuuuaacuggacagguguuacccagaaugggacgagcuccgcuugcauacggcgcucaaacaauaguuucuuuagccgacugaacuggcucacucacuuaaacuucaaguacccagcacugaaugugaccaugcccaacaaugagcaguuugauaagcuguauaucuggggaguccaucacccuggcacagacaaagaucagauuuucuuguacgcccaagcugccggccguaucacugugucuaccaagagaucccagcaggcgguaauuccaaacaucgggucaaggccccggguucgcaauauaccuagcagagugaguauuuauuggacaaucgucaaaccaggagacauucugcuaaucaacucuaccgguaaucucaucgcaccgaggggcuacuuuaagauucgguccgggaaaagcucgauaaugcgcucugaugcccccaucggaaaguguaacuccgcuugcauuacgccuaauggcucaaucccaaacgacaagcccuuccagaaugugaaccgaauaacuuacggugccuguccuagauaugugaaacaaaauacacugaaacuugcaaccgggaugaggaacgucccagaaaaacagacucggggaauuuuuggcgcuaucgccggcuucaucgagaaugggugggaaggaaugguugacgguugguacggcuuucgucaccagaacagugaggggcgcggacaagcggccgaucuuaagagcacacaggcagcuauugaccagaucaacggcaaauugaauagacucauugguaagaccaacgagaaauuccaucagauagaaaaggaguucuccgaaguggaggggaggauccaagaucuggaaaaguauguagaggacacgaaaauugauuuauggucuuacaaugccgagcugcucgugguccuugaaaaccagcacaccaucgaccugacagauagcgagaugaauaaguuguuugaaaagacuaagaaacagcuacgggagaacgcugaagacaugggcaauggaugcuucaagaucuaucauaagugugauaacgccugcauuggcucaauacgaaaugggaccuacgaccacgauguguaucgcgacgaggcacugaacaauagauuucagaucaaaggaguugagcucaagagugguuacaaagacuggauucuguggaucuccuucgccauuagcugcuuucuucuguguguggcuuugcucggcuucaucaugugggcgugccaaaaggggaacauaagguguaauaucugcauuuga

SEQ ID NO: 134101 - RNA, 1701 nt, Artificial Sequence
  derived and/or modified sequence opt3 from hemagglutinin__InfluenzaA__AHZ35879
augaagaccaacaucgcccugagcuacauucucugccuuguguccgcucagaaacugcccggcaaugacaacucuacagcaacuuuguguuuagggcaccaugccgucccuaauggaacgauaguuaagaccaucacaaacgaucaaauugaggugacuaaugcgaccgaacugguacagucaaguagcacaggugagaucugcaacuccccacaccagauucuagacggcgaaaauuguacccucaucgaugcucugcuuggggacccgcagugcgauggauuccaaaacaaaaagugggaccuguuuguggagagaucuaaagcccauucgaauuguuaucccuacgaugucccugacuaugcaucauugaggagccucguggccaguuccggcacucuggaguucaacaaugaaucuuuuaacuggacagguguuacccagaaugggacgagcuccgcuugcauacggcgcucaaacaauaguuucuuuagccgacugaacuggcucacucacuuaaacuucaaguacccagcacugaaugugaccaugcccaacaaugagcaguuugauaagcuguauaucuggggaguccaucacccuggcacagacaaagaucagauuuucuuguacgcccaagcugccggccguaucacugugucuaccaagagaucccagcaggcgguaauuccaaacaucgggucaaggccccggguucgcaauauaccuagcagagugaguauuuauuggacaaucgucaaaccaggagacauucugcuaaucaacucuaccgguaaucucaucgcaccgaggggcuacuuuaagauucgguccgggaaaagcucgauaaugcgcucugaugcccccaucggaaaguguaacuccgcuugcauuacgccuaauggcucaaucccaaacgacaagcccuuccagaaugugaaccgaauaacuuacggugccuguccuagauaugugaaacaaaauacacugaaacuugcaaccgggaugaggaacgucccagaaaaacagacucggggaauuuuuggcgcuaucgccggcuucaucgagaaugggugggaaggaaugguugacgguugguacggcuuucgucaccagaacagugaggggcgcggacaagcggccgaucuuaagagcacacaggcagcuauugaccagaucaacggcaaauugaauagacucauugguaagaccaacgagaaauuccaucagauagaaaaggaguucuccgaaguggaggggaggauccaagaucuggaaaaguauguagaggacacgaaaauugauuuauggucuuacaaugccgagcugcucguggcucuugaaaaccagcacaccaucgaccugacagauagcgagaugaauaaguuguuugaaaagacuaagaaacagcuacgggagaacgccgaagacaugggcaauggaugcuucaagaucuaucauaagugugauaacgcaugcauuggcucaauacgaaaugggaccuacgaccacgaugucuaucgcgacgaggcccugaacaauagauuucagaucaaaggaguggagcucaagagugguuacaaagacuggauucuguggaucuccuucgcuauuagcugcuuucuucuguguguugcguugcucggcuucaucaugugggcaugccaaaaggggaacauaagguguaauaucugcauuuga

SEQ ID NO: 134102 - RNA, 1701 nt, Artificial Sequence; identical to SEQ ID NO: 134096
  derived and/or modified sequence opt3 from hemagglutinin__InfluenzaA__AHZ35891

SEQ ID NO: 134103 - RNA, 1701 nt, Artificial Sequence; identical to SEQ ID NO: 134096
  derived and/or modified sequence opt3 from hemagglutinin__InfluenzaA__AHZ35902

SEQ ID NO: 134104 - RNA, 1710 nt, Artificial Sequence
  derived and/or modified sequence opt3 from hemagglutinin__InfluenzaA__AHZ35913
augaaggccauccuggugguccuccuuuacaccuucgcuauugcaaacgccgacacacugugcauaggcuaucacgcgaauaacagcacugauacgguugacaccguguuggagaaaaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauuaauuacgaggagcucagggagcagcugagcaguguguccucuuucgaacgguuugagauguucccgaagacuagcuccuggcccaaccacgacucaaauaagggugucacagccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaaccacggcugaccaacagagcuuguaccagaaugccgaugcguacguguucgucgggacuucucgcuauucuaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcaggguccggaaucauaauuagcgacaccccagugcaugauugcaacacaaccugucaaacgccgaaaggcgcuaucaauacuucgcucacaucucugcccuuccagaacauucacccuaucaccaucgguaagugcccaaaguauguaaaauccacuaaacuucgccuggccacaggguugagaaaugugcccucaauucagaguaggggacucuuuggcgcgauagccggcuucaucgaagggggauggaccgguauggucgacggcugguacggguaucaucaccagaacgaacaaggaagcggcuacgcagcugaccugaaguccacgcagaaugccauugauaagaucaccaacaaagugaauaguguuauagagaagaugaacacacaguuuacugcuguggguaaggaguucaaucacuuagaaaaacggauugagaaccugaauaagaaagucgacgauggguuccucgacaucuggaccuacaacgccgaacuucugguguugcuagagaaugaacgcacacuggauuaucaugacagcaacguaaagaaccucuacgagcgaguuagaaaucagcugaaaaacaaugcaaaggagaucggcaacggauguuuugaguucuaucacaagugcgauaauacuuguauggaaucagugaaaaacggcaccuacgacuauccuaaguacagugaagaggccaaacuuaauagggaagagauugauggggucaagcuggaguccacacggaucuaucaaauuuuggcuauauacagcaccguggcgucuucacucguccuggugguuaguuuaggagcaaucagcuuuuggaugugcuccaacgguucucugcagugccguauuuguaucuga

SEQ ID NO: 134105 - RNA, 1701 nt, Artificial Sequence
  derived and/or modified sequence opt3 from hemagglutinin__InfluenzaA__AHZ35924
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaagcaggggccaaaaguuuuuauaagaaccugaucuggcucgugaaaaagggaaauagcuacccaaaauuaucuaaguccuauauaaacgauaagggcaaagaaguacugguucuuuggggcauccaucaccccucaacgagcgcugaccagcagaguuuguaccagaaugccgaugcguacguguucgucgggacuucuaaguauuccaaaaaguuuaaaccugagauugcagugcgcccaaaggugcgagaccaagagggacguaugaacuacuauuggacccuggucgaacccggugauaaaaucacauucgaggccacuggcaaccuacucguuccuagauacgcuuuugccauggaaaggaaugcagggagcggaauuaucauaucggacaccccagugcacgauugcaacacaaccugucagacgccgaagggcgcuauuaauacuucucugcccuuccagaacauccauccuauuacaaucgguaagugcccaaaauauguaaaguccaccaaacuucggcuggccacuggguugcgcaaugugcccucaacacagaguagaggacucuuuggcgcgaucgccggcuucauugaagggggauggaccgguauggucgacggcugguacggguaucaccaucaaaacgcacagggaagcggcuacgcugccgaccugaaguccacgcagaaugcuauagauaaaaucaccaacaagguaaauucuguuauugaaaagaugaacacacaguuuacugccguggguaaagaguucaaucacuuagagaagaggaucgaaaaccugaauaaaaaggucgacgauggguuccucgacauauggaccuacaacgcagagcuucugguguugcuagaaaaugagcggacacuggauuaucacgacagcaacgugaaaaaccucuacgaaaagguucgcucacaacugaagaauaacgccaaagagauuggcaauggauguuuugaguucuaucauaagugcgauaacacuuguauggaaagugugaaaaauggcaccuacgacuauccuaaguacuccgaggaagcuaaacuuaaccgagaggaaaucgauggggucaagcuggagagcacaagaaucuaucagauuuuggcgaucuacucuaccguggcaucaagucucguccuggugguuagcuuaggagccauuuccuuuuggaugugcucuaaugguucgcugcagugcaggauauguaucuga

SEQ ID NO: 134106 - RNA, 1701 nt, Artificial Sequence
  derived and/or modified sequence opt3 from hemagglutinin__InfluenzaA__AHZ35935
augaaggccauccuggugguccuccuuuacaccuucgcuauugcaaacgccgacacacugugcauaggcuaucacgcgaauaacagcacugauacgguugacaccguguuggagaaaaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauuaauuacgaggagcucagggagcagcugagcaguguguccucuuucgaacgguuugagauguucccgaagacuagcuccuggcccaaccacgacucaaauaagggugucacagccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaaccacggcugaccaacagagcuuguaccagaaugccgaugcguacguguucgucgggaccagucgcuauucuaagaaauuuaagccugagauugcaauccgaccaaaagugcgugaccaggagggaagaaugaacuacuauuggacucugguggaacccggugauaagauuacauucgaggccacuggcaaccuagucguuccuagguacgcuuuugccauggaacggaaugcaggguccggaaucauaauuagcgacaccccagugcaugauugcaacacaaccugucaaacgccgaaaggcgcuaucaauacuucgcuccccuuccagaacauucacccuaucacaaucgguaagugcccaaaguauguaaaaucuaccaagcugcgccuugccacugggcugagaaauauucccuccauacagucaaggggauuguuuggcgcgaucgccggcuucauugaagggggauggacagguaugguggacggcugguacggguaucaucaccagaacgaacaaggaaguggcuacgcagcugaccucaaaagcacccagaaugccaucgauaagauaacgaacaaagucaauuccgugauugagaagaugaacacccaguuuacagcuguugguaaggaguucaaucaccuggaaaaacggaucgagaacuuaaauaagaaaguggacgauggguuccuggacaucuggacuuacaacgccgaacuccuuguccuguuggagaaugaacgcacccuagauuaucaugacucuaacgugaagaaccuguacgagaaaguacgaaaucagcucaagaacaaugcaaaggagauuggcaacggauguuuugaguucuaucacaaaugcgauaauacauguauggaaagcguuaagaacggcacuuacgacuauccuaaauacucagaagaggccaagcugaauagagaagagaucgauggggugaaacuugagaguaccaggauuuaucaaauacuggcuaucuacuccacagucgcgagcucuuuggugcucgucgugucacugggagcaauuaguuuuuggaugugcagcaacgguuccuuacagugccggaucuguaucuga

SEQ ID NO: 134107 - RNA, 1701 nt, Artificial Sequence; identical to SEQ ID NO: 134101
  derived and/or modified sequence opt3 from hemagglutinin__InfluenzaA__AHZ35946

SEQ ID NO: 134108 - RNA, 1701 nt, Artificial Sequence; identical to SEQ ID NO: 134096
  derived and/or modified sequence opt3 from hemagglutinin__InfluenzaA__AHZ35958

SEQ ID NO: 134109 - RNA, 1701 nt, Artificial Sequence; identical to SEQ ID NO: 134096
  derived and/or modified sequence opt3 from hemagglutinin__InfluenzaA__AHZ35980

SEQ ID NO: 134110 - RNA, 1701 nt, Artificial Sequence; identical to SEQ ID NO: 134096
  derived and/or modified sequence opt3 from hemagglutinin__InfluenzaA__AHZ35991

SEQ ID NO: 134111 - RNA, 1701 nt, Artificial Sequence; identical to SEQ ID NO: 134096
  derived and/or modified sequence opt3 from hemagglutinin__InfluenzaA__AHZ36002

SEQ ID NO: 134112 - RNA, 1701 nt, Artificial Sequence
  derived and/or modified sequence opt3 from hemagglutinin__InfluenzaA__AHZ36013
augaaggccauccuggugguccuccuuuacaccuucgcuauugcaaacgccgacacacugugcauaggcuaucacgcgaauaacagcacugauacgguugacaccguguuggagaaaaauguaacagugacucauuccgucaacuuacuggaagauaagcacaauagaaaacuauguaagcucagggguguggcuccccugcaucuuggaaaaugcaacaucgccgguuggauucugggcaauccugagugugaaucuuugucaaccgcaaguagcugguccuacaucguugagacaucuucgucagacaacgggaccugcuauccaggagauuuuauuaauuacgaagaacuccgggagcagcugagcaguguguccucuuucgaacgcuuugagauguucccgaagacuagcuccuggcccaaccacgacucaaauaagggcgucacagccgcuuguccucaugcaggggccaaaaguuuuuauaagaaccugaucuggcucgugaaaaaggggaauagcuacccaaaauuaucuaaguccuauauaaacgauaagggaaaagaaguacugguucuuuggggcauccaccaccccucaaccacggcugaccaacagagcuuguaccagaaugccgaugcguacguguucgucggcacuucccgauauucuaagaaauuuaagccugagauugcaauccguccaaaagugagagaccaggaggggaggaugaacuacuauuggacccugguggaacccggagauaagauuacauucgaggccacugguaaccuagucguuccucgguacgcuuuugccauggaacgcaaugcaggcuccgggaucauaauuagcgacaccccagugcaugauugcaacacaaccugucaaacgccgaaaggagcuaucaauacuucgcuccccuuccagaacauucacccuaucacaaucggcaagugcccaaaguauguaaaaucuaccaagcugagacuugccacuggucugaggaaugugcccuccauucagucacggggguuguuuggagcgauagccggcuucaucgagggcggguggacaggaauggucgacgguugguacggcuaucaucaccagaacgaacaagggaguggauacgcagcugaccucaaaagcacccagaaugccauugauaagaucacgaacaaagugaauaguguuauagagaagaugaacacccaguuuacagcugugggcaaggaguucaaucaccuggaaaaacgcauugagaacuuaaauaagaaagucgacgaugguuuccuggacaucuggacuuacaacgccgaacuccuugugcuguuggagaaugaacgaacccuagauuaucaugacucuaacguaaagaaccuguacgagaaaguuagaaaucagcucaagaacaaugcaaaggagaucgggaacggcuguuuugaguucuaucacaaaugcgauaauacauguauggagagcgugaagaacggaacuuacgacuauccuaaauacucagaagaggccaagcugaauagggaagagauugauggcgucaaacuugagaguacccggaucuaucaaauucuggcuauauacuccacaguggcgagcucuuugguccucgugguuucacugggggcaaucaguuuuuggaugugcagcaacggauccuuacagugccguauuuguaucuga

SEQ ID NO: 134113 - RNA, 1701 nt, Artificial Sequence
  derived and/or modified sequence opt3 from hemagglutinin__InfluenzaA__AHZ36024
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcgugaccaggagggaagaaugaacuacuauuggacacugguggaacccggugauaagauuacuuucgaggccaccggcaaccuagucguuccuagguacgcuuuugccauggaacggaaugcaggguccggaaucauaauuagcgacacaccagugcaugauugcaacaccacgugucaaacuccgaaaggcgcuaucaauacaucgcuccccuuccagaacauucacccuaucaccaucgguaagugcccaaaguauguaaaaucuacuaagcugcgccuugccacagggcugagaaaugugcccuccauucagucaaggggauuguuuggcgcgauagccggcuucaucgaagggggauggaccgguauggucgacggcugguacggguaucaucaccagaacgaacaaggaaguggcuacgcagcugaccucaaaagcacgcagaaugccauugauaagaucaccaacaaaguuaauuccgugauagagaagaugaacacacaguuuacugcuguggguaaggaguucaaucaccuggaaaaacggauugagaacuuaaauaagaaagucgacgauggguuccuggacaucuggaccuacaacgccgaacuccuugugcuguuggagaaugaacgcacacuagauuaucaugacucuaacguaaagaaccuguacgagaaaguucgaaaucagcucaagaacaaugcaaaggagaucggcaacggauguuuugaguucuaucacaaaugcgauaauacuuguauggaaagcgugaagaacggcaccuacgacuauccuaaauacucagaagaggccaagcugaauagagaagagauugauggggucaaacuugagaguacaaggaccuaucaaauccuggcuauuuacuccacuguggcgagcucuuugguccucgugguuucacugggagcaauaaguuuuuggaugugcagcaacgguuccuuacagugccggaucuguauuuga

SEQ ID NO: 134114 - RNA, 1701 nt, Artificial Sequence
  derived and/or modified sequence opt3 from hemagglutinin__InfluenzaA__AHZ36035
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugauucagucuucaaguacaggugagaucugcaauagcccacaccagauacuagacggcgaaaacuguacccucaucgaugcucugcuuggggacccgcagugcgauggauuucaaaauaaaaagugggaccuguucguagagagauccaaagcccauucuaacuguuaucccuacgaugugccugacuaugcaucguugaggucacucgucgccagcaguggcacucuggaauuuaauaacgaguccuucaauuggacaggugugacccagaacgggacgucuagcgcuugcauucggcgcuccaauaacucauuuuucagucgacugaauuggcucacucacuuaaacuuuaaguacccagcacugaacguuaccaugcccaauaacgagcaguucgauaaguuguauaucuggggagugcaucacccuggcacagacaaagaucagauuuuucuuuacgcccaagcugccggccguaucacugucagcaccaagagaucucagcaggcggugauaccaaauauuggguccaggccccggguacgcaacaucccuucaagaguuagcauuuauuggacaaucgugaaaccaggagacauccugcuaauuaauaguaccgguaaccucauagcaccgaggggcuacuucaagauccggucugggaaauccagcauuaugcgcucggaugcccccaucggaaaguguaauucugcuugcauaacgccuaacggcuccauuccaaaugacaagcccuuucagaacgucaaucgaaucacuuacggugccuguccuagauaugugaaacaaaacacacugaaacuugcaaccgggaugaggaaugugccagaaaaacagacucggggaaucuucggcgcuauugccggcuuuaucgagaacgggugggaaggaauggucgacgguugguacggcuuccgucaccaaaauucagaggggcgcggacaggcggccgaucugaagaguacacaggcagcuauugaccagauaaacggcaaauugaacagacucaucgguaagaccaaugagaaauuccaucagauugaaaaggaguuuagcgaaguugaggggaggauccaagaucuggaaaaguauguggaggacacgaaaaucgauuuaugguccuacaacgccgagcugcucguagcucuugaaaaucagcacaccauugaccugacagauucugagaugaacaaguuguucgaaaagacuaagaaacagcuacgggagaaugccgaagacaugggcaacggaugcuuuaagauauaucauaagugugauaaugcaugcaucggcagcauucgaaacgggaccuacgaccacgauguguaucgcgacgaggcccugaauaacagauuccagaucaaaggagucgagcucaagucagguuacaaagacuggauucuguggaucaguuuugcuauauccugcuuccuucuguguguggcguugcucggcuuuaucaugugggcaugccaaaaggggaauauuagguguaacaucugcauuuga

SEQ ID NO: 134115 - RNA, 1701 nt, Artificial Sequence; identical to SEQ ID NO: 128871
  derived and/or modified sequence opt3 from hemagglutinin__InfluenzaA__AHZ36047

SEQ ID NO: 134116 - RNA, 1701 nt, Artificial Sequence; identical to SEQ ID NO: 134096
  derived and/or modified sequence opt3 from hemagglutinin__InfluenzaA__AHZ36059

SEQ ID NO: 134117 - RNA, 1701 nt, Artificial Sequence; identical to SEQ ID NO: 134113
  derived and/or modified sequence opt3 from hemagglutinin__InfluenzaA__AHZ36070

SEQ ID NO: 134118 - RNA, 1701 nt, Artificial Sequence; identical to SEQ ID NO: 134112
  derived and/or modified sequence opt3 from hemagglutinin__InfluenzaA__AHZ36081

SEQ ID NO: 134119 - RNA, 1701 nt, Artificial Sequence; identical to SEQ ID NO: 134113
  derived and/or modified sequence opt3 from hemagglutinin__InfluenzaA__AHZ36092

SEQ ID NO: 134120 - RNA, 1701 nt, Artificial Sequence; identical to SEQ ID NO: 134096
  derived and/or modified sequence opt3 from hemagglutinin__InfluenzaA__AHZ36103

SEQ ID NO: 134121 - RNA, 1701 nt, Artificial Sequence; identical to SEQ ID NO: 134113
  derived and/or modified sequence opt3 from hemagglutinin__InfluenzaA__AHZ36114

SEQ ID NO: 134122 - RNA, 1701 nt, Artificial Sequence; identical to SEQ ID NO: 134096
  derived and/or modified sequence opt3 from hemagglutinin__InfluenzaA__AHZ36125

SEQ ID NO: 134123 - RNA, 1701 nt, Artificial Sequence; identical to SEQ ID NO: 134096
  derived and/or modified sequence opt3 from hemagglutinin__InfluenzaA__AHZ36136

SEQ ID NO: 134124 - RNA, 1701 nt, Artificial Sequence; identical to SEQ ID NO: 128871
  derived and/or modified sequence opt3 from hemagglutinin__InfluenzaA__AHZ36147

SEQ ID NO: 134125 - RNA, 1701 nt, Artificial Sequence
  derived and/or modified sequence opt3 from hemagglutinin__InfluenzaA__AHZ36158
augaaggccauccuggugguccuccuuuacaccuucgcuauugcaaacgccgacacacugugcauaggcuaucacgcgaauaacagcacugauacgguugacaccguguuggagaaaaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauuaauuacgaggagcucagggagcagcugagcaguguguccucuuucgaacgguuugagauguucccgaagacuagcuccuggcccaaccacgacucaaauaagggugucacagccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaaccacggcugaccaacagagcuuguaccagaaugccgaugcguacguguucgucgggacuucccgcuauucuaagaaauuuaagccugagauugcaacccgaccaaaagugcgugaccaggagggaagaaugaacuacuauuggacacugguggaacccggugauaagaucacuuucgaggccaccggcaaccuagucguuccuagguacgcuuuugccauggaacggaaugcaggguccggaauuaucauaagcgacacaccagugcaugauugcaacaccacgugucaaacuccgaaaggcgcuauuaauacaucgcuccccuuccagaacauccacccuauuaccaucgguaagugcccaaaguauguaaaaucuacuaagcugcgccuugccacagggcugagaaaugugcccuccauccagucaaggggauuguuuggcgcgauugccggcuucauagaagggggauggaccgguauggucgacggcugguacggguaucaucaccagaacgaacaaggaaguggcuacgcagcugaccucaaaagcacgcagaaugccaucgauaagauuaccaacaaagugaauaguguuaucgagaagaugaacacacaguuuacugcuguggguaaggaguucaaucaccuggaaaaacggauagagaacuuaaauaagaaagucgacgauggguuccuggacauuuggaccuacaacgccgaacuccuugugcuguuggagaaugaacgcacacuagauuaucaugacucuaacguaaagaaccuguacgagaaaguucgaaaucagcucaagaacaaugcaaaggagaucggcaacggauguuuugaguucuaucacaaaugcgauaauacuuguauggaaagcgugaagaacggcaccuacgacuauccuaaauacucagaagaggccaagcugaauagagaagagaucgauggggucaaacuugagaguacaaggauuuaucaaauccuggcuauuuacuccaccguggcgagcucuuugguccucgugguuucacugggagcaauaaguuuuuggaugugcagcaacgguuccuuacagugccggaucuguauuuga

SEQ ID NO: 134126 - RNA, 1701 nt, Artificial Sequence; identical to SEQ ID NO: 134096
  derived and/or modified sequence opt3 from hemagglutinin__InfluenzaA__AHZ36169

SEQ ID NO: 134127 - RNA, 1701 nt, Artificial Sequence
  derived and/or modified sequence opt3 from hemagglutinin__InfluenzaA__AHZ36180
augaaggccauccuggugguccuccuuuacaccuucgcuauugcaaacgccgacacacugugcauaggcuaucacgcgaauaacagcacugauacgguugacaccguguuggagaaaaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauuaauuacgaggagcucagggagcagcugagcaguguguccucuuucgaacgguuugagauguucccgaagacuagcuccuggcccaaccacgacucaaauaagggugucacagccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaaccacggcugaccaacagagcuuguaccagaaugccgaugcguacguguucgucgggaccagucgcuauucuaagaaauuuaagccugagauugcaauccgaccaaaagugcgugaccaggagggaagaaugaacuacuauuggacucugguggaacccggugauaagauuacauucgaggccacuggcaaccuagucguuccuagguacgcuuuugccauggaacggaaugcaggguccggaaucauaauuagcgacaccccaauccaugauugcaacacaaccugucaaacgccgaaaggcgcuauuaauacuucgcuccccuuccagaacauccacccuaucacaauugguaagugcccaaaguaugugaaaucuaccaagcugcgccuugccacugggcugagaaauguacccuccauacagucaaggggauuguuuggcgcgaucgccggcuucauugaagggggauggacagguaugguggacggcugguacggguaucaucaccagaacgaacaaggaaguggcuacgcagcugaccucaaaagcacccagaaugccaucgauaagauaacgaacaaagucaauuccgugauugagaagaugaacacccaguuuacagcuguugguaaggaguucaaucaccuggaaaaacggaucgagaacuuaaauaagaaaguggacgauggguuccuggacaucuggacuuacaacgccgaacuccuuguccuguuggagaaugaacgcacccuagauuaucaugacucuaacgugaagaaccuguacgagaaaguacgaaaucagcucaagaacaaugcaaaggagauuggcaacggauguuuugaguucuaucacaaaugcgauaauacauguauggaaagcguuaagaacggcacuuacgacuauccuaaauacucagaagaggccaagcugaauagagaagagaucgauggggugaaacuugagaguaccaggauuuaucaaauacuggcuaucuacuccacagucgcgagcucuuuggugcucgucgugucacugggagcaauuaguuuuuggaugugcagcaacgguuccuuacagugccggaucuguaucuga

SEQ ID NO: 134128 - RNA, 1701 nt, Artificial Sequence; identical to SEQ ID NO: 134101
  derived and/or modified sequence opt3 from hemagglutinin__InfluenzaA__AHZ36191

SEQ ID NO: 134129 - RNA, 1701 nt, Artificial Sequence; identical to SEQ ID NO: 128871
  derived and/or modified sequence opt3 from hemagglutinin__InfluenzaA__AHZ36203

SEQ ID NO: 134130 - RNA, 1701 nt, Artificial Sequence; identical to SEQ ID NO: 134096
  derived and/or modified sequence opt3 from hemagglutinin__InfluenzaA__AHZ36215

SEQ ID NO: 134131 - RNA, 1701 nt, Artificial Sequence; identical to SEQ ID NO: 128871
  derived and/or modified sequence opt3 from hemagglutinin__InfluenzaA__AHZ36226

SEQ ID NO: 134132 - RNA, 1701 nt, Artificial Sequence; identical to SEQ ID NO: 134096
  derived and/or modified sequence opt3 from hemagglutinin__InfluenzaA__AHZ36238

SEQ ID NO: 134133 - RNA, 1701 nt, Artificial Sequence; identical to SEQ ID NO: 134096
  derived and/or modified sequence opt3 from hemagglutinin__InfluenzaA__AHZ36249

SEQ ID NO: 134134 - RNA, 1701 nt, Artificial Sequence
  derived and/or modified sequence opt3 from hemagglutinin__InfluenzaA__AHZ36260
augaaggccauccuggugguccuccuuuacaccuucgcuauugcaaacgccgacacacugugcauaggcuaucacgcgaauaacagcacugauacgguugacaccguguuggagaaaaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacauuuucuucggacaacggaaccugcuauccaggcgauuucauuaauuacgaggagcucagggagcagcugucaagcgugaguuccuuugaacgguucgagauguuuccgaagacuucuagcuggcccaaccacgacuccaauaagggugucacagccgcuuguccucaugcaggggccaaaucauucuauaagaaccugaucuggcucgugaaaaagggaaauaguuacccaaaauuaagcaagucuuauauaaacgauaagggcaaagaaguacugguucuuuggggcauccaccaccccuccaccacggcugaccaacagucauuguaccagaaugccgaugcguacguguuugucgggacuagccgcuauaguaagaaauucaagccugagauugcaauccgaccaaaagugcgugaccaggagggaagaaugaacuacuauuggacccugguggaacccggugauaagauuacauuugaggccacuggcaaccuagucguuccuagguacgcuuucgccauggaacggaaugcagggucuggaaucauaauuuccgacaccccagugcaugauugcaacacaaccugucaaacgccgaaaggcgcuaucaauacuagccuccccuuucagaacauucacccuaucacaaucgguaagugcccaaaguauguaaaaucgaccaagcugcgccuugccacugggcugagaaaugugcccucuauucaguccaggggauuguucggcgcgauagccggcuuuaucgaagggggauggacagguauggucgacggcugguacggguaucaucaccagaacgaacaaggaucaggcuacgcagcugaccucaaaaguacccagaaugccauugauaagaucacgaacaaagugaauagcguuauagagaagaugaacacccaguucacagcuguggguaaggaguucaaucaccuggaaaaacggauugagaacuuaaauaagaaagucgacgauggguuucuggacaucuggacuuacaacgccgaacuccuugugcuguuggagaaugaacgcacccuagauuaucaugacuccaacguaaagaaccuguacgagaaaguucgaaaucagcucaagaacaaugcaaaggagaucggcaacggauguuucgaauuuuaucacaaaugcgauaauacauguauggagucugugaagaacggcacuuacgacuauccuaaauacagcgaagaggccaagcugaauagagaagagauugauggggucaaacuugagucaaccaggaucuaucaaauucuggcuauauacaguacaguggcguccagcuugguccucgugguuucucugggagcaaucucauucuggaugugcaguaacgguagcuuacagugccggauuuguaucuga

SEQ ID NO: 134135 - RNA, 1701 nt, Artificial Sequence; identical to SEQ ID NO: 134081
  derived and/or modified sequence opt3 from hemagglutinin__InfluenzaA__AHZ36271

SEQ ID NO: 134136 - RNA, 1701 nt, Artificial Sequence; identical to SEQ ID NO: 134096
  derived and/or modified sequence opt3 from hemagglutinin__InfluenzaA__AHZ36283

SEQ ID NO: 134137 - RNA, 1701 nt, Artificial Sequence; identical to SEQ ID NO: 134081
  derived and/or modified sequence opt3 from hemagglutinin__InfluenzaA__AHZ36294

SEQ ID NO: 134138 - RNA, 1701 nt, Artificial Sequence
  derived and/or modified sequence opt3 from hemagglutinin__InfluenzaA__AHZ36306
augaaggccauccuggugguccuccuuuacaccuucgcuauugcaaacgccgacacacugugcauaggcuaucacgcgaauaacagcacugauacgguugacaccguguuggagaaaaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauuaauuacgaggagcucagggagcagcugagcaguguguccucuuucgaacgguuugagauguucccgaagacuagcuccuggcccaaccacgacucaaauaagggugucacagccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaaccacggcugaccaacagagcuuguaccagaaugccgaugcguacguguucgucgggacuucccgcuauucuaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcaggguccggaaucauaauuagcgacaccccagugcaugauugcaacacaaccugucaaacgccgaaaggcgcuaucaauacuucgcuccccuuccagaacauucacccuaucacaaucgguaagugcccaaaguauguaaaaucuaagaaacugcgccuugccaccgggcugagaaaugugcccuccauucagucaaggggauuguuuggcgcgauagccggcuucaucgaagggggauggacugguauggucgacggcugguacggguaucaucaccagaacgaacaaggaaguggcuacgcagcugaccucaagagcacacagaaugccauugauaaaaucaccaacaaggugaauaguguuauagagaagaugaacacgcaguuuaccgcuguggguaaagaguucaaucaccuggaaaagcggauugagaacuuaaauaaaaaggucgacgauggguuccuggacaucuggacauacaacgccgaacuccuugugcuguuggagaaugaacgcacucuagauuaucaugacucuaacguaaagaaccuguacgagaagguucgaaaucagcucaagaacaaugcaaaagagaucggcaacggauguuuugaguucuaucacaagugcgauaauaccuguauggaaagcgugaaaaacggcacauacgacuauccuaaguacucagaagaggccaaacugaauagagaagagauugauggggucaaacuugagaguacuaggaucuaucaaauucuggcuauauacuccaccguggcgagcucuuugguccucgugguuucacugggagcaaucaguuuuuggaugugcagcaacgguuccuuacagugccggauuuguaucuga

SEQ ID NO: 134139 - RNA, 1701 nt, Artificial Sequence; identical to SEQ ID NO: 134096
  derived and/or modified sequence opt3 from hemagglutinin__InfluenzaA__AHZ36317

SEQ ID NO: 134140 - RNA, 1701 nt, Artificial Sequence; identical to SEQ ID NO: 134096
  derived and/or modified sequence opt3 from hemagglutinin__InfluenzaA__AHZ36328

SEQ ID NO: 134141 - RNA, 1701 nt, Artificial Sequence
  derived and/or modified sequence opt3 from hemagglutinin__InfluenzaA__AHZ36339
augaaggccauccuggugguccuccuuuacaccuucgcuauugcaaacgccgacacacugugcauaggcuaucacgcgaauaacagcacugauacgguugacaccguguuggagaagaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauuaauuacgaggagcucagggagcagcugagcaguguguccucuuucgaacgguuugagauguucccgaagacuagcuccuggcccaaccacgacucaaauaagggugucacagccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaaccacggcugaccaacagagcuuguaccagaaugccgaugcguacguguucgucgggaccagucgcuauucuaagaaauuuaagccugagauugcaauccgaccaaaagugcgugaccaggagggaagaaugaacuacuauuggacucugguggaacccggugauaagauuacauucgaggccacuggcaaccuagucguuccuagguacgcuuuugccauggaacggaaugcaggguccggaaucauaauuagcgacaccccagugcaugauugcaacacaaccugucaaacgccgaaaggcgcuguaaauacuucgcuccccuuccagaacauccacccuauuacaaucgguaagugcccaaaguaugugaaaucuaccaagcugcgccuugccacugggcugagaaauguccccuccauccagucaaggggauuguuuggcgcgauugccggcuucauagaagggggauggacagguaugguggacggcugguacggguaucaucaccagaacgaacaaggaaguggcuacgcagcugaccucaaaagcacccagaaugccaucgauaagauuacgaacaaaguuaauuccgugaucgagaagaugaacacccaguuuacagcugucgguaaggaguucaaucaccuggaacggcgcauagagaacuuaaauaaaaagguggacgauggguuccuggacauuuggacuuacaacgccgaacuccuuguacuguuggagaaugaacgaacccuagauuaucaugacucuaacguuaaaaaccuguacgagaaggugagaaaucagcucaaaaacaaugcaaaggagaucggcaacggauguuuugaguucuaucacaagugcgauaauacauguauggaaagcgucaaaaacggcacuuacgacuauccuaaguacucagaagaggccaaacugaauagggaagagaucgauggggugaaacuugagaguacccggauuuaucaaauccuggcuauuuacuccacagucgcgagcucuuuggugcucguugugucacugggagcaauaaguuuuuggaugugcagcaacgguuccuuacagugccguaucuguauuuga

SEQ ID NO: 134142 - RNA, 1701 nt, Artificial Sequence
  derived and/or modified sequence opt3 from hemagglutinin__InfluenzaA__AHZ36362
augaaggccauccuggugguccuccuuuacaccuucgcuauugcaaacgccgacacacugugcauaggcuaucacgcgaauaacagcacugauacgguugacaccguguuggagaaaaauguaacagugacucauuccaucaacuuacuggaagauaagcacaaugggaaacuauguaagcucagaggagucgcuccccugcaucuugguaaaugcaacauugccggcuggauccuggggaauccugagugugaaucuuugucaaccgcaaguagcugguccuacauuguggagacaucuucgucagacaacggaaccugcuauccaggcgauuuuaucaauuacgaggagcucagggagcagcugagcaguguuuccucuuucgaacgguuugagauguucccgaagacuagcuccuggcccaaccacgacucaaauaagggugugacagccgcuuguccucaugcaggggccaaaaguuuuuauaagaaccugauauggcucgucaaaaagggaaauagcuacccaaaauuaucuaaguccuauaucaacgauaagggcaaagaagugcugguacuuuggggcauucaccaccccucaaccacggcugaccaacagagcuuguaccagaaugccgaugcguacguuuucguggggacuucccgcuauucuaagaaauuuaagccugagaucgcaauucgaccaaaaguccgugaccaggagggaagaaugaacuacuauuggacccugguggaacccggugauaagaucacauucgaggccacuggcaaccuaguggucccuagguacgcuuuugccauggaacggaaugcaggguccggaauaauuaucagcgacaccccaguucaugauugcaacacaaccugucaaacgccgaaaggcgcugugaauacuucgcuccccuuccagaacauucacccuaucacaaucgguaagugcccaaaguauguaaaaucuaccaagcugcgccuugccacugggcugagaaaugugcccuccauucagucaaggggauuguuuggcgcgauagccggcuucaucgaagggggauggacagguauggucgacggcugguacggguaucaucaccagaacgaacaaggaaguggcuacgcagcugaccucaaaagcacccagaaugccauugauaagaucacgaacaaagugaauaguguuauagagaagaugaacacccaguuuacagcuguggguaaggaguucaaucaccuggaacggcgcauugagaacuuaaauaaaaaggucgacgauggguuccuggacaucuggacuuacaacgccgaacuccuugugcuguuggagaaugaacgaacccuagauuaucaugacucuaacguaaagaaccuguacgagaagguuagaaaucagcucaaaaacaaugcaaaggagaucggcaacggauguuuugaguucuaucacaagugcgauaauacauguauggaaagcgugaaaaacggcacuuacgacuauccuaaguacucagaagaggccaaacugaauagggaagagauugauggggucaaacuugagaguacccggaucuaucaaauucuggcuauauacuccacaguggcgagcucuuugguccucgugguuucacugggagcaaucaguuuuuggaugugcagcaacgguuccuuacagugccguauuuguaucuga

SEQ ID NO: 134143 - RNA, 1701 nt, Artificial Sequence
  derived and/or modified sequence opt3 from hemagglutinin__InfluenzaA__AHZ36385
augaagaccaucauugcccugagcuacauacucugccuuaucuucgcucaggagauucccggcaacgacaauuccacagcaacucuguguuuggggcaccaugccgugccuaacggaacgaucgucaaaaccauuacaaaugaucaaaucgaaguuacuaacgcgaccgaguuagugcagucuucaaguacaggugaaauaugcaauagcccacaccagauccuggacggcgagaacuguacccuaauugaugcucuccugggggacccgcagugcgaugacuuucaaaauaagaaaugggaucuuuucguagaaagauccaaggcccauucuaacuguuaucccuacgacgugccugauuaugcaucgcugaggucauuggucgccagcaguggaacucucgaguuuaauaacgaguccuucaauuggacaggcgugacccagaacgguacgucuagcgcuugcauccggcgcuccaauaacucauuuuucagucgacugaauuggcugacucaccucaacuuuaaauacccagcauuaaacguuaccaugcccaauaacgaacaguucgacaagcuguauauuuggggagugcaucacccugggacagauaaggaccagaucuuucuuuacgcccaagcuagcggccguauaacugucucuaccaaaagaucccagcaggccgugauuccaaauaucggcucaaggccccggguacgcaacauuccuagcagaguuaguaucuauuggacaaucgugaagccaggggauauuuugcugauaaauucuaccggaaaccuaaucgcgccgagggguuacuucaaaauucgguccggcaagagcucgaucaugcgcucugacgcacccauagggaaauguaauuccgccugcauuacgccuaacggaucaaucccaaaugacaagcccuuucagaacgucaaucgaaucacuuacggcgcuuguccuagauaugugaagcaaaacacacucaaacuggccaccgguaugaggaaugugccagagaagcagacucgggggauuuucggagcaaucgcuggcuuuauugaaaacggcugggaggggauggucgauggaugguacgguuuccgucaccagaauagugagggccgcgggcaagccgcggaccuuaaaagcacacaggccgcaauagaucagaucaacggaaagcugaacagauugauuggcaaaaccaaugaaaaguuccaucagaucgagaaagaauuuuccgagguugaagguaggauccaagaccucgagaaguauguggaggauacgaagauugaccuguggucuuacaacgcugaauuacugguagcccucgagaaucagcacaccauagaucuuacagacagcgaaaugaacaaacuguucgagaagacuaaaaagcaguugcgggaaaaugcugaggauauggggaacggcugcuuuaaaaucuaucauaagugugacaaugccugcauuggaucaauccgaaacggcaccuacgaucacgacguguaucgcgacgaggcacuaaauaacagauucaagauuaaaggggucgaacugaagaguggauacaaagauuggauccucuggauauccuuugccaucagcugcuuccugcuuuguguggcucuguuggguuuuauuaugugggcgugccagaagggcaauaucagguguaacauuugcaucuga

SEQ ID NO: 134144 - RNA, 1701 nt, Artificial Sequence
  derived and/or modified sequence opt3 from hemagglutinin__InfluenzaA__AHZ36397
augaagaccaucauugcccugagcuacauacucugccuuaucuucgcucaggagauucccggcaacgacaauuccacagcaacucuguguuuggggcaccaugccgugccuaacggaacgaucgucaaaaccauuacaaaugaucaaaucgaaguuacuaacgcgaccgaguuagugcagucuucaaguacaggugaaauaugcaauagcccacaccagauccuggacggcgagaacuguacccuaauugaugcucuccugggggacccgcagugcgaugacuuucaaaauaagaaaugggaucuuuucguagaaagauccaaggcccauucuaacuguuaucccuacgacgugccugauuaugcaucgcugaggucauuggucgccagcaguggaacucucgaguuuaauaacgaguccuucaauuggacaggcgugacccagaacgguacgucuagcgcuugcauccggcgcuccaauaacucauuuuucagucgacugaauuggcugacucaccucaacuuuaaauacccagcauuaaacguuaccaugcccaauaacgaacaguucgacaagcuguauauuuggggagugcaucacccugggacagauaaggaccagaucuuucuuuacgcccaagcuagcggccguauaacugucucuaccaaaagaucccagcaggccgugauuccaaauaucggcucaaggccccggguacgcaacauuccuagcagaguuaguaucuauuggacaaucgugaagccaggggauauuuugcugauaaauucuaccggaaaccuaaucgcgccgagggguuacuucaaaauucgguccggcaagagcucgaucaugcgcucugacgcacccauagggaaauguaauuccgccugcauuacgccuaacggaucaaucccaaaugacaagcccuuucagaacgucaaucgaaucacuuacggcgcuuguccuagauaugugaagcaaaacacacucaaacuggccaccgguaugaggaaugugccagagaagcagacucgggggauuuucggagcaaucgcuggcuuuauugaaaacggcugggaggggauggucgauggaugguacgguuuccgucaccagaauagugagggccgcgggcaagccgcggaccuuaaaagcacacaggccgcaauagaucagaucaacggaaagcugaacagauugauuggcaaaaccaaugaaaaguuccaucagaucgagaaagaauuuuccgagguugaagguaggauccaagaccucgagaaguauguggaggauacgaagauugaccuguggucuuacaacgcugaauuacugguagcccucgagaaucagcacaccauagaucuuacagacagcgaaaugaacaaacuguucgagaagacuaaaaagcaguugcgggaaaaugcugaggauauggggaacggcugcuuuaaaaucuaucauaagugugacaaugccugcauuggaucaauccgaaacggcaccuacgaucacaauguguaucgcgacgaggcacuaaacaauagauucaagauuaaaggggucgaacugaagaguggauacaaagacuggauccucuggauauccuuugccaucagcugcuuccugcuuuguguggcucuguuggguuuuauuaugugggcgugccagaagggcaacaucagguguaauauuugcaucuga

SEQ ID NO: 134145 - RNA, 1701 nt, Artificial Sequence; identical to SEQ ID NO: 134081
  derived and/or modified sequence opt3 from hemagglutinin__InfluenzaA__AHZ36409

SEQ ID NO: 134146 - RNA, 1701 nt, Artificial Sequence; identical to SEQ ID NO: 134082
  derived and/or modified sequence opt3 from hemagglutinin__InfluenzaA__AHZ36433

SEQ ID NO: 134147 - RNA, 1701 nt, Artificial Sequence
  derived and/or modified sequence opt3 from hemagglutinin__InfluenzaA__AHZ36445
augaagaccaucauugcccugagcuacauacucugccuuaucuucgcucaggagauucccggcaacgacaauuccacagcaacucuguguuuggggcaccaugccgugccuaacggaacgaucgucaaaaccauuacaaaugaucaaaucgaaguuacuaacgcgaccgaguuagugcagucuucaaguacaggugaaauaugcaauagcccacaccagauccuggacggcgagaacuguacccuaauugaugcucuccugggggacccgcagugcgaugacuuucaaaauaagaaaugggaucuuuucguagaaagauccaaggcccauucuaacuguuaucccuacgacgugccugauuaugcaucgcugaggucauuggucgccagcaguggaacucucgaguuuaauaacgaguccuucaauuggacaggcgugacccagaacgguacgucuagcgcuugcauccggcgcuccaauaacucauuuuucagucgacugaauuggcugacucaccucaacuuuaaauacccagcauuaaacguuaccaugcccaauaacgaacaguucgacaagcuguauauuuggggagugcaucacccugggacagauaaggaccagaucuuucuuuacgcccaagcuagcggccguauaacugucucuaccaaaagaucccagcaggccgugauuccaaauaucggcucaaggccccggguacgcaacauuccuagcagaguuaguaucuauuggacaaucgugaagccaggggauauuuugcugauaaauucuaccggaaaccuaaucgcgccgagggguuacuucaaaauucgguccggcaagagcucgaucaugcgcucugacgcacccauagggaaauguaauuccgccugcauuacgccuaacggaucaaucccaaaugacaagcccuuucagaacgucaaucgaaucacuuacggcgcuuguccuagauaugugaagcaaaacacacucaaacuggccaccgguaugaggaaugugccagagaagcagacucgggggauuuucggagcaaucgcuggcuuuauugaaaacggcugggaggggauggucgauggaugguacgguuuccgucaccagaauagugagggccgcgggcaagccgcggaccuuaaaagcacacaggccgcaauagaucagaucaacggaaagcugaacagauugauuggcaaaaccaaugaaaaguuccaucagaucgagaaagaauuuuccgagguugaagguaggauccaagaccucgagaaguauguggaggauacgaagauugaccuguggucuuacaacgcugaauuacugguagcccucgagaaucagcacaccauagaucuuacagacagcgaaaugaacaaacuguucgagaagacuaaaaagcaguugcgggaaaaugcugaggauauggggaacggcugcuuuaaaaucuaucauaagugugacgaugccugcauuggaucaauccgaaauggcaccuacgaccacgacguguaucgcgaugaggcacuaaacaauagauuccagauuaagggggucgaacugaaaaguggauacaaggacuggauccucuggauauccuuugccaucagcugcuuccugcuuuguguggcucuguuggguuuuauuaugugggcgugccaaaaaggcaacaucagguguaauauuugcaucuga

SEQ ID NO: 134148 - RNA, 1701 nt, Artificial Sequence; identical to SEQ ID NO: 134081
  derived and/or modified sequence opt3 from hemagglutinin__InfluenzaA__AHZ36457

SEQ ID NO: 134149 - RNA, 1701 nt, Artificial Sequence; identical to SEQ ID NO: 134081
  derived and/or modified sequence opt3 from hemagglutinin__InfluenzaA__AHZ36469

SEQ ID NO: 134150 - RNA, 1701 nt, Artificial Sequence
  derived and/or modified sequence opt3 from hemagglutinin__InfluenzaA__AHZ36481
augaagaccaucauugcccugagcuacauacucugccuuaucuucgcucaggagauucccggcaacgacaauuccacagcaacucuguguuuggggcaccaugccgugccuaacggaacgaucgucaaaaccauuacaaaugaucaaaucgaaguuacuaacgcgaccgaguuagugcagucuucaaguacaggugaaauaugcaauagcccacaccagauccuggacggcgagaacuguacccuaauugaugcucuccugggggacccgcagugcgaugacuuucaaaauaagaaaugggaucuuuucguagaaagauccaaggcccauucuaacuguuaucccuacgacgugccugauuaugcaucgcugaggucauuggucgccagcaguggaacucucgaguuuaauaacgaguccuucaauuggacaggcgugacccagaacgguacgucuagcgcuugcauccggcgcuccaauaacucauuuuucagucgacugaauuggcugacucaccucaacuuuaaauacccagcauuaaacguuaccaugcccaauaacgaacaguucgacaagcuguauauuuggggagugcaucacccugggacagauaaggaccagaucuuucuuuacgcccaagcuagcggccguauaacugucucuaccaaaagaucccagcaggccgugauuccaaauaucggcucaaggccccggguacgcaacauuccuagcagaguuaguaucuauuggacaaucgugaagccaggggauauuuugcugauaaauucuaccggaaaccuaaucgcgccgagggguuacuucaaaauucggaauggcaaguccagcaucaugcgcucggacgcacccauagggaaauguaacucugccugcauuacgccuaauggauccaucccaaacgacaagcccuuucagaaugucaaccgaaucacuuacggcgcuuguccuagauaugugaagcaaaauacacucaaacuggccaccgguaugaggaacgugccagagaagcagacucgggggauuuucggagcaaucgcuggcuuuauugaaaauggcugggaggggauggucgauggaugguacgguuuccgucaccagaacucagagggccgcgggcaagccgcggaccuuaaaaguacacaggccgcaauagaucagaucaacggaaagcugaauagauugauuggcaaaaccaacgaaaaguuccaucagaucgagaaagaauuuagcgagguugaagguaggauccaagaccucgagaaguauguggaggauacgaagauugaccugugguccuacaaugcugaauuacugguagcccucgagaaccagcacaccauagaucuuacagacucugaaaugaauaaacuguucgagaagacuaaaaagcaguugcgggaaaacgcugaggauauggggaauggcugcuuuaaaaucuaucauaagugugacaacgccugcauuggaagcauccgaaauggcaccuacgaucacgacguguaucgcgacgaggcacuaaacaauagauuccagauuaagggggucgaacugaaaucaggauacaaggauuggauccucuggauaaguuuugccaucuccugcuuccugcuuuguguggcucuguuggguuuuauuaugugggcgugccaaaaaggcaacaucagguguaauauuugcaucuga

SEQ ID NO: 134151 - RNA, 1701 nt, Artificial Sequence; identical to SEQ ID NO: 134082
  derived and/or modified sequence opt3 from hemagglutinin__InfluenzaA__AHZ36493

SEQ ID NO: 134152 - RNA, 1701 nt, Artificial Sequence; identical to SEQ ID NO: 134082
  derived and/or modified sequence opt3 from hemagglutinin__InfluenzaA__AHZ36505

SEQ ID NO: 134153 - RNA, 1701 nt, Artificial Sequence; identical to SEQ ID NO: 134082
  derived and/or modified sequence opt3 from hemagglutinin__InfluenzaA__AHZ36517

SEQ ID NO: 134154 - RNA, 1701 nt, Artificial Sequence
  derived and/or modified sequence opt3 from hemagglutinin__InfluenzaA__AHZ36529
augaagaccaucauugcccugagcuacauacucugccuuaucuucgcucaggagauucccggcaacgacaauuccacagcaacucuguguuuggggcaccaugccgugccuaacggaacgaucgucaaaaccauuacaaaugaucaaaucgaaguuacuaacgcgaccgaguuagugcagucuucaaguacaggugaaauaugcaauagcccacaccagauccuggacggcgagaacuguacccuaauugaugcucuccugggggacccgcagugcgaugacuuucaaaauaagaaaugggaucuuuucguagaaagauccaaggcccauucuaacuguuaucccuacgacgugccugauuaugcaucgcugaggucauuggucgccagcaguggaacucucgaguuuaauaacgaguccuucaauuggacaggcgugacccagaacgguacgucuagcgcuugcauccggcgcuccaauaacucauuuuucagucgacugaauuggcugacucaccucaacuuuaaauacccagcauuaaacguuaccaugcccaauaacgaacaguucgacaagcuguauauuuggggagugcaucacccugggacagauaaggaccagaucuuucuuuacgcccaagcuagcggccguauaacugucucuaccaaaagaucccagcaggccgugauuccaaauaucggcucaaggccccggguacgcaacauuccuagcagaguuaguaucuauuggacaaucgugaagccaggggauauuuugcugauaaauucuaccggaaaccuaaucgcgccgagggguuacuucaaaauucgguccggcaagagcucgaucaugcgcucugacgcacccauagggaaauguaauuccucaugcauuacgccuaacggaaguaucccaaaugacaagcccuuucagaacgucaaucgaaucacuuacggcgccuguccuagauaugugaagcaaaacacacucaaacuggcuaccgguaugaggaaugugccagagaagcagacucgggggauuuucggagccaucgcaggcuuuauugaaaacggcugggaggggauggucgauggaugguacgguuuccgucaccagaauagcgagggccgcgggcaagcugccgaccuuaaauccacacaggcggccauagaucagaucaacggaaagcugaacagauugauuggcaaaaccaaugaaaaguuccaucagaucgagaaagaauuuucugagguugaagguaggauccaagaccucgagaaguauguggaggauacgaagauugaccuguggagcuacaacgcagaauuacugguagcucucgagaaucagcacaccauagaucuuacagacucagaaaugaacaaacuguucgagaagacuaaaaagcaguugcgggaaaaugccgaggauauggggaacggcugcuuuaaaaucuaucauaagugugacaaugcuugcauuggaaguauccgaaacggcaccuacgaucacgacguguaucgcgacgaggcccuaaauaacagauuccagauuaagggggucgaacugaaauccggauacaaggauuggauccucuggaucagcuuugcaauaucuugcuuccugcuuuguguggcccuguuggguuuuauuaugugggcuugccaaaaaggcaauaucagguguaacauuugcaucuga

SEQ ID NO: 134155 - RNA, 1701 nt, Artificial Sequence; identical to SEQ ID NO: 134081
  derived and/or modified sequence opt3 from hemagglutinin__InfluenzaA__AHZ36541

SEQ ID NO: 134156 - RNA, 1701 nt, Artificial Sequence
  derived and/or modified sequence opt3 from hemagglutinin__InfluenzaA__AHZ36553
augaagaccaucauugcccugagcuacauacucugccuuaucuucgcucaggagauucccggcaacgacaauuccacagcaacucuguguuuggggcaccaugccgugccuaacggaacgaucgucaaaaccauuacaaaugaucaaaucgaaguuacuaacgcgaccgaguuagugcagucuucaaguacaggugaaauaugcaauagcccacaccagauccuggacggcgagaacuguacccuaauugaugcucuccugggggacccgcagugcgaugacuuucaaaauaaggaaugggaucuuuucguagagagauccaaagcccauucuaacuguuaucccuacgacgugccugauuaugcaucgcugaggucauuggucgccagcaguggaacucucgaguuuaagaaugaauccuucaacuggacaggcgugacccagaaugguacgucuagcgcuugcauccggcgcuccaacaauucauuuuucagucgacugaacuggcugacucaccucaauuuuaaauacccagcauuaaacguuaccaugcccaacaaugagcaguucgacaagcuguauauuuggggagugcaucacccugggacagauaaggaccagaucuuucuuuacgcccaagcuagcggccguauaacugucucuaccaaaagaucccagcaggccgugauuccaaacaucggcucaaggccccggguacgcaauauuccuagcagaguuaguaucuauuggacaaucgugaagccaggggauauuuugcugauaaacucuaccggaaaucuaaucgcgccgagggguuacuucaaaauucgguccggcaagagcucgaucaugcgcucugacgcacccauagggaaauguaacuccgccugcauuacgccuaauggaucaaucccaaacgacaagcccuuucagaaugucaaccgaaucacuuacggcacauguccuagauaugugaagcaaaauacccucaaacuggcuacugguaugaggaacgugccagaaaagcagacacgggggauuuucggagccaucgcaggcuuuauugagaauggcugggaggggauggucgauggaugguacgguuuccgucaccagaacagugaaggccgcgggcaagcugccgaccuuaaaagcacccaggcggccauagaucagaucaauggaaagcugaacagauugauuggcaaaacgaacgagaaguuccaucagaucgaaaaagaguuuuccgaaguugaggguaggauccaagaccucgagaaguauguggaagauaccaagauugaccuguggucuuacaaugcagaguuacugguagcucucgaaaaccagcacacaauagaucuuacugacagcgagaugaauaaacuguucgaaaagaccaaaaagcaguugcgggagaacgccgaggauauggggaauggcugcuuuaaaaucuaucauaagugugacaacgcuugcauuggaucaauccgaaauggcacauacgaucacgacguguaucgcgacgaagcccuaaacaauagauuccagauuaagggggucgagcugaaaaguggauacaaggauuggauccucuggauauccuuugcaaucagcugcuuccugcuuuguguggcccuguuggguuuuauuaugugggcuugccaaaaaggcaacaucagguguaauauuugcaucuga

SEQ ID NO: 134157 - RNA, 1701 nt, Artificial Sequence; identical to SEQ ID NO: 134081
  derived and/or modified sequence opt3 from hemagglutinin__InfluenzaA__AHZ36565

SEQ ID NO: 134158 - RNA, 1701 nt, Artificial Sequence; identical to SEQ ID NO: 134081
  derived and/or modified sequence opt3 from hemagglutinin__InfluenzaA__AHZ36577

SEQ ID NO: 134159 - RNA, 1701 nt, Artificial Sequence; identical to SEQ ID NO: 134081
  derived and/or modified sequence opt3 from hemagglutinin__InfluenzaA__AHZ36589

SEQ ID NO: 134160 - RNA, 1701 nt, Artificial Sequence; identical to SEQ ID NO: 134156
  derived and/or modified sequence opt3 from hemagglutinin__InfluenzaA__AHZ36601

SEQ ID NO: 134161 - RNA, 1701 nt, Artificial Sequence
  derived and/or modified sequence opt3 from hemagglutinin__InfluenzaA__AHZ36613
augaagaccaucauugcccugagcuacauacucugccuuaucuucgcucaggagauucccggcaacgacaauuccacagcaacucuguguuuggggcaccaugccgugccuaacggaacgaucgucaaaaccauuacaaaugaucaaaucgaaguuacuaacgcgaccgaguuagugcagucuucaaguacaggugaaauaugcaauagcccacaccagauccuggacggcgagaacuguacccuaauugaugcucuccugggggacccgcagugcgaugacuuucaaaauaaggaaugggaucuuuucguagagagauccaaagcccauucuaacuguuaucccuacgacgugccugauuaugcaucgcugaggucauuggucgccagcaguggaacucucgaguuuaauaacgaauccuucaauuggacaggcgugacccagaacgguacgucuagcgcuugcauccggcgcuccaauaacucauuuuucagucgacugaauuggcugacucaccucaacuuuaaguacccagcauuaaacguuaccaugcccaauaacgagcaguucgacaaacuguauauuuggggagugcaucacccugggacagauaaggaccagaucuuucuuuacgcccaagcuagcggccguauaacugucucuaccaagagaucccagcaggccgugauuccaaauaucggcucaaggccccggguacgcaacauuccuagcagaguuaguaucuauuggacaaucgugaaaccaggggauauuuugcugauaaauucuaccggaaaccuaaucgcgccgagggguuacuucaagauucgguccggcaaaagcucgaucaugcgcucugacgcacccauagggaaguguaauuccgccugcauuacgccuaacggaucaaucccaaaugacaaacccuuucagaacgucaaucgaaucacuuacggcacauguccuagauaugugaagcaaaacacccucaagcuggcuacugguaugaggaaugugccagaaaaacagacacgggggauuuucggagccaucgcaggcuuuauugagaacggcugggaggggauggucgauggaugguacgguuuccgucaccagaauagugaaggccgcgggcaagcugccgaccuuaagagcacccaggcggccauagaucagaucaacggaaaacugaacagauugauuggcaagacgaaugagaaauuccaucagaucgaaaaggaguuuuccgaaguugaggguaggauccaagaccucgagaaauauguggaagauaccaagauugaccuguggucuuacaacgcagaguuacugguagcucucgaaaaucagcacacaauagaucuuacugacagcgagaugaacaagcuguucgagaaaaccaagaaacaguugcgggaaaaugccgaggauauggggaacggcugcuuuaagaucuaucauaaaugugacaaugcuugcauuggaucaauccgaaacggcacauacgaucacgacguguaucgcgacgaagcccuaaauaacagauuccagauuaagggggucgagcugaagaguggauacaaagauuggauccucuggauauccuuugcaacuagcugcuuccugcuuuguguggcccuguuggguuuuaucaugugggcuugccaaaagggcaauauuagguguaacaucugcauuuga

SEQ ID NO: 134162 - RNA, 1701 nt, Artificial Sequence; identical to SEQ ID NO: 134081
  derived and/or modified sequence opt3 from hemagglutinin__InfluenzaA__AHZ36625

SEQ ID NO: 134163 - RNA, 1701 nt, Artificial Sequence; identical to SEQ ID NO: 134082
  derived and/or modified sequence opt3 from hemagglutinin__InfluenzaA__AHZ36637

SEQ ID NO: 134164 - RNA, 1701 nt, Artificial Sequence; identical to SEQ ID NO: 134082
  derived and/or modified sequence opt3 from hemagglutinin__InfluenzaA__AHZ36649

SEQ ID NO: 134165 - RNA, 1701 nt, Artificial Sequence; identical to SEQ ID NO: 132010
  derived and/or modified sequence opt3 from hemagglutinin__InfluenzaA__AHZ36661

SEQ ID NO: 134166 - RNA, 1701 nt, Artificial Sequence; identical to SEQ ID NO: 132010
  derived and/or modified sequence opt3 from hemagglutinin__InfluenzaA__AHZ36673

SEQ ID NO: 134167 - RNA, 1701 nt, Artificial Sequence
  derived and/or modified sequence opt3 from hemagglutinin__InfluenzaA__AHZ36685
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggauucaggaccuggagaaauacguugaggauacaaagauagacuuauggucauauaacgcagaacugcucguggcucuugagaaccaacauaccaucgaucugacggacagugaaaugaauaaauuguucgagaagaccaaaaagcagcuacgggaaaacgccgaggauaugggaaauggcugcuuuaagauuuaccacaaaugugacaacgcuugcaucggguccauucgaaauggaacauaugaucaugacguauaccgcgacgaggcccugaacaauagauuccagaucaagaggguggaacucaaaagcgguuacaaggauuggauacuguggaucucuuuugcaauuucaugcuuccuucugugugucgccuugcucggcuuuaucaugugggcuugccagaaagggaacauucgguguaauaucugcauauga

SEQ ID NO: 134168 - RNA, 1683 nt, Artificial Sequence; identical to SEQ ID NO: 132004
  derived and/or modified sequence opt3 from hemagglutinin__InfluenzaA__AHZ39698

SEQ ID NO: 134169 - RNA, 1683 nt, Artificial Sequence
  derived and/or modified sequence opt3 from hemagglutinin__InfluenzaA__AHZ39722
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaacgcacaguggauuugggccaaugcggguuacugggaaccaucacuggcccaccgcagugugaccaguuucuagaguucucugcugaucucauaaucgaacgacgugaggguucagacguuugcuaccccgggaaguuugugaacgaggaagcccugagacagauucuuagggagaguggaggcaucgauaaagaagcaaugggcuucacauauagcgggauucggaccgacggagccacguccgcuugucgcagaucugguucgucauuuuacgcagagaugaaguggcuguugagcaauacugaugacgccgcuuucccucaaaugaccaagaguuauaaaaacacaaggaaguccccagcccucaucgucuggggcauacaccauucugugagcacugcggagcagaccaaacuguacggguccggaaauaagcugguaacaguuggcucaaguaacuaucagcagagcuuugugcccucuccuggugcacggccacaagucaaugggcucuccggacgcauugauuuccacugguuaaugcugaaccccaaugacaccgugacguuuucauucaacggcgccuuuaucgcuccugaucgagccagcuuccuuagaggcaaaaguauggggauucagucuggagugcaggucgacgcaaauugcgaaggugauuguuaccauuccggcgggacuaucaucagcaacuugccauuucagaacauugacucgagggcuguuggaaagugcccgcgguaugugaagcaacguucucugcuacucgccacaggcaugaaaaauguacccgagauaccuaagggucgcgggcuguucggcgcgaucgccggauucauugaaaacggcugggaggggcuuaucgacggaugguacgguuuuagacaccagaaugcacagggcgaagggaccgcugccgauuacaaauccacucaaucagcuauagaccagauuacaggaaagcugaacagguugaucgagaaaaccaaucagcaguucgagcucaucgauaacgaauuuaaugagguggaaaagcaaauuggcaacgucaucaauuggacgcgggacaguauuaccgagguguggagcuauaacgccgaacuguuaguugcaauggagaaucagcacacaauagaucuggccgacuccgagauggauaaacucuacgaacgagugaagcgccagcuuagagagaacgcugaagaggacgguacuggguguuucgaaaucuuucauaagugcgaugacgauuguauggcgucuauuaggaauaacaccuaugaccacagcaaauaccgggaggaggcaaugcagaaucgcauccaaaucgacccagucaagcugucaaguggcuauaaagaugugauuuugugguucuccuuuggagccagcugcuucauacuacuggcuaucguaaugggccucguuuuuauuugcgugaagaacgggaacaugagauguacaaucugcauuuga

SEQ ID NO: 134170 - RNA, 1683 nt, Artificial Sequence; identical to SEQ ID NO: 134169
  derived and/or modified sequence opt3 from hemagglutinin__InfluenzaA__AHZ39734

SEQ ID NO: 134171 - RNA, 1683 nt, Artificial Sequence
  derived and/or modified sequence opt3 from hemagglutinin__InfluenzaA__AHZ39746
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaacgcacaguggauuugggccaaugcggguuacugggaaccaucacuggcccaccgcagugugaccaguuucuagaguucucugcugaucucauaaucgaacgacgugaggguucagacguuugcuaccccgggaaguuugugaacgaggaagcccugagacagauucuuagggagaguggaggcaucgauaaagaagcaaugggcuucacauauagcgggauucggaccaauggagccacguccgcuugucgcagaucugguucgucauuuuacgcagagaugaaguggcuguugagcaacacugacaaugccgcuuucccucaaaugaccaagaguuauaaaaacacaaggaaguccccagcccucaucgucuggggcauacaccauucugugagcacugcggagcagaccaaacuguacggguccggaaauaagcugguaacaguuggcucaaguaacuaucagcagagcuuugugcccucuccuggugaacggccacaagucaaugggcucuccggacgcauugauuuccacugguuaaugcugaaccccaaugacaccgugacguuuucauucaacggcgcauuuaucgccccugaucgagcuagcuuccuuagaggcaaaaguauggggauucagucuggagugcaggucgacgccaacugcgagggugauuguuaccauuccggcgggacuaucaucagcaauuugccauuucagaacauugacucgagggcaguuggaaagugcccgcgguaugugaagcaacguucucugcuacucgcuacaggcaugaaaaauguacccgaaauaccuaagggucgcgggcuguucggcgccaucgcgggauucauugagaacggcugggaagggcuuaucgauggaugguacgguuuuagacaccagaaugcccagggcgaggggaccgcagcugacuacaaauccacucaaucagccauagaccagauuacaggaaagcugaacagguugaucgagaaaaccaaucagcaguucgaacucaucgauaacgaguuuaaugaaguggagaagcaaauuggcaacgucaucaauuggacgcgggacaguauuaccgaaguguggagcuauaacgcugagcuguuaguugccauggagaaucagcacacaauagaucuggcagacuccgaaauggauaaacucuacgagcgagugaagcgccagcuuagagaaaacgccgaggaagacgguacuggguguuucgagaucuuucauaagugcgaugacgauuguauggcuucuauuaggaauaacaccuaugaccacagcaaauaccgggaggaagcgaugcagaaccgcauccaaaucgauccagucaagcugucaaguggcuauaaagacgugauuuugugguucuccuuuggagcaagcugcuucauacuacuggccaucguaaugggccucguuuuuauuugcgugaagaaugggaacaugagauguacaaucugcauuuga

SEQ ID NO: 134172 - RNA, 1683 nt, Artificial Sequence; identical to SEQ ID NO: 134169
  derived and/or modified sequence opt3 from hemagglutinin__InfluenzaA__AHZ39758

SEQ ID NO: 134173 - RNA, 1683 nt, Artificial Sequence; identical to SEQ ID NO: 134169
  derived and/or modified sequence opt3 from hemagglutinin__InfluenzaA__AHZ39770

SEQ ID NO: 134174 - RNA, 1683 nt, Artificial Sequence; identical to SEQ ID NO: 134169
  derived and/or modified sequence opt3 from hemagglutinin__InfluenzaA__AHZ39782

SEQ ID NO: 134175 - RNA, 1701 nt, Artificial Sequence; identical to SEQ ID NO: 131899
  derived and/or modified sequence opt3 from hemagglutinin__InfluenzaA__AHZ39794

SEQ ID NO: 134176 - RNA, 1701 nt, Artificial Sequence; identical to SEQ ID NO: 132013
  derived and/or modified sequence opt3 from hemagglutinin__InfluenzaA__AHZ39806

SEQ ID NO: 134177 - RNA, 1701 nt, Artificial Sequence
  derived and/or modified sequence opt3 from hemagglutinin__InfluenzaA__AHZ39818
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaguuguauauuuggggaguccaucacccuggcacagacaaagaucagacuuuucuuuacgcccaagcugccggccguaucaccgugagcacaaagagaucucagcaggcgguaauuccaaauaucggguccaggccccggguucgcaacauaccuucaagagugagcauuuauuggaccaucgucaaaccaggagacauucugcuaaucaauaguacggguaaccucaucgcaccgaggggcuacuucaagauucggucugggaaauccagcauaaugcgcucggaugcccccaucggaaaguguaauucugcuugcauuacuccuaacggcuccaucccaaaugacaagcccuuucagaacgugaaucgaauaacauacggugccuguccuagauaugugaaacaaaacacccugaaacuugcaacugggaugaggaaugucccagaaaaacagacacggggaauuuucggcgcuaucgccggcuuuaucgagaacgggugggaaggaaugguugacgguugguacggcuuccgucaccaaaauucagaggggcgcggacaggcggccgaucugaagaguacccaggcagcuauugaccagaucaacggcaaauugaacagacucauugguaagacgaaugagaaauuccaucagauagaaaaggaguuuagcgaaguggaggggaggauccaagaucuggaaaaguauguagaggacaccaaaauugauuuaugguccuacaacgccgagcugaucguggcucucgaaaaucagcacacaaucgaccuuacugauucugagaugaacaagcuguucgaaaagaccaagaaacaguugcgggagaaugccgaagacaugggcaacggaugcuuuaagauuuaucauaagugugauaaugcaugcauaggcagcauccgaaacgggacauacgaccacgaugucuaucgcgacgaggcccuaaauaacagauuccagauuaaaggaguggagcugaagucagguuacaaagacuggauccucuggauuaguuuugcuaucuccugcuuccugcuuuguguugugcuguugggcuuuauaaugugggcgugccaaaaggggaauaucagguguaacauuugcaucuga

SEQ ID NO: 134178 - RNA, 1701 nt, Artificial Sequence; identical to SEQ ID NO: 131899
  derived and/or modified sequence opt3 from hemagglutinin__InfluenzaA__AHZ39841

SEQ ID NO: 134179 - RNA, 1701 nt, Artificial Sequence; identical to SEQ ID NO: 131919
  derived and/or modified sequence opt3 from hemagglutinin__InfluenzaA__AHZ39853

SEQ ID NO: 134180 - RNA, 1701 nt, Artificial Sequence; identical to SEQ ID NO: 131899
  derived and/or modified sequence opt3 from hemagglutinin__InfluenzaA__AHZ39865

SEQ ID NO: 134181 - RNA, 1701 nt, Artificial Sequence
  derived and/or modified sequence opt3 from hemagglutinin__InfluenzaA__AHZ39877
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgaggucgaagggcggauucaggaccuggagaaauacguugaggauaccaagauagacuuauggucauauaacgccgaacugcucguggcacuugagaaccaacauacgaucgaucugaccgacagugaaaugaauaaauuguucgagaagacaaagaagcagcuacgagaaaacgcugaggauaugggcaauggaugcuuuaagauuuaccacaaaugugacaacgccugcaucggcuccauucgcaaugggacuuaugaucauaacguauacagagacgaggcucugaauaacagguuccagaucaagggaguggaacucaaaagcgguuacaaggacuggauacuguggaucucuuuugccaccucaugcuuccuucugugugucgcauugcucggcuuuauuaugugggccugccagaaagggaauauccgguguaacauuugcaucuga

SEQ ID NO: 134182 - RNA, 1701 nt, Artificial Sequence; identical to SEQ ID NO: 131919
  derived and/or modified sequence opt3 from hemagglutinin__InfluenzaA__AHZ39889

SEQ ID NO: 134183 - RNA, 1701 nt, Artificial Sequence; identical to SEQ ID NO: 131900
  derived and/or modified sequence opt3 from hemagglutinin__InfluenzaA__AHZ39913

SEQ ID NO: 134184 - RNA, 1701 nt, Artificial Sequence
  derived and/or modified sequence opt3 from hemagglutinin__InfluenzaA__AHZ39925
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagagauauuccuaguaggaucucuaucuacuggaccauuguuaaaccaggagacauacugcuaaucaauuccacagguaaccucauugccccgcggggcuacuucaagauccgcagcgggaaaucgucuauaaugcgauccgacgcgcccauuggaaaguguaagucagaaugcaucaccccuaauggcaguaucccaaacgauaaacccuuucagaaugugaacagaauuacguauggugcauguccuagguacgucaagcagagcacucugaaacuugccacagggaugcggaaugugccagagaagcaaacccguggaaucuucggcgcuauugccggcuuuauagaaaacgggugggagggaaugguggacgguugguauggcuuccgccaccaaaauuccgaggggagaggacaggcagcugaucugaaaucuacucaggccgcgaucgaccagauuaacggcaaguugaauaggcucaucgguaaaacaaacgaaaaguuccaccagaucgagaaggaauuuagcgaggucgaagggcggauucaggaucuggagaaauacguugaggacaccaagauagauuuauggucauauaaugccgaacugcucguggcacuugagaaccaacauacgaucgaccugaccgauagugaaaugaacaaauuguucgagaagacaaagaagcagcuacgagaaaaugcugaggacaugggcaacggaugcuuuaagauuuaccacaaaugugauaaugccugcaucggcuccauucgcaacgggacuuaugaccaugacguauacagagaugaggcucugaauaacagguuccagaucaagggaguggaacucaaaagcgguuacaaggacuggauacuguggaucucuuuugccauuucaugcuuccuucugugugucgcauugcucggcuuuaucaugugggccugccagaaagggaauauucgguguaacaucugcauauga

SEQ ID NO: 134185 - RNA, 1701 nt, Artificial Sequence; identical to SEQ ID NO: 131899
  derived and/or modified sequence opt3 from hemagglutinin__InfluenzaA__AHZ39937

SEQ ID NO: 134186 - RNA, 1701 nt, Artificial Sequence; identical to SEQ ID NO: 131899
  derived and/or modified sequence opt3 from hemagglutinin__InfluenzaA__AHZ39949

SEQ ID NO: 134187 - RNA, 1701 nt, Artificial Sequence; identical to SEQ ID NO: 131899
  derived and/or modified sequence opt3 from hemagglutinin__InfluenzaA__AHZ39961

SEQ ID NO: 134188 - RNA, 1701 nt, Artificial Sequence; identical to SEQ ID NO: 131899
  derived and/or modified sequence opt3 from hemagglutinin__InfluenzaA__AHZ39973

SEQ ID NO: 134189 - RNA, 1701 nt, Artificial Sequence
  derived and/or modified sequence opt3 from hemagglutinin__InfluenzaA__AHZ39985
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgucaauuggaaaguguaagagugaaugcaucacccccaacggcagcaucccuaaugacaaaccauuucagaacgugaauagaauuacguauggugcaugucccagguacgucaagcaguccacucugaaacuugccacagggaugcggaacgugccugagaagcaaacccguggaaucuucggcgcuauugccggcuuuauagaaaaugggugggagggaaugguggaugguugguauggcuuccgccaccagaacucugaggggagaggacaggcagcugaccugaaaagcacucaagccgcgaucgaucagauuaauggcaaguugaacaggcucaucgguaaaacaaaugaaaaguuccaccagaucgagaaggaauuuucagaggucgaagggcggauucaggaccuggagaaauacguugaggauaccaagauagacuuauggaguuauaacgccgaacugcucguggcacuugagaaccaacauacgaucgaucugaccgacuccgaaaugaauaaauuguucgagaagacaaagaagcagcuacgagaaaacgcugaggauaugggcaauggaugcuuuaagauuuaccacaaaugugacaacgccugcaucggcagcauucgcaaugggacuuaugaucauaacguauacagagacgaggcucugaauaacagguuccagaucaagggaguggaacucaaaucugguuacaaggacuggauacuguggaucucauuugccaccaguugcuuccuucugugugucgcauugcucggcuuuauuaugugggccugccagaaagggaauauccgguguaacauuugcaucuga

SEQ ID NO: 134190 - RNA, 1701 nt, Artificial Sequence; identical to SEQ ID NO: 131899
  derived and/or modified sequence opt3 from hemagglutinin__InfluenzaA__AHZ39997

SEQ ID NO: 134191 - RNA, 1701 nt, Artificial Sequence
  derived and/or modified sequence opt3 from hemagglutinin__InfluenzaA__AHZ40009
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaauuucuucaaucggugagauaugcgacaguccacaccagauccuagauggcgaaaauuguacacucauugacgcucugcuuggggauccgcagugcgacggauuucagaacaaaaagugggaucuguucguggagaggagcaaagccuauuccaauuguuaccccuaugacgucccugauuacgcaucuuugcggucgcucguggccucaagcggcacccuggaauuuaacaaugagaguuucaacuggacugguguuacacaaaaugggaccuccucugcuugcauccgcaagagcaacuccucauuuuucagucgacugaauuggcucacgcauuuaaacuuuaaguauccagcacugaaugugacuaugcccaacaacgagcaguucgacaaacuuuacauuuggggaguccaccauccuggcaccgauaaggaccagaucuuuuuguaugcccagagcucuggccguauaacaguguccacuaaaagaucacaacaggcuguaauuccaaauaucgggagcaggccccggauucgcaacaucccuaguagaaucucuauuuacuggaccauaguuaagccaggagauauccugcuaauuaauuccacagguaaccucaucgccccgaggggcuacuucaaaauacggagcgggaagucgucuauuaugcgcuccgacgcgcccaucggaaaguguaaaucagaaugcaucaccccuaauggcaguauuccaaacgacaagcccuuucagaaugugaaccgaaucacguauggugcauguccuagauacgucaaacagagcacucugaaacuugccacagggaugaggaaugugccagagaagcaaacccggggaauuuucggcgcuauagccggcuuuaucgaaaacgggugggagggaaugguggaugguugguauggcuuccgucaccaaaauuccgaggggcgcggacaggcagcugaccugaagucuacucaggccgcgauugaucagaucaacggcaaauugaauagacucaucgguaagacaaacgaaaaguuccaccagauugagaaagaauuuagcgaggucgaagggaggauacaggaccuggagaaguacguugaggauaccaaaaucgacuuauggucauauaaugccgaacugcucguggcacuugagaaccaacauacgauugaucugaccgacagugaaaugaacaaguuguucgagaaaacaaagaagcagcuacgggaaaaugcugaggauaugggcaacggaugcuuuaaaaucuaccacaagugugacaaugccugcauuggcuccauccgaaacgggacuuaugaucaugacguauaccgcgacgaggcucugaauaacagauuccagauaaaaggaguggaacucaagagcgguuacaaagauuggauccuguggauuucuuuugccaucucaugcuuccuucugugugucgcauugcucggcuuuauuaugugggccugccagaaggggaauaucagguguaacauaugcauuuga

SEQ ID NO: 134192 - RNA, 1701 nt, Artificial Sequence; identical to SEQ ID NO: 131899
  derived and/or modified sequence opt3 from hemagglutinin__InfluenzaA__AHZ40021

SEQ ID NO: 134193 - RNA, 1701 nt, Artificial Sequence; identical to SEQ ID NO: 131874
  derived and/or modified sequence opt3 from hemagglutinin__InfluenzaA__AHZ40033

SEQ ID NO: 134194 - RNA, 1701 nt, Artificial Sequence; identical to SEQ ID NO: 131899
  derived and/or modified sequence opt3 from hemagglutinin__InfluenzaA__AHZ40045

SEQ ID NO: 134195 - RNA, 1701 nt, Artificial Sequence; identical to SEQ ID NO: 131899
  derived and/or modified sequence opt3 from hemagglutinin__InfluenzaA__AHZ40060

SEQ ID NO: 134196 - RNA, 1701 nt, Artificial Sequence; identical to SEQ ID NO: 131899
  derived and/or modified sequence opt3 from hemagglutinin__InfluenzaA__AHZ40072

SEQ ID NO: 134197 - RNA, 1701 nt, Artificial Sequence; identical to SEQ ID NO: 131899
  derived and/or modified sequence opt3 from hemagglutinin__InfluenzaA__AHZ40084

SEQ ID NO: 134198 - RNA, 1701 nt, Artificial Sequence; identical to SEQ ID NO: 131899
  derived and/or modified sequence opt3 from hemagglutinin__InfluenzaA__AHZ40096

SEQ ID NO: 134199 - RNA, 1701 nt, Artificial Sequence; identical to SEQ ID NO: 131900
  derived and/or modified sequence opt3 from hemagglutinin__InfluenzaA__AHZ40108

SEQ ID NO: 134200 - RNA, 1701 nt, Artificial Sequence; identical to SEQ ID NO: 132013
  derived and/or modified sequence opt3 from hemagglutinin__InfluenzaA__AHZ40120

SEQ ID NO: 134201 - RNA, 1701 nt, Artificial Sequence
  derived and/or modified sequence opt3 from hemagglutinin__InfluenzaA__AHZ40130
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgaggucgaagggcggauucaggaccuggagaaauacguugaggauaccaagauagacuuauggucauauaacgccgaacugcucguggcacuugagaaccaacauacgaucgaucugaccgacagugaaaugaauaaauuguucgagaagacaaagaagcagcuacgagaaaacgcugaggauaugggcaauggaugcuuuaagauuuaccacaaaugugacaacgccugcaucggcuccauucgcaaugggacuuaugaucauaacguauacagagacgaggcucugaauaacagguuccagaucaagggaguggaacucaaaagcgguuacaagaauuggauacuguggaucucuuuugccauuucaugcuuccuucugugugucgcauugcucggcuuuaucaugugggccugccagaaagggaacauucgguguaauaucugcauauga

SEQ ID NO: 134202 - RNA, 1701 nt, Artificial Sequence
  derived and/or modified sequence opt3 from hemagglutinin__InfluenzaA__AHZ40142
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucaggauaaaaagugggaccuguucguggagaggagcaaagccuauuccaauuguuaccccuaugaugucccugacuacgcaucuuugcggucgcucguggccucaagcggcacccuggaauuuaacaaugagaacuucaauuggacugguguuacacaaaacgggaccaguuccgcuugcauucgccgaucuaauagcuccuuuuucucacgucugaacuggcucacgcauuuaaauuuuaaguauccagcacugaacgugacuaugcccaacaaugagcaguucgauaaguuguacaucuggggaguccaccauccuggcaccgacaaagaucagauuuuucuuuaugcccagaguagcggcagaaucacagugucuacuaagaggucccaacaggcuguaauaccaaacauugggucacggccccgcaucagaaauauuccuagcaggaucaguaucuacuggaccauuguuaaaccaggagacauacugcuaaucaacucuacagguaaucucauugccccgcggggcuacuucaagauccgcuccgggaaaagcucgauaaugcgaucugacgcgcccauuggaaaguguaaguccgaaugcaucaccccuaacggcucaaucccaaaugauagacccuuucagaacgugaauaggauuacguauggugcauguccucgguacgucaaacagaguacucugaaacuugccacagggaugcguaacgugccagagaagcaaacccgcggaaucuucggcgcuauugccggcuuuauagaaaaugggugggagggaaugguggacgguugguauggcuucagacaccagaacagcgaggggaggggacaggcagcugaucugaaguccacucaagccgcgaucgaccagauuaauggcaaauugaaccggcucaucgguaagacaaaugaaaaauuccaccagaucgagaaggaauuuucugaggucgaagggcgcauucaggaucuggagaaguacguugaggacaccaaaauagauuuauggagcuauaacgccgaacugcucguggcacuugagaaccaacauacgaucgaccugaccgauucagaaaugaauaaguuguucgagaaaacaaagaaacagcuacgagaaaacgcugaggacaugggcaauggaugcuuuaagauuuaccacaagugugauaacgccugcaucggcaguauuagaaaugggacuuaugaccaugacguauacagggaugaggcucugaacaaucgguuccagaucaaaggaguggaacucaaguccgguuacaaagacuggauacuguggaucagcuuugccauuucuugcuuccuucugugugucgcauugcucggcuuuaucaugugggccugccagaaggggaacauucgcuguaauaucugcauauga

SEQ ID NO: 134203 - RNA, 1701 nt, Artificial Sequence
  derived and/or modified sequence opt3 from hemagglutinin__InfluenzaA__AHZ40154
augaagaccaucauugcccugagcuacauacucugccuuggcuucgcucaggagcugcccgggaacgacaauuccacagcaacuuuguguuuaggacaccaugccgugccuaacgguacgaucgucaaaaccauuacaaaugaucaaaucgaaguuacuaacgcgaccgagcuggugcagucuucaaguacaggcgaaauuugcaauagcccacaccagauccuagacggggagaacuguacccucauagaugcucugcuuggagacccgcagugcgauggcuuucaaaauaagaaaugggaccuguucguagaaagauccaaggcccauucuaacuguuaucccuacgaugugccugacuaugcaucguugaggucacucgucgccagcagugguacucuggaguuuaauaacgaguccuucaauuggacaggggugacccagaacggaacgucuagcgcuugcauccggggcuccaauaacucauuuuucagucgccugaauuggcucacucacuuaaacuuuaaauacccagcacugaacguuaccaugcccaauaacgaacaguucgauaaacuuuauauuuggggcgugcaucacccugggacagacaaggaucagaucuuuuuguacgcccaagcuagcggacgaauuacugucucuaccaagcguucccagcaggccgugaucccaaauauagguucaagacccaggguacggaacauuccuagccgcguuaguaucuauuggacaauugugaagccaggcgacaugcugcuaaucaauucuaccgggaaccucaucgcgccgagaggauacuucaaaauuagguccggcaagagcucgauaaugcggucugaugcacccaucgguaaauguaauuccgccugcauuacgccuaacgggucaaucccaaaugacaagcccuuucagaacgucaaucgcauaacuuacggagcuuguccucgauaugugaagcaaaacacacugaaacuugccaccggcaugagaaaugugccagagaagcagacuaggggcauuuucggggcaaucgcuggauuuaucgaaaacgguugggagggcauggucgacgggugguacggauuccggcaccagaauagugagggccguggucaagccgcggaucugaaaagcacacaggccgcaauugaccagaucaacgggaaguugaaccgccucauuggcaaaaccaaugaaaaguuccaucagauagagaaagaauuuuccgagguugaaggaagaauccaagaucuggagaaguauguggaggacacgaagauugauuuauggucuuacaacgcugaacugcucguagcccuugagaaucagcacaccaucgaccugacagauagcgaaaugaacaaauuguucgagaagacuaaaaagcagcuaagggaaaaugcugaggacaugggcaacgggugcuuuaaaaucuaucauaaguguaauaacgccugcauuggaucaauacggaaugguaccuacgaucacgacguguaucgagaugaggcacugaacaaucgcuuccagaucaagggcgucgaacucaaaaguggguacaaggacuggauucuguggaucuccuuugccauuagcugcuuccuucuguguguggcuuugcucggauuuaucaugugggcgugccaaaaaggcaacauaagauguaauaucugcauuuga

SEQ ID NO: 134204 - RNA, 1701 nt, Artificial Sequence
  derived and/or modified sequence opt3 from hemagglutinin__InfluenzaA__AHZ40166
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcgugaccaggagggaagaaugaacuacuauuggacacugauugaacccggugauaagaucacuuucgaggccaccggcaaccuaguggucccuagguacgcuuuugccauggaacggaaugcaggguccggaauaauuaucagcgacacaccaguucaugauugcaacaccacgugucaaacuccggagggcgcuauuaauacaucgcuccccuuccagaacauccacccuaucaccauuggucgcugcccaaaauaugugaagucuacuaagcugagacuugccacagggcugaggaauguacccuccauacagucacggggauuguuuggcgcgaucgccggcuucauugaagggggauggaccgguaugguggacggcugguacggguaucaucaccagaacgagcaaggaaguggcuacgcagcugaccucaaaagcacgcagaaugccaucgauaagauaaccaacaaagucaauuccgugauugagaagaugaacacacaguuuacugcuguugguaaagaguucaaucaccuggagaagcgcaucgaaaacuuaaauaagaaaguggacgauggguuccuggacaucuggaccuacaacgccgagcuccuuguccuguuggaaaaugagcgaacacuagauuaucaugacucuaacgugaagaaccuguacgagaaaguaagaaaucagcucaagaacaaugcaaaagaaauuggcaacggauguuuugaguucuaucacaagugcgauaauacuuguauggaaagcguuaagaacggcaccuacgacuauccuaaauacucagaggaagccaagcugaauagggagaaaaucgauggggugaaacuugagaguacacggauuuaucaaauacuggcuaucuacuccaccgucgcgagcucuuuggugcucgucgugucacugggagcaauuaguuuuuggaugugcagcaacgguuccuuacagugccguaucuguaucuga

SEQ ID NO: 134205 - RNA, 1701 nt, Artificial Sequence; identical to SEQ ID NO: 131899
  derived and/or modified sequence opt3 from hemagglutinin__InfluenzaA__AHZ40177

SEQ ID NO: 134206 - RNA, 1701 nt, Artificial Sequence; identical to SEQ ID NO: 131899
  derived and/or modified sequence opt3 from hemagglutinin__InfluenzaA__AHZ40189

SEQ ID NO: 134207 - RNA, 1701 nt, Artificial Sequence; identical to SEQ ID NO: 131899
  derived and/or modified sequence opt3 from hemagglutinin__InfluenzaA__AHZ40201

SEQ ID NO: 134208 - RNA, 1701 nt, Artificial Sequence; identical to SEQ ID NO: 131884
  derived and/or modified sequence opt3 from hemagglutinin__InfluenzaA__AHZ40213

SEQ ID NO: 134209 - RNA, 1701 nt, Artificial Sequence; identical to SEQ ID NO: 131851
  derived and/or modified sequence opt3 from hemagglutinin__InfluenzaA__AHZ40225

SEQ ID NO: 134210 - RNA, 1701 nt, Artificial Sequence
  derived and/or modified sequence opt3 from hemagglutinin__InfluenzaA__AHZ40237
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacccuggaauuuaauaacgagaguuucaauugggcugguguuacucagaacgggacauccucugcaugcauucggggaagcaauuccucauuuuucagucgccugaacuggcucacccauuuaaauuuuaaguauccagcccugaacgugacgaugcccaacaaugagcaguucgacaaacuuuacaucuggggcguccaccauccuggcacugauaaagaccagaucuuuuuguaugcucaaagcucugggcgaauuaccguguccacaaagcguucacagcaggccguaauaccaaacauuggaagcagacccaggauccggaauauuccuagucgcaucucuaucuacuggacuauuguuaaaccaggugauauacugcuaaucaacuccaccggcaaucucauugcgccgagaggguacuucaagaucaggagcggaaaaucgucuauaaugcgguccgacgcacccauuggcaaguguaagucagaaugcaucacaccuaacgguaguaucccaaccgacaaacccuuucagaaugugaaccgcauuacguauggggccuguccucgauacgucaagcaaagcacucugaaacuugcuacaggaaugagaaaugugccagagaagcagaccaggggcaucuucggcgccauugcaggguuuauagaaaacggaugggaggguaugguggauggcugguauggguuccggcaccaaaauuccgagggacguggccaggcugccgaccugaaaucuacucaggcggccaucgaucagauuaacgguaaguugaaucgccucaucgggaaaacaaacgaaaaguuccaccagaucgagaaggaauuuagcgaggucgaaggcaggauucaagaccuggagaaauacguugaggauaccaagauagacuuauggucauauaaugcagaacugcucguggcucuugagaaccagcauacgaucgaucugaccgacagugaaaugaacaaauuguucgagaagacaaagaagcagcuaagagaaaaugccgaggauaugggaaacggcugcuuuaagauuuaccacaaaugugacaaugcuugcaucggguccauucggaacggaacuuaugaucaugacguauaccgagacgaggcccugaauaaccgcuuccagaucaaggguguggaacucaaaagcggcuacaaggauuggauacuguggaucucuuuugcaauuucaugcuuccuucugugugucgccuugcucggguuuaucaugugggcuugccaaaaaggaaauauuagauguaacaucugcauauga

SEQ ID NO: 134211 - RNA, 1701 nt, Artificial Sequence; identical to SEQ ID NO: 131907
  derived and/or modified sequence opt3 from hemagglutinin__InfluenzaA__AHZ40249

SEQ ID NO: 134212 - RNA, 1701 nt, Artificial Sequence; identical to SEQ ID NO: 131874
  derived and/or modified sequence opt3 from hemagglutinin__InfluenzaA__AHZ40261

SEQ ID NO: 134213 - RNA, 1701 nt, Artificial Sequence; identical to SEQ ID NO: 132013
  derived and/or modified sequence opt3 from hemagglutinin__InfluenzaA__AHZ40273

SEQ ID NO: 134214 - RNA, 1701 nt, Artificial Sequence
  derived and/or modified sequence opt3 from hemagglutinin__InfluenzaA__AHZ40285
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccgacucaaguuucuuuagccgacugaacuggcucacucauuuaaauuuuaaguauccagcacugaacgugaccaugcccaauaacgagcaguucgauaaacuuuacauuuggggaguccaccauccuggcacagacaaggaucagaucuuuuuguaugcccaggcuucuggccguauuacuguguccaccaagagaucacaacagagcguaaucccaaacauagggaguaggccccggauucgcaauaucccuucuagaauuuccaucuacuggacaaucguuaaaccaggagacauucugcuaauaaacagcaccgguaaucucaucgccccgaggggcuacuucaagauucagucggggaaaucuuccaucaugcggucagacacgcccauaggaaaguguaacagugaaugcauuacuccuaauggcagcaucccaaacgauaagcccuuucaaaaugugaaccgcaucacauauggugcguguccucgauacgucaaacagaauacccugaaacuugcaacugggaugagaaacgugccagagaagcagacaaggggaauuuucggcgccaucgcuggcuuuauugaaaaugggugggagggaaugguggacgguugguauggcuuccggcaccaaaacuccgaggggcguggacaggccgcagaucugaagucuacccaggcugccauagaccagaucaauggcaaauugaaccgccucauugguaagacgaaugaaaaauuccaccaaaucgagaaggaauuuagcgaggucgaagggagaauccaggaucuggagaaguacguugaggacaccaaaauugauuuauggucauauaacgcggaacugcucguggcccuugagaaccagcauacaauagaccugacugauagugaaaugaauaaguuguucgagaaaaccaagaaacagcuaagggaaaacgcagaggacaugggcaauggaugcuuuaagaucuaccacaagugugauaacgcuugcauuggcuccauccggaaugggacauauaaccaugacguauaccgagacgaggcccugaauaaccgcuuccaaauuaaaggaguggaacucaagagcgguuacaaagauuggauccuguggauaucuuuugcuaucucaugcuuccuucugugugucgccuugcucggcuuuauuaugugggcaugccagaaggggaauaucagauguaacauuugcaucuga

SEQ ID NO: 134215 - RNA, 1701 nt, Artificial Sequence; identical to SEQ ID NO: 132010
  derived and/or modified sequence opt3 from hemagglutinin__InfluenzaA__AHZ40297

SEQ ID NO: 134216 - RNA, 1701 nt, Artificial Sequence
  derived and/or modified sequence opt3 from hemagglutinin__InfluenzaA__AHZ40309
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauaacuccuuuuucucacgucugaauuggcucacgcauuuaaacuuuaaguauccagcacugaacgugacuaugcccaauaacgagcaguucgacaaacuuuacaucuggggaguccaccauccuggcaccgauaaagaccagaucuuuuuguaugcccagaguagcggcagaauuacagugucuacuaagaggucccaacaggcuguaauaccaaauauugggucacggccccgcaucagaaacauuccuagcaggaucaguaucuacuggaccauuguuaaaccaggagauauacugcuaaucaauucuacagguaaccucauugccccgcggggcuacuucaagauccgcaaugggaaauccagcauaaugcgaucggacgcgcccauuggaaaguguaagucugaaugcaucaccccuaacggcuccaucccaaaugacaaacccuuucagaacgugaauagaauuacguauggugcauguccuagguacgucaagcagucaacucugaaacuugccacagggaugcggaacgugccagagaagcaaacccguggaaucuucggcgcuauugccggcuuuauagaaaaugggugggagggaaugguggaugguugguauggcuuccgccaccagaacagugaggggagaggacaggcagcugaccugaaaagcacucaagccgcgaucgaucagauuaauggcaaguugaacaggcucaucgguaaaacaaacgaaaaguuccaccagaucgagaaggaauuuuccgaggucgaagggcggauucaggaccuggagaaauacguugaggauaccaagauagacuuauggucuuauaaugccgaacugcucguggcacuugagaaccaacauacgaucgaucugaccgacagcgaaaugaauaaauuguucgagaagacaaagaagcagcuacgagaaaacgcugaggauaugggcaauggaugcuuuaagauuuaccacaaaugugacaacgccugcaucggcucaauucgcaaugggacuuaugaucaugacguauacagagacgaggcucugaacaauagguuccagaucaagggaguggaacucaaaagugguuacaaggauuggauacuguggaucuccuuugccauuagcugcuuccuucugugugucguguugcucggcuuuaucaugugggcaugccagaaagggaacauucgguguaauaucugcauauga

SEQ ID NO: 134217 - RNA, 1701 nt, Artificial Sequence; identical to SEQ ID NO: 131899
  derived and/or modified sequence opt3 from hemagglutinin__InfluenzaA__AHZ40321

SEQ ID NO: 134218 - RNA, 1701 nt, Artificial Sequence; identical to SEQ ID NO: 131899
  derived and/or modified sequence opt3 from hemagglutinin__InfluenzaA__AHZ40333

SEQ ID NO: 134219 - RNA, 1701 nt, Artificial Sequence
  derived and/or modified sequence opt3 from hemagglutinin__InfluenzaA__AHZ40345
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaagcgacaaacccuuucagaaugugaacagaauuacguauggugcauguccuagguacgucaagcaguccacucugaaacuugccacagggaugcggaaugugccagagaagcaaacccguggaaucuucggcgcuauugccggcuuuauagaaaacgggugggagggaaugguggaugguugguauggcuuccgccaccaaaauucugaggggagaggacaggcagcugaccugaaaagcacucaggccgcgaucgaucagauuaacggcaaguugaauaggcucaucgguaaaacaaacgaaaaguuccaccagaucgagaaggaauuuucagaggucgaagggcggauucaggaccuggagaaauacguugaggauaccaagauagacuuauggaguuauaaugccgaacugcucguggcacuugagaaccaacauacgaucgaucugaccgacuccgaaaugaacaaauuguucgagaagacaaagaagcagcuacgagaaaaugcugaggauaugggcaacggaugcuuuaagauuuaccacaaaugugacaaugccugcaucggcagcauucgcaacgggacuuaugaucaugacguauacagagacgaggcucugaauaacagguuccagaucaagggaguggaacucaaaucugguuacaaggauuggauacuguggaucucauuugccauuaguugcuuccuucugugugucgcauugcucggcuuuaucaugugggccugccagaaagggaauauucgguguaacaucugcauauga

SEQ ID NO: 134220 - RNA, 1701 nt, Artificial Sequence; identical to SEQ ID NO: 131900
  derived and/or modified sequence opt3 from hemagglutinin__InfluenzaA__AHZ40357

SEQ ID NO: 134221 - RNA, 1701 nt, Artificial Sequence
  derived and/or modified sequence opt3 from hemagglutinin__InfluenzaA__AHZ40369
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaguuguacaucuggggaguccaccauccuggcaccgauaaagaccagauuuuucuuuaugcccagagcucuggcagaaucacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggcgaucgucuauaaugagauccgacgcgcccauuggaaaauguaagucagaaugcaucaccccuaacggcaguaucccaaaugacaagcccuuucagaacgugaauaggauuacguauggugcauguccucgguacgucaaacagagcacucugaaacuugccacagggaugcguaacgugccagagaagcaaacccgcggaaucuucggcgcuauugccggcuuuauagaaaaugggugggagggaaugguggaugguugguauggcuucagacaccagaacuccgaggggaggggacaggcagcugaccugaagucuacucaagccgcgaucgaucagauuaauggcaaauugaaccggcucaucgguaagacaaaugaaaaauuccaccagaucgagaaggaauuuagcgaggucgaagggcgcauucaggaccuggagaaguacguugaggauaccaaaauagacuuauggucauauaacgccgaacugcucguggcacuugagaaccaacauacgaucgaucugaccgacagugaaaugaauaaguuguucgagaaaacaaagaaacagcuacgagaaaacgcugaggauaugggcaauggaugcuuuaagauuuaccacaagugugacaacgccugcaucggcuccauuagaaaugggacuuaugaucaugacguauacagggacgaggcucugaacaaucgguuccagaucaaaggaguggaacucaagagcgguuacaaagauuggauacuguggaucucuuuugccauuucaugcuuccuucugugugucgcauugcucggcuuuaucaugugggccugccagaaggggaacauucgcuguaauaucugcauauga

SEQ ID NO: 134222 - RNA, 1701 nt, Artificial Sequence; identical to SEQ ID NO: 132010
  derived and/or modified sequence opt3 from hemagglutinin__InfluenzaA__AHZ40381

SEQ ID NO: 134223 - RNA, 1701 nt, Artificial Sequence; identical to SEQ ID NO: 131899
  derived and/or modified sequence opt3 from hemagglutinin__InfluenzaA__AHZ40393

SEQ ID NO: 134224 - RNA, 1701 nt, Artificial Sequence; identical to SEQ ID NO: 131899
  derived and/or modified sequence opt3 from hemagglutinin__InfluenzaA__AHZ40405

SEQ ID NO: 134225 - RNA, 1701 nt, Artificial Sequence; identical to SEQ ID NO: 131899
  derived and/or modified sequence opt3 from hemagglutinin__InfluenzaA__AHZ40417

SEQ ID NO: 134226 - RNA, 1701 nt, Artificial Sequence
  derived and/or modified sequence opt3 from hemagglutinin__InfluenzaA__AHZ40429
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgaccaaaucgaagugacuaaugcgaccgagcugguacagucuucaaguacaggugaaauuugcaacagcccacaccagauccuagauggcgagaauuguacccucauagacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacucuggaguuuaaaaacgaguccuucaauuggacagguguuacccagaacgggacgucuagcgcuugcauccggcgcuccaauaacucauuuuucagucgacugaauuggcucacucacuuaaacuuuaaguacccagcacugaaugugaccaugcccaacaacgaacaguucgacaagcuguauauuuggggaguccaucacccuggcacagauaaagaccagaucuuuuuguacgcccaagcuagcggccguauuacugugucuaccaagagaucccagcaggccguaaucccaaauauagggucaaggccccggguucgcaacauuccuagcagagugaguaucuauuggacaauugucaaaccaggagauauccugcuaaucaauucuaccgguaaccucauugcgccgaggggcuacuucaagauacgguccgggaaaagcucgaucaugcgcucugacgcacccauuggaaaguguaauuccgccugcaucacgccuaacggcucaauaccaaaugacaagcccuuucagaacgugaaucgaauuacuuacggugcuuguccuagauaugugaaacaaaacacacugaaacuugccaccgggaugaggaaugucccagagaagcagacucggggaaucuucggcgcaaucgcuggcuuuauugaaaacgggugggagggaaugguugaugguugguacggcuuccgucaccagaauagugaggggcgcggacaagccgcggaccuuaagagcacacaggccgcaaucgaucagauuaacggcaaauugaauagacucauagguaagaccaacgaaaaauuccaucagaucgagaaggaauuuuccgagguggaagggaggauucaagaccuggagaaguauguagaggauacgaaaaucgacuuauggucuuacaacgcugaacugcucguggcccuugagaaucagcacaccaucgaucugacagacagcgaaaugaacaaguuguucgagaaaacuaagaaacagcuacgggaaaaugcugaggauaugggcaacggaugcuuuaagauuuaucauaagugugacaaugccugcauaggcucaauccgaaacgggaccuacgaucacgacgucuaucgcgacgaggcacugaauaacagauuccagauuaaaggaguggaacucaagagugguuacaaagauuggauccuguggauuuccuuugccaucagcugcuuccuucuguguguugcuuugcucggcuuuauaaugugggcgugccaaaaggggaauaucagguguaacauuugcaucuga

SEQ ID NO: 134227 - RNA, 1701 nt, Artificial Sequence; identical to SEQ ID NO: 131899
  derived and/or modified sequence opt3 from hemagglutinin__InfluenzaA__AHZ40441

SEQ ID NO: 134228 - RNA, 1701 nt, Artificial Sequence; identical to SEQ ID NO: 132042
  derived and/or modified sequence opt3 from hemagglutinin__InfluenzaA__AHZ40453

SEQ ID NO: 134229 - RNA, 1701 nt, Artificial Sequence
  derived and/or modified sequence opt3 from hemagglutinin__InfluenzaA__AHZ40465
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacaugccugauuacgcaucuuugcggucgcucgucgccucaagcggcacccuggaauuuaauaacgagaguuucaauuggacuggugugacacaaaacgggaccuccucugcuugcauucgccgaagcaauuccucauuuuucagucgucugaacuggcucacgcauuuaaauuuuaaguauccagcacugaacguuacuaugcccaacaaugagagauucgacaaacuuuacaucuggggagugcaccauccuggcaccgauaaagaccagaucuuuuuguaugcccagagcucuggcaggauuacagucuccacuaagcggucacagcaagcugugauaccaaacauugggagccgccccagaaucaggaauauuccuagucggaucucuaucuacuggaccauuguaaaaccaggagauauacugcuaaucaacuccacagguaaucucauugccccgcgcggcuacuucaagauccgaagcgggaaaucgucuauaaugagauccgacgcgcccauuggaaaguguaagucagaaugcaucaccccuaacggcaguaucccaaaugacaaacccuuucagaacguuaauaggauuacguauggugcauguccucgguacgugaagcagagcacucugaaacuugccacagggaugcguaacgucccagagaagcagacccgcggaaucuucggcgcuauugccggcuuuauagaaaaugggugggagggaaugguggaugguugguauggcuucagacaccaaaacuccgaggggaggggacaggcagcugaccugaaaucuacucaggccgcgaucgaucaaauuaauggcaaguugaaccggcucaucgguaaaacaaaugaaaaguuccaccagaucgagaaggaauuuagcgagguggaagggcgcauucaggaccuggagaaauacgucgaggauaccaagauagacuuauggucauauaacgccgaacugcucguugcacuugagaaccagcauacgaucgaucugaccgacagugaaaugaauaaauuguucgagaagacaaagaagcaacuacgagaaaacgcugaggauaugggcaauggaugcuuuaagauuuaccacaaaugugacaacgccugcaucggcuccauuagaaaugggacuuaugaucauaacguguacagggacgaggcucugaauaaccgguuccagaucaagggaguagaacucaaaagcgguuacaaggacuggauacuguggaucucuuuugccauuucaugcuuccuucuguguguggcauugcucggcuuuaucaugugggccugccagaaagggaauauucgcuguaacaucugcauauga

SEQ ID NO: 134230 - RNA, 1701 nt, Artificial Sequence; identical to SEQ ID NO: 131900
  derived and/or modified sequence opt3 from hemagglutinin__InfluenzaA__AHZ40477

SEQ ID NO: 134231 - RNA, 1701 nt, Artificial Sequence; identical to SEQ ID NO: 132076
  derived and/or modified sequence opt3 from hemagglutinin__InfluenzaA__AHZ40489

SEQ ID NO: 134232 - RNA, 1701 nt, Artificial Sequence; identical to SEQ ID NO: 131899
  derived and/or modified sequence opt3 from hemagglutinin__InfluenzaA__AHZ40500

SEQ ID NO: 134233 - RNA, 1701 nt, Artificial Sequence; identical to SEQ ID NO: 131899
  derived and/or modified sequence opt3 from hemagglutinin__InfluenzaA__AHZ40512

SEQ ID NO: 134234 - RNA, 1701 nt, Artificial Sequence
  derived and/or modified sequence opt3 from hemagglutinin__InfluenzaA__AHZ40524
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagcggcaaacacguggcaucuucggcgccauugcaggguuuauagaaaauggaugggaggguaugguggauggcugguauggguuccgccaccagaacuccgagggaagaggccaggcugccgaccugaagucuacccaagcggccaucgaucagauuaaugguaaauugaacaggcucaucgggaagacuaaugaaaaauuccaccagaucgagaaggaauuuagcgaggucgaaggccggauucaggaccuggagaaguacguugaggauacaaaaauagacuuauggucauauaacgcagaacugcucguggcucuugagaaccaacauaccaucgaucugacggacagugaaaugaauaaguuguucgagaaaaccaagaaacagcuacgagaaaacgccgaggauaugggaaauggcugcuuuaagauuuaccacaagugugacaacgcuugcaucggguccauucgcaauggaacauaugaucaugacguauacagagacgaggcccugaacaauagguuccagaucaaagguguggaacucaagagcggcuacaaagauuggauacuguggaucucuuuugcaauuucaugcuuccuucugugugucgccuugcucggguuuaucaugugggcuugccagaagggaaacauucgguguaauaucugcauauga

SEQ ID NO: 134235 - RNA, 1701 nt, Artificial Sequence; identical to SEQ ID NO: 133786
  derived and/or modified sequence opt3 from hemagglutinin__InfluenzaA__AHZ40536

SEQ ID NO: 134236 - RNA, 1701 nt, Artificial Sequence; identical to SEQ ID NO: 131899
  derived and/or modified sequence opt3 from hemagglutinin__InfluenzaA__AHZ40548

SEQ ID NO: 134237 - RNA, 1701 nt, Artificial Sequence; identical to SEQ ID NO: 131874
  derived and/or modified sequence opt3 from hemagglutinin__InfluenzaA__AHZ40572

SEQ ID NO: 134238 - RNA, 1701 nt, Artificial Sequence; identical to SEQ ID NO: 131874
  derived and/or modified sequence opt3 from hemagglutinin__InfluenzaA__AHZ40583

SEQ ID NO: 134239 - RNA, 1701 nt, Artificial Sequence
  derived and/or modified sequence opt3 from hemagglutinin__InfluenzaA__AHZ40595
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacgacgggaaacuguguaagcuaagaggaguggcuccccuccaucuggguaaaugcaauauagccggcuggauccuugggaacccugagugugaaucucugucaacagcaaguagcugguccuacauuguugagaccucuggaucggauaauggcacuugcuauccaggugacuuuaucgauuacgaagaguugagggagcagcucucaagcgugaguuccuucgaacgguuugagauuuucccgaagacaucuagcuggcccaaccacgacuccaauaagggggucaccgccgcuuguccucaugcaggagccaaaggcuuuuauaagaaccugaucuggcuggugaaaaagggcaauucauacccaaaacucaguauaagcuauaucaacgauaaggggaaggaaguauuaguucugugggguauucaccaccccucuacgacugcugaccaacagucccuuuaccagaaugccgauaccuacguguucgucggaacaucacgcuauagcaaaaaguuuaaaccugagaucgcgauucgaccaaaggugcgugaccaggagggcagaaugaacuacuauuggacuuugguggaacccggggauaaaaucaccuucgaggcaacaggaaaucuggucguuccuagguacgccuuugcuaugaagcggaacgccggcagugguauaauuaucucugacaccccagugcaugacugcaacacgacuugucaaacaccgaaaggggcaauuaauaccucccuacccuuccagaacauccacccuaucacuauuggaaagugcccaaaguauguaaaaagcacaaagcuccgccuggcuaccggccuuagaaaugugcccucgauacagucuaggggccuguuuggggccaucgcgggauucauugaagguggcuggacggggauggucgauggaugguacggcuaucaucaccagaacgagcaagguuccggguacgccgcagacuugaaaucaacccagaaugcuaucgauaagauaacaaacaaagugaauaguguuauugaaaagaugaacacucaguuuaccgccgugggcaaggaguucaaucaccucgagaaacggaucgaaaaccugaauaagaaagucgacgauggauucuuagacaucuggacauacaacgcugagcugcucgugcuucuggaaaaugagcgcacuuuggauuaucaugacagcaacguaaagaaucuauacgaaaaaguucgaaaccagcugaagaacaaugccaaggagauuggcaacggguguuuugaguucuaucacaaaugcgauaauaccuguauggaauccgugaagaacggaacauacgacuauccuaaauacucugaggaagcaaagcucaauagagagaaaaucgauggugucaagcuggaaagcaccaggauuuaucaaauacuugccaucuacucaacugcugcgaguucccugguguuggucgugagccucggcgcaauuucuuuuuggaugugcucaaacgggagucugcagugccggaucuguaucuga

SEQ ID NO: 134240 - RNA, 1701 nt, Artificial Sequence
  derived and/or modified sequence opt3 from hemagglutinin__InfluenzaA__AHZ40606
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugauggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgagguggaagggcggauucaggaccuggagaaauacgucgaggauaccaagauagacuuauggucauauaacgccgaacugcucguugcacuugagaaccaacauacgaucgaucugaccgacagugaaaugaauaaauuguucgagaagacaaagaagcagcuacgagaaaacgcugaggauaugggcaauggaugcuuuaagauuuaccacaaaugugacaacgccugcaucggcuccauucgcaaugggacuuaugaucaugacguguacagagacgaggcucugaacaauagguuccagaucaagggaguagaacucaaaagcgguuacaaggauuggauacuguggaucucuuuugccauuucaugcuuccuucuguguguggcauugcucggcuuuaucaugugggccugccagaaagggaacauucgguguaauaucugcauauga

SEQ ID NO: 134241 - RNA, 1701 nt, Artificial Sequence; identical to SEQ ID NO: 131899
  derived and/or modified sequence opt3 from hemagglutinin__InfluenzaA__AHZ40618

SEQ ID NO: 134242 - RNA, 1701 nt, Artificial Sequence; identical to SEQ ID NO: 131938
  derived and/or modified sequence opt3 from hemagglutinin__InfluenzaA__AHZ40626

SEQ ID NO: 134243 - RNA, 1701 nt, Artificial Sequence; identical to SEQ ID NO: 131899
  derived and/or modified sequence opt3 from hemagglutinin__InfluenzaA__AHZ40638

SEQ ID NO: 134244 - RNA, 1701 nt, Artificial Sequence; identical to SEQ ID NO: 131874
  derived and/or modified sequence opt3 from hemagglutinin__InfluenzaA__AHZ40650

SEQ ID NO: 134245 - RNA, 1701 nt, Artificial Sequence
  derived and/or modified sequence opt3 from hemagglutinin__InfluenzaA__AHZ40662
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgacagaaucgaagugacuaaugcgaccgagcugguacaaucuucaaguacaggugaaauuugcaacagcccacaccagauccuagauggcgagaauuguacccucauagacgcucugcuuggggauccgcagugcgacggauuucagaacaagaaaugggaucuguucguggaaagguccaaggcccauucuaauuguuaucccuacgacgucccugauuaugcaucguugcggucacucguggccagcaguggcacucuggaguuuaacaaugaguccuucaacuggacagguguuacccaaaaugggacgucuagcgcuugcauccgccgauccaacaauucauuuuucagucgucugaacuggcucacucacuuaaauuuuaaauacccagcacugaacgugaccauucccaacaaugaacaguucgacaaguuguauaucuggggaguccaucacccuggcacagauaaggaccagauuuuucuuuacgcccaggcuagcggcagaaucacugugucuaccaaaaggucccaacagacaguaauaccaaacauugggucacggccccgcguuagaaauaucccuagcagggugaguauuuauuggaccaucgucaagccaggagauauccugcuaauuaacucuacggguaaucucauagccccgcggggcuacuucaaaauccgcuccggaaagagcucgauuaugcgaucugacgcgcccaucgggaaauguaacuccgcaugcauaacuccuaauggcucaauuccaaacgacaagcccuuucagaaugugaacagaaucacauacggugccuguccuagguaugugaagcagaauacccugaaacuugcuacugggaugcggaacgucccagagaagcaaacacguggaaucuucggcgccauugcaggcuuuaucgaaaaugggugggagggaaugguugaugguugguacggcuuccgccaccagaacagugaggggagaggacaggcugccgaccugaaaagcacccaagcggccauugaucagauaaauggcaaguugaacaggcucaucgguaaaacgaacgaaaaguuccaucagauugagaaagaauuuuccgagguggaagggcggauccaggaccuggagaaguauguagaggauaccaagaucgacuuauggucuuacaaugcagaacugcucguggcucuugagaaccaacacacaauugaucugacugacagcgaaaugaauaaauuguucgagaagaccaaaaagcagcuacgagaaaacgccgaggauaugggcaauggaugcuuuaaaauauaucauaagugugacaacgcuugcaucggcucaauucgcaaugggacauacgaucacgacgucuauagagacgaggcccugaacaauagguuccagaucaagggaguggaacucaaaagugguuacaaggauuggauucuguggaucuccuuugcaauaagcugcuuccuucuguguguugccuugcucggcuuuaucaugugggcuugccagaaagggaacauucgguguaauaucugcauuuga

SEQ ID NO: 134246 - RNA, 1701 nt, Artificial Sequence; identical to SEQ ID NO: 131919
  derived and/or modified sequence opt3 from hemagglutinin__InfluenzaA__AHZ40674

SEQ ID NO: 134247 - RNA, 1701 nt, Artificial Sequence; identical to SEQ ID NO: 131899
  derived and/or modified sequence opt3 from hemagglutinin__InfluenzaA__AHZ40686

SEQ ID NO: 134248 - RNA, 1701 nt, Artificial Sequence; identical to SEQ ID NO: 131884
  derived and/or modified sequence opt3 from hemagglutinin__InfluenzaA__AHZ40698

SEQ ID NO: 134249 - RNA, 1701 nt, Artificial Sequence; identical to SEQ ID NO: 131884
  derived and/or modified sequence opt3 from hemagglutinin__InfluenzaA__AHZ40710

SEQ ID NO: 134250 - RNA, 1701 nt, Artificial Sequence; identical to SEQ ID NO: 132010
  derived and/or modified sequence opt3 from hemagglutinin__InfluenzaA__AHZ40722

SEQ ID NO: 134251 - RNA, 1701 nt, Artificial Sequence; identical to SEQ ID NO: 131907
  derived and/or modified sequence opt3 from hemagglutinin__InfluenzaA__AHZ40734

SEQ ID NO: 134252 - RNA, 1701 nt, Artificial Sequence; identical to SEQ ID NO: 132010
  derived and/or modified sequence opt3 from hemagglutinin__InfluenzaA__AHZ40746

SEQ ID NO: 134253 - RNA, 1701 nt, Artificial Sequence; identical to SEQ ID NO: 134203
  derived and/or modified sequence opt3 from hemagglutinin__InfluenzaA__AHZ40758

SEQ ID NO: 134254 - RNA, 1701 nt, Artificial Sequence; identical to SEQ ID NO: 124683
  derived and/or modified sequence opt3 from hemagglutinin__InfluenzaA__AHZ40782

SEQ ID NO: 134255 - RNA, 1701 nt, Artificial Sequence; identical to SEQ ID NO: 124683
  derived and/or modified sequence opt3 from hemagglutinin__InfluenzaA__AHZ40793

SEQ ID NO: 134256 - RNA, 1701 nt, Artificial Sequence; identical to SEQ ID NO: 124683
  derived and/or modified sequence opt3 from hemagglutinin__InfluenzaA__AHZ40804

SEQ ID NO: 134257 - RNA, 1701 nt, Artificial Sequence
  derived and/or modified sequence opt3 from hemagglutinin__InfluenzaA__AHZ40815
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaggagcucagggagcagcugucaagcgugaguuccuucgaacgguuugagauuuuccccaagacaucuagcuggccuaaucacgauuccaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaguucucgcuauuccaagaaauuuaagccagagauugcaauccgacccaaagugcgugauagagagggaaggaugaauuacuauuggacucugguggaaccuggugacaagauuaccuucgaggccacaggcaaccuagucguuccacgguacgcuuuugccauggaacgcaacgcagggagcggaaucauaauuucggauacuccggugcaugacugcaauaccacaugucagacccccaaaggcgcuaucaacacgucucucccuuuccaaaauauucacccaaucacuaucgguaagugccccaaguauguaaaauccacaaagcugagacuugccaccgggcugaggaacauuccuucaauacagagucggggauuguuuggcgcgaucgccggcuucauugaagggggauggacugguaugguggacggcugguacggguaucaucaccagaaugaacagggaagcggcuacgcagcugaucucaaauccacacaaaacgccaucgacgagauaaccaauaaggucaacucugugauugagaaaaugaauacgcaguuuaccgcuguugguaaggaguucaaccaccuggaaaagcgcaucgaaaauuuaaacaaaaagguggaugacggguuccuggauaucuggacauacaaugccgagcuccuuguccuguuggaaaacgagcgaacucuagacuaucaugauagcaaugugaaaaaccuguacgagaagguaagaucacagcucaaaaacaaugcaaaggaaauuggcaacggauguuuugaguucuaucacaagugcgacaauaccuguauggaaaguguuaaaaacggcacauacgauuauccaaaguacuccgaggaagccaaacugaauagggaggagaucgacggggugaaacuugaaagcacucggauuuaucagauacuggcuaucuacucuaccgucgcgucaaguuuggugcucgucgugagccugggagcaauuuccuuuuggaugugcucuaacgguucguuacaaugccguaucuguaucuga

SEQ ID NO: 134258 - RNA, 1701 nt, Artificial Sequence
  derived and/or modified sequence opt3 from hemagglutinin__InfluenzaA__AHZ40826
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaggagcucagggagcagcugucaagcgugaguuccuucgaacgguuugagauuuuccccaagacaucuagcuggccuaaucacgauuccaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcauuuaccagaacgccgacgcguacguguucgucgggaguucucgcuauuccaagaaauuuaagccagagaucgcaauucgacccaaagugcgugaucaggagggaagaaugaauuacuauuggacuuugguggaaccuggugacaagaucaccuucgaggccacaggcaaccuggucguuccaagguacgcuuuugccauggaacggaacgcagggagcggaauaauuaucucggauacuccggugcaugacugcaauaccacaugucaaacccccaaaggcgcuauuaacacgucucuaccuuuccagaauauccacccaaucacuauugguaagugccccaaguauguaaaauccacaaagcuccgccuggccaccgggcuuagaaacauaccuucaauccagaguaggggacuguuuggcgcgauugccggcuucaucgaagggggauggacugguaugguggacggcugguacggguaucaucaccagaaugaacaaggaagcggcuacgcagcugauuugaaauccacacagaacgccauagacgagauuaccaauaaggucaacucugugaucgagaaaaugaauacgcaguuuaccgcuguugguaaggaguucaaccaccucgaaaagcggaucgaaaaucugaacaaaaagguggaugacggguucuuagauauuuggacauacaaugccgagcugcucguccuucuggaaaacgagcgcacuuuggacuaucaugauagcaaugugaaaaaccuauacgagaagguacgaucacagcugaaaaacaaugcaaaggaaaucggcaacggauguuuugaguucuaucacaagugcgacaauaccuguauggaaaguguuaaaaacggcacauacgauuauccaaaguacuccgaggaagccaaacucaauagagaggagauugacggggugaagcuggaaagcacuaggauauaucaaauccuugcuauuuacucuaccgucgcgucaagucugguguuggucgugagccucggagcaaucuccuuuuggaugugcucuaacgguucgcugcagugccggaucuguauuuga

SEQ ID NO: 134259 - RNA, 1701 nt, Artificial Sequence
  derived and/or modified sequence opt3 from hemagglutinin__InfluenzaA__AHZ40848
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaagaacucagggagcagcugucaagcgugaguuccuucgaacgguuugagauuuuccccaagacaucuagcuggccuaaucacgauuccaacaagggugucaccgccgcuuguccacaugcaggggccaaaucauuuuauaagaaucugaucuggcucgugaaagaaggaaacaguuaccccaaguuaagcaaaucuuauauaaaugacaagggcaaggagguacugguucuuuggggcauccaccacccuuccacgucagcugagcaacagagcuuguaccagaacgccgaugcguacguguucgucgggaguucucgcuauuccaaaaaguuuaaaccagaaauugcagcccgacccaaggugcguggacaggcugguagaaugaauuacuauuggacucugguggagccuggcgacaaaaucaccuucgaagccacagggaaccuagucguuccaagguacgcauuugcuauggagcggaacgccggaagcggcauuaucauaucggauacuccggugcaugacugcaauaccacaugucaaacccccaagggugcgauuaacacgucucucccuuuccagaauauccacccaauuacuaucgggaaaugccccaaguauguaaaguccacaaaacugcgccuugccaccggacugagaaacaucccuucaauucagaguaggggcuuguuuggcgcaauagcuggguucaucgaaggagguuggacuggcaugguggaugggugguacggauaucaucaccagaaugagcaaggcagcgguuacgccgcugaccucaaguccacacagaacgccauugacgagaucaccaauaaagucaacucugugauagaaaagaugaauacgcaguuuaccgcaguugggaaagaguucaaccaccuggaaaagcggauugagaauuuaaacaagaaaguggaugacggcuuccuggauaucuggacauacaaugccgaacuccuuguccuguuggagaacgagcgcacucuagacuaucaugauagcaaugugaagaaccuguacgaaaaaguacgaucacagcucaagaacaaugcuaaagagaucggaaacggcuguuuugaguucuaucacaagugcgacaauaccuguauggagaguguuaagaacgggacauacgauuauccaaaauacuccgaagaggcgaagcugaauagagaggaaauugacggagugaaacuugagagcacuaggaucuaucaaauucuggcaauauacucuaccgucgccucaaguuuggugcucgucgugagccugggugcuaucuccuuuuggaugugcucuaacggcucguuacagugccggauuuguaucuga

SEQ ID NO: 134260 - RNA, 1701 nt, Artificial Sequence
  derived and/or modified sequence opt3 from hemagglutinin__InfluenzaA__AHZ40881
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaagaacucagggagcagcugucaagcgugaguuccuucgaacgguuugagauuuuccccaagacaucuagcuggccuaaucacgauuccaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugagcaacagagcuuguaccagaacgccgaugcguacguguucgucgggaguucucgcuauuccaagaaauuuaagccagagauugcagcccgacccaaagugcguggacaggcugguagaaugaauuacuauuggacucugguggaaccuggcgacaagaucaccuucgaggccacagggaaccuagucguuccaagguacgcauuugcuauggaacggaacgccggaagcggcauuaucauaucggauacuccggugcaugacugcaauaccacaugucaaacccccaaaggugcgauuaacacgucucucccuuuccagaauauccacccaauuacuaucgggaagugccccaaguauguaaaauccacaaagcugcgccuugccaccggacugagaaacaucccuucaauucagaguaggggcuuguuuggcgcaauagcuggguucaucgagggagguuggacuggcaugguggaugggugguacggauaucaucaccagaaugaacaaggcagcgguuacgccgcugaccucaaauccacacagaacgccauugacgagaucaccaauaaggucaacucugugauagagaaaaugaauacgcaguuuaccgcaguugggaaggaguucaaccaccuggagaagcggauugaaaauuuaaacaaaaagguggaugacggcuuccuggauaucuggacauacaaugccgagcuccuuguccuguuggaaaacgagcgcacucuagacuaucaugauagcaaugugaaaaaccuguacgagaagguacgaucacagcucaaaaacaaugcuaaggaaaucggaaacggcuguuuugaguucuaucacaagugcgacaauaccuguauggaaaguguuaaaaacgggacauacgauuauccaaaguacuccgaggaagcgaaacugaauagagaggagauugacggagugaaacuugaaagcacuaggaucuaucaaauucuggcaauauacucuaccgucgccucaaguuuggugcucgucgugagccugggugcuaucuccuuuuggaugugcucuaacggcucguuacagugccggauuuguaucuga

SEQ ID NO: 134261 - RNA, 1701 nt, Artificial Sequence; identical to SEQ ID NO: 134260
  derived and/or modified sequence opt3 from hemagglutinin__InfluenzaA__AHZ40892

SEQ ID NO: 134262 - RNA, 1701 nt, Artificial Sequence; identical to SEQ ID NO: 134259
  derived and/or modified sequence opt3 from hemagglutinin__InfluenzaA__AHZ40914

SEQ ID NO: 134263 - RNA, 1701 nt, Artificial Sequence; identical to SEQ ID NO: 134260
  derived and/or modified sequence opt3 from hemagglutinin__InfluenzaA__AHZ40925

SEQ ID NO: 134264 - RNA, 1701 nt, Artificial Sequence
  derived and/or modified sequence opt3 from hemagglutinin__InfluenzaA__AHZ40936
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaggagcucagggagcagcugucaagcgugaguuccuucgaacgguuugagauuuuccccaagacaucuagcuggccuaaucacgauuccaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugagcaacagagcuuguaccagaacgccgaugcguacguguucgucgggaguucucgcuauuccaagaaauuuaagccagagauugcagcccgacccaaagugcgugaccaggcuggaagaaugaauuacuauuggacucugguggaaccuggugauaagaucaccuucgaggccacaggcaaccuagucguuccaagguacgcauuugcuauggaacggaacgccgggagcggaauuaucauaucggacacuccggugcaugauugcaauaccacaugucaaacccccaaaggcgcgauuaacacgucucucccuuuccagaauauccacccaauuacuaucgguaagugccccaaguauguaaaauccacaaagcugcgccuugccaccgggcugagaaacaucccuucaauucagaguaggggauuguuuggcgcaauagcuggcuucaucgaagggggauggacugguaugguggacggcugguacggguaucaucaccagaaugaacaaggaagcggcuacgccgcugaccucaaauccacacagaacgccauugaugagaucaccaauaaggucaacucugugauagagaaaaugaauacgcaguuuaccgcaguugguaaggaguucaaccaccuggaaaagcggauugaaaauuuaaacaaaaagguggacgauggguuccuggacaucuggacauacaaugccgagcuccuuguccuguuggaaaacgagcgcacucuagauuaucaugacagcaaugugaaaaaccuguacgagaagguacgaucacagcucaaaaacaaugcuaaggaaaucggcaacggauguuuugaguucuaucacaagugcgauaauaccuguauggaaaguguuaaaaacggcacauacgacuauccaaaguacuccgaggaagcgaaacugaauagagaggagauugauggggugaaacuugaaagcacuaggaucuaucaaauucuggcaauauacucuaccgucgccucaaguuuggugcucgucgugagccugggagcuaucuccuuuuggaugugcucuaacgguucguuacagugccggauuuguaucuga

SEQ ID NO: 134265 - RNA, 1701 nt, Artificial Sequence; identical to SEQ ID NO: 134259
  derived and/or modified sequence opt3 from hemagglutinin__InfluenzaA__AHZ40947

SEQ ID NO: 134266 - RNA, 1701 nt, Artificial Sequence; identical to SEQ ID NO: 134260
  derived and/or modified sequence opt3 from hemagglutinin__InfluenzaA__AHZ40958

SEQ ID NO: 134267 - RNA, 1701 nt, Artificial Sequence; identical to SEQ ID NO: 134264
  derived and/or modified sequence opt3 from hemagglutinin__InfluenzaA__AHZ40969

SEQ ID NO: 134268 - RNA, 1701 nt, Artificial Sequence; identical to SEQ ID NO: 134264
  derived and/or modified sequence opt3 from hemagglutinin__InfluenzaA__AHZ40980

SEQ ID NO: 134269 - RNA, 1701 nt, Artificial Sequence; identical to SEQ ID NO: 134264
  derived and/or modified sequence opt3 from hemagglutinin__InfluenzaA__AHZ40991

SEQ ID NO: 134270 - RNA, 1701 nt, Artificial Sequence; identical to SEQ ID NO: 134264
  derived and/or modified sequence opt3 from hemagglutinin__InfluenzaA__AHZ41002

SEQ ID NO: 134271 - RNA, 1701 nt, Artificial Sequence; identical to SEQ ID NO: 134264
  derived and/or modified sequence opt3 from hemagglutinin__InfluenzaA__AHZ41013

SEQ ID NO: 134272 - RNA, 1701 nt, Artificial Sequence; identical to SEQ ID NO: 134260
  derived and/or modified sequence opt3 from hemagglutinin__InfluenzaA__AHZ41024

SEQ ID NO: 134273 - RNA, 1701 nt, Artificial Sequence; identical to SEQ ID NO: 134260
  derived and/or modified sequence opt3 from hemagglutinin__InfluenzaA__AHZ41035

SEQ ID NO: 134274 - RNA, 1701 nt, Artificial Sequence; identical to SEQ ID NO: 134260
  derived and/or modified sequence opt3 from hemagglutinin__InfluenzaA__AHZ41046

SEQ ID NO: 134275 - RNA, 1701 nt, Artificial Sequence; identical to SEQ ID NO: 134260
  derived and/or modified sequence opt3 from hemagglutinin__InfluenzaA__AHZ41057

SEQ ID NO: 134276 - RNA, 1701 nt, Artificial Sequence; identical to SEQ ID NO: 134260
  derived and/or modified sequence opt3 from hemagglutinin__InfluenzaA__AHZ41068

SEQ ID NO: 134277 - RNA, 1701 nt, Artificial Sequence; identical to SEQ ID NO: 134264
  derived and/or modified sequence opt3 from hemagglutinin__InfluenzaA__AHZ41079

SEQ ID NO: 134278 - RNA, 1701 nt, Artificial Sequence; identical to SEQ ID NO: 134260
  derived and/or modified sequence opt3 from hemagglutinin__InfluenzaA__AHZ41090

SEQ ID NO: 134279 - RNA, 1701 nt, Artificial Sequence; identical to SEQ ID NO: 134264
  derived and/or modified sequence opt3 from hemagglutinin__InfluenzaA__AHZ41101

SEQ ID NO: 134280 - RNA, 1701 nt, Artificial Sequence; identical to SEQ ID NO: 134260
  derived and/or modified sequence opt3 from hemagglutinin__InfluenzaA__AHZ41112

SEQ ID NO: 134281 - RNA, 1701 nt, Artificial Sequence; identical to SEQ ID NO: 134260
  derived and/or modified sequence opt3 from hemagglutinin__InfluenzaA__AHZ41123

SEQ ID NO: 134282 - RNA, 1701 nt, Artificial Sequence; identical to SEQ ID NO: 134260
  derived and/or modified sequence opt3 from hemagglutinin__InfluenzaA__AHZ41134

SEQ ID NO: 134283 - RNA, 1701 nt, Artificial Sequence; identical to SEQ ID NO: 134260
  derived and/or modified sequence opt3 from hemagglutinin__InfluenzaA__AHZ41145

SEQ ID NO: 134284 - RNA, 1701 nt, Artificial Sequence; identical to SEQ ID NO: 134260
  derived and/or modified sequence opt3 from hemagglutinin__InfluenzaA__AHZ41156

SEQ ID NO: 134285 - RNA, 1701 nt, Artificial Sequence; identical to SEQ ID NO: 134260
  derived and/or modified sequence opt3 from hemagglutinin__InfluenzaA__AHZ41167

SEQ ID NO: 134286 - RNA, 1701 nt, Artificial Sequence; identical to SEQ ID NO: 134260
  derived and/or modified sequence opt3 from hemagglutinin__InfluenzaA__AHZ41178

SEQ ID NO: 134287 - RNA, 1701 nt, Artificial Sequence; identical to SEQ ID NO: 134260
  derived and/or modified sequence opt3 from hemagglutinin__InfluenzaA__AHZ41189

SEQ ID NO: 134288 - RNA, 1701 nt, Artificial Sequence; identical to SEQ ID NO: 134259
  derived and/or modified sequence opt3 from hemagglutinin__InfluenzaA__AHZ41246

SEQ ID NO: 134289 - RNA, 1701 nt, Artificial Sequence; identical to SEQ ID NO: 134264
  derived and/or modified sequence opt3 from hemagglutinin__InfluenzaA__AHZ41263

SEQ ID NO: 134290 - RNA, 1701 nt, Artificial Sequence; identical to SEQ ID NO: 134260
  derived and/or modified sequence opt3 from hemagglutinin__InfluenzaA__AHZ41281

SEQ ID NO: 134291 - RNA, 1701 nt, Artificial Sequence; identical to SEQ ID NO: 134260
  derived and/or modified sequence opt3 from hemagglutinin__InfluenzaA__AHZ41292

SEQ ID NO: 134292 - RNA, 1701 nt, Artificial Sequence; identical to SEQ ID NO: 134259
  derived and/or modified sequence opt3 from hemagglutinin__InfluenzaA__AHZ41303

SEQ ID NO: 134293 - RNA, 1701 nt, Artificial Sequence; identical to SEQ ID NO: 134259
  derived and/or modified sequence opt3 from hemagglutinin__InfluenzaA__AHZ41314

SEQ ID NO: 134294 - RNA, 1701 nt, Artificial Sequence; identical to SEQ ID NO: 134259
  derived and/or modified sequence opt3 from hemagglutinin__InfluenzaA__AHZ41325

SEQ ID NO: 134295 - RNA, 1701 nt, Artificial Sequence; identical to SEQ ID NO: 134259
  derived and/or modified sequence opt3 from hemagglutinin__InfluenzaA__AHZ41336

SEQ ID NO: 134296 - RNA, 1701 nt, Artificial Sequence; identical to SEQ ID NO: 134259
  derived and/or modified sequence opt3 from hemagglutinin__InfluenzaA__AHZ41347

SEQ ID NO: 134297 - RNA, 1701 nt, Artificial Sequence; identical to SEQ ID NO: 134260
  derived and/or modified sequence opt3 from hemagglutinin__InfluenzaA__AHZ41358

SEQ ID NO: 134298 - RNA, 1701 nt, Artificial Sequence; identical to SEQ ID NO: 134260
  derived and/or modified sequence opt3 from hemagglutinin__InfluenzaA__AHZ41366

SEQ ID NO: 134299 - RNA, 1701 nt, Artificial Sequence; identical to SEQ ID NO: 134264
  derived and/or modified sequence opt3 from hemagglutinin__InfluenzaA__AHZ41377

SEQ ID NO: 134300 - RNA, 1701 nt, Artificial Sequence; identical to SEQ ID NO: 134260
  derived and/or modified sequence opt3 from hemagglutinin__InfluenzaA__AHZ41388

SEQ ID NO: 134301 - RNA, 1701 nt, Artificial Sequence; identical to SEQ ID NO: 134264
  derived and/or modified sequence opt3 from hemagglutinin__InfluenzaA__AHZ41410

SEQ ID NO: 134302 - RNA, 1701 nt, Artificial Sequence; identical to SEQ ID NO: 134260
  derived and/or modified sequence opt3 from hemagglutinin__InfluenzaA__AHZ41432

SEQ ID NO: 134303 - RNA, 1701 nt, Artificial Sequence
  derived and/or modified sequence opt3 from hemagglutinin__InfluenzaA__AHZ41441
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaagaacucagggagcagcugucaagcgugaguuccuucgaacgguuugagauuuuccccaagacaucuagcuggccuaaucacgauuccaacaagggugucaccgccgcuuguccacaugcaggggccaaaucauuuuauaagaaucugaucuggcucgugaaagaaggaaacaguuaccccaaguuaagcaaaucuuauauaaaugacaagggcaaggagguacugguucuuuggggcauccaccacccuuccacgucagcugagcaacagagcuuguaccagaacgccgaugcguacguguucgucgggaguucucgcuauuccaaaaaguuuaaaccagaaauugcagcccgacccaaggugcgugaccaggcuggaagaaugaauuacuauuggacucugguggagccuggugauaaaaucaccuucgaagccacaggcaaccuagucguuccaagguacgcauuugcuauggagcggaacgccgggagcggaauuaucauaucggacacuccggugcaugauugcaauaccacaugucaaacccccaagggcgcgauuaacacgucucucccuuuccagaauauccacccaauuacuaucgguaaaugccccaaguauguaaaguccacaaaacugcgccuugccaccgggcugagaaacaucccuucaauucagaguaggggauuguuuggcgcaauagcuggcuucaucgaagggggauggacugguaugguggacggcugguacggguaucaucaccagaaugagcaaggaagcggcuacgccgcugaccucaaguccacacagaacgccauugaugagaucaccaauaaagucaacucugugauagaaaagaugaauacgcaguuuaccgcaguugguaaagaguucaaccaccuggaaaagcggauugagaauuuaaacaagaaaguggacgauggguuccuggacaucuggacauacaaugccgaacuccuuguccuguuggagaacgagcgcacucuagauuaucaugacagcaaugugaagaaccuguacgaaaaaguacgaucacagcucaagaacaaugcuaaagagaucggcaacggauguuuugaguucuaucacaagugcgauaauaccuguauggagaguguuaagaacggcacauacgacuauccaaaauacuccgaagaggcgaagcugaauagagaggaaauugauggggugaaacuugagagcacuaggaucuaucaaauucuggcaauauacucuaccgucgccucaaguuuggugcucgucgugagccugggagcuaucuccuuuuggaugugcucuaacgguucguuacagugccggauuuguaucuga

SEQ ID NO: 134304 - RNA, 1701 nt, Artificial Sequence; identical to SEQ ID NO: 134259
  derived and/or modified sequence opt3 from hemagglutinin__InfluenzaA__AHZ41452

SEQ ID NO: 134305 - RNA, 1701 nt, Artificial Sequence
  derived and/or modified sequence opt3 from hemagglutinin__InfluenzaA__AHZ41463
augaaggccauccuggugguccuccuuuacaccuucgcuacagcaaacgccgacacucugugcauuggcuaucacgcgaauaacagcacggauaccguuuacacaguguuggagaagaauguaacugugacccauuccgucaacuuacuggaagacaagcacaaugggaaacuauguaagcucagaggaguggcuccccugcaucuugguaaaugcaacauagccggcuggauccuggggaauccugagugugaaucuuugucaacagcaaguagcugguccuauauuguugagaccccaucuucggauaacggaacuugcuacccgggcgacuuuaucgauuaugaagaacucagggagcagcugucaagcgugaguuccuucgaacgguuugagauuuuccccaagacaucuagcuggccuaaucacgacuccaacaagggugucaccgccgcuuguccacaugcaggggccaaaucauuuuacaagaaucugaucuggcucgugaaaaagggaaacaguuaucccaaauuaagcaagucuuacauaaaugauaagggcaaagaaguacugguucuuuggggcauccaccacccuuccacgucagcugagcaacagagcuuguaccagaacgccgacgcguauguguucgucgggaguucucgcuacuccaagaaauuuaagccagagauugcagcccgacccaaagugcguggacaggcugguagaaugaauuauuacuggacucugguggaaccuggcgauaagaucaccuucgaggccacagggaaccuagucguuccaagguaugcauuugcuauggaacggaacgccggaagcggcauuaucauaucggacacuccggugcaugauugcaauaccacaugucaaacccccaaaggugcgauuaacacgucucucccuuuccagaauauccacccaauuacuaucgggaagugccccaaguacguaaaauccacaaagcugcgccuugccaccggacugagaaacaucccuucaauucagaguaggggcuuguuuggcgcaauagcuggguucaucgagggagguuggacuggcaugguggacgggugguauggauaccaucaccagaaugaacaaggcagcgguuacgccgcugaucucaaauccacacagaacgccauugacgagaucaccaauaaggucaacucugugauagagaaaaugaauacgcaguuuaccgcaguugggaaggaguucaaccaccuggagaagcggauugaaaauuuaaacaaaaagguggacgauggcuuccuggacaucuggacauauaaugccgagcuccuuguccuguuggaaaacgagcgcacucuagauuaccaugacagcaaugugaaaaaccuguaugagaagguacgaucacagcucaaaaacaaugcuaaggaaaucggaaacggcuguuuugaguucuaccacaagugcgauaauaccuguauggaaaguguuaaaaacgggacauaugacuacccaaaguauuccgaggaagcgaaacugaauagagaggagauugauggagugaaacuugaaagcacuaggaucuaccaaauucuggcaauauacucuaccgucgccucaaguuuggugcucgucgugagccugggugcuaucuccuuuuggaugugcucuaacggcucguuacagugccggauuuguaucuga

SEQ ID NO: 134306 - RNA, 1701 nt, Artificial Sequence; identical to SEQ ID NO: 134259
  derived and/or modified sequence opt3 from hemagglutinin__InfluenzaA__AHZ41473

SEQ ID NO: 134307 - RNA, 1701 nt, Artificial Sequence; identical to SEQ ID NO: 134259
  derived and/or modified sequence opt3 from hemagglutinin__InfluenzaA__AHZ41484

SEQ ID NO: 134308 - RNA, 1701 nt, Artificial Sequence; identical to SEQ ID NO: 134264
  derived and/or modified sequence opt3 from hemagglutinin__InfluenzaA__AHZ41495

SEQ ID NO: 134309 - RNA, 1701 nt, Artificial Sequence; identical to SEQ ID NO: 134259
  derived and/or modified sequence opt3 from hemagglutinin__InfluenzaA__AHZ41506

SEQ ID NO: 134310 - RNA, 1701 nt, Artificial Sequence
  derived and/or modified sequence opt3 from hemagglutinin__InfluenzaA__AHZ41517
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaagaacucagggagcagcugucaagcgugaguuccuucgaacgguuugagauuuuccccaagacaucuagcuggccuaaucacgauuccaacaagggugucaccgccgcuuguccacaugcaggggccaaaucauuuuauaagaaucugaucuggcucgugaaaaagggaaacaguuaccccaaauuaagcgaaucuuauauaaaugacaagggcaaggagguacugguucuuuggggcauccaccacccuuccacgucagcugagcaacagagcuuguaccagaacgccgaugcguacguguucgucgggaguucucgcuauuccaaaaaguuuaaaccagaaauugcagcccgacccaaggugcguggacaggcugguagaaugaauuacuauuggacucugguggagccuggcgacaaaaucaccuucgaagccacagggaaccuagucguuccaagguacgcauuugcuauggagcggaacgccggaagcggcauuaucauaucggauacuccggugcaugacugcaauaccacaugucaaacccccaagggugcgauuaacacgucucucccuuuccagaauauccacccaauuacuaucgggaaaugccccaaguauguaaaguccacaaaacugcgccuugccaccggacugagaaacaucccuucaauucagaguaggggcuuguuuggcgcaauagcuggguucaucgaaggagguuggacuggcaugguggaugggugguacggauaucaucaccagaaugagcaaggcagcgguuacgccgcugaccucaaguccacacagaacgccauugacgagaucaccaauaaagucaacucugugauagaaaagaugaauacgcaguuuaccgcaguugggaaagaguucaaccaccuggaaaagcggauugagaauuuaaacaagaaaguggaugacggcuuccuggauaucuggacauacaaugccgaacuccuuguccuguuggagaacgagcgcacucuagacuaucaugauagcaaugugaagaaccuguacgaaaaaguacgaucacagcucaagaacaaugcuaaagagaucggaaacggcuguuuugaguucuaucacaagugcgacaauaccuguauggagaguguuaagaacgggacauacgauuauccaaaauacuccgaagaggcgaagcugaauagagaggaaauugacggagugaaacuugagagcacuaggaucuaucaaauucuggcaauauacucuaccgucgccucaaguuuggugcucgucgugagccugggugcuaucuccuuuuggaugugcucuaacggcucguuacagugccggauuuguaucuga

SEQ ID NO: 134311 - RNA, 1701 nt, Artificial Sequence
  derived and/or modified sequence opt3 from hemagglutinin__InfluenzaA__AHZ41528
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaagaacucagggagcagcugucaagcgugaguuccuucgaacgguuugagauuuuccccaagacaucuagcuggccuaaucacgauuccaacaagggugucaccgccgcuuguccacaugcaggggccaaaucauuuuauaagaaucugaucuggcucgugaaaaagggaaacaguuaccccaaauuaagcgaaucuuauauaaaugacaagggcaaggagguacugguucuuuggggcauccaccacccuuccacgucagcugaucaacagagcuuguaccagaacgccgacgcguacguguucgucgggaguucucgcuauuccaaaaaguuuaaaccagagauugcagcccgacccaaggugcguggacaggcugguagaaugaauuacuauuggacucugguggaaccuggcgauaaaaucaccuucgaggccacagggaaccuagucguuccaagguacgcauuugcuauggaacggaacgccggaagcggcauuaucauaucggacacuccggugcaugauugcaauaccacaugucaaacccccaagggugcgauuaacacgucucucccuuuccagaauauccacccaauuacuaucgggaaaugccccaaguauguaaaguccacaaaacugcgccuugccaccggacugagaaacaucccuucaauucagaguaggggcuuguuuggcgcaauagcuggguucaucgagggagguuggacuggcaugguggacgggugguacggauaucaucaccagaaugaacaaggcagcgguuacgccgcugaccucaaguccacacagaacgccauugaugagaucaccaauaaagucaacucugugauagagaagaugaauacgcaguuuaccgcaguugggaaagaguucaaccaccuggagaagcggauugaaaauuuaaacaagaaaguggacgauggcuuccuggacaucuggacauacaaugccgagcuccuuguccuguuggaaaacgagcgcacucuagauuaucaugacagcaaugugaagaaccuguacgagaaaguacgaucacagcucaagaacaaugcuaaagaaaucggaaacggcuguuuugaguucuaucacaagugcgauaauaccuguauggaaaguguuaagaacgggacauacgacuauccaaaauacuccgaggaagcgaagcugaauagagaggagauugauggagugaaacuugaaagcacuaggaucuaucaaauucuggcaauauacucuaccgucgccucaaguuuggugcucgucgugagccugggugcuaucuccuuuuggaugugcucuaacggcucguuacagugccggauuuguaucuga

SEQ ID NO: 134312 - RNA, 1701 nt, Artificial Sequence; identical to SEQ ID NO: 134264
  derived and/or modified sequence opt3 from hemagglutinin__InfluenzaA__AHZ41539

SEQ ID NO: 134313 - RNA, 1701 nt, Artificial Sequence; identical to SEQ ID NO: 134259
  derived and/or modified sequence opt3 from hemagglutinin__InfluenzaA__AHZ41550

SEQ ID NO: 134314 - RNA, 1701 nt, Artificial Sequence; identical to SEQ ID NO: 134260
  derived and/or modified sequence opt3 from hemagglutinin__InfluenzaA__AHZ41561

SEQ ID NO: 134315 - RNA, 1701 nt, Artificial Sequence
  derived and/or modified sequence opt3 from hemagglutinin__InfluenzaA__AHZ41572
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaagaacucagggagcagcugucaagcgugaguuccuucgaacgguuugagauuuuccccaagacaucuagcuggccuaaucacgauuccaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugagcaacagagcuuguaccagaacgccgaugcguacguguucgucgggaguucucgcuauuccaagaaauuuaagccagagauugcagcccgacccaaagugcguggacaggcugguagaaugaauuacuauuggacucugguggaaccuggcgacgagaucaccuucgaagccacagggaaccuagucguuccaagguacgcauuugcuauggagcggaacgccggaagcggcauuaucauaucggauacuccggugcaugacugcaauaccacaugucaaacccccaagggugcgauuaacacgucucucccuuuccagaauauccacccaauuacuaucgggaaaugccccaaguauguaaaguccacaaaacugcgccuugccaccggacugagaaacaucccuucaauucagaguaggggcuuguuuggcgcaauagcuggguucaucgaaggagguuggacuggcaugguggaugggugguacggauaucaucaccagaaugagcaaggcagcgguuacgccgcugaccucaaguccacacagaacgccauugacgagaucaccaauaaagucaacucugugauagaaaagaugaauacgcaguuuaccgcaguugggaaagaguucaaccaccuggaaaagcggauugagaauuuaaacaagaaaguggaugacggcuuccuggauaucuggacauacaaugccgaacuccuuguccuguuggagaacgagcgcacucuagacuaucaugauagcaaugugaagaaccuguacgaaaaaguacgaucacagcucaagaacaaugcuaaagagaucggaaacggcuguuuugaguucuaucacaagugcgacaauaccuguauggagaguguuaagaacgggacauacgauuauccaaaauacuccgaagaggcgaagcugaauagagaggaaauugacggagugaaacuugagagcacuaggaucuaucaaauucuggcaauauacucuaccgucgccucaaguuuggugcucgucgugagccugggugcuaucuccuuuuggaugugcucuaacggcucguuacagugccggauuuguaucuga

SEQ ID NO: 134316 - RNA, 1701 nt, Artificial Sequence; identical to SEQ ID NO: 134264
  derived and/or modified sequence opt3 from hemagglutinin__InfluenzaA__AHZ41583

SEQ ID NO: 134317 - RNA, 1701 nt, Artificial Sequence; identical to SEQ ID NO: 134259
  derived and/or modified sequence opt3 from hemagglutinin__InfluenzaA__AHZ41594

SEQ ID NO: 134318 - RNA, 1701 nt, Artificial Sequence
  derived and/or modified sequence opt3 from hemagglutinin__InfluenzaA__AHZ41605
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaagaacucagggagcagcugucaagcgugaguuccuucgaacgguuugagauuuuccccaauacaucuagcuggccuaaccacgauuccaauaagggugucaccgccgcuuguccacaugcaggggccaagucauuuuauaaaaaccugaucuggcucgugaagaaaggaaauaguuaccccaaguuaagcaaaucuuauauaaacgacaagggcaaggaaguacugguucuuuggggcauccaccacccuuccacgucagcugagcaacagagcuuguaccagaaugccgaugcguacguguucgucgggaguucucgcuauuccaaaaaguuuaaaccagagauugcagcccgacccaaggugaugggacaggcuggucguaugaacuacuauuggacucugguggaaccuggcgacaaaaucaccuucgaggccacagggaaccuagucguuccaagauacgcauuugcuauggaaaggaaugccggaagcggcauuaucauaucggauacuccggugcaugacugcaacaccacaugucaaacccccaagggugcgauuaauacgucucucccuuuccagaacauccacccaauuacuaucgggaaaugccccaaguauguaaaguccacaaaacugcggcuugccaccggacugcgcaauaucccuucaauucagaguagaggcuuguuuggcgcaauagcuggguucaucgagggagguuggacuggcaugguggaugggugguacggauaucaucaccagaacgaacaaggcagcgguuacgccgcugaccucaaguccacacagaaugccauugacgagaucaccaacaaagucaauucugugauagagaagaugaacacgcaguuuaccgcaguugggaaagaguucaaucaccuggagaagaggauugaaaacuuaaauaagaaaguggaugacggcuuccuggauaucuggacauacaacgccgagcuccuuguccuguuggaaaaugagcggacucuagacuaucaugauagcaacgugaagaaccuguacgagaaaguacgcucacagcucaagaauaacgcuaaagaaaucggaaauggcuguuuugaguucuaucacaagugcgacaacaccuguauggaaaguguuaagaaugggacauacgauuauccaaaauacuccgaggaagcgaagcugaaccgagaggagauugacggagugaaacuugaaagcacuagaaucuaucaaauucuggcaauauacucuaccgucgccucaaguuuggugcucgucgugagccugggugcuaucuccuuuuggaugugcucuaauggcucguuacagugcaggauuuguaucuga

SEQ ID NO: 134319 - RNA, 1701 nt, Artificial Sequence; identical to SEQ ID NO: 134259
  derived and/or modified sequence opt3 from hemagglutinin__InfluenzaA__AHZ41616

SEQ ID NO: 134320 - RNA, 1701 nt, Artificial Sequence; identical to SEQ ID NO: 134264
  derived and/or modified sequence opt3 from hemagglutinin__InfluenzaA__AHZ41627

SEQ ID NO: 134321 - RNA, 1701 nt, Artificial Sequence; identical to SEQ ID NO: 134264
  derived and/or modified sequence opt3 from hemagglutinin__InfluenzaA__AHZ41638

SEQ ID NO: 134322 - RNA, 1701 nt, Artificial Sequence; identical to SEQ ID NO: 134260
  derived and/or modified sequence opt3 from hemagglutinin__InfluenzaA__AHZ41649

SEQ ID NO: 134323 - RNA, 1701 nt, Artificial Sequence; identical to SEQ ID NO: 134260
  derived and/or modified sequence opt3 from hemagglutinin__InfluenzaA__AHZ41660

SEQ ID NO: 134324 - RNA, 1701 nt, Artificial Sequence; identical to SEQ ID NO: 134264
  derived and/or modified sequence opt3 from hemagglutinin__InfluenzaA__AHZ41671

SEQ ID NO: 134325 - RNA, 1701 nt, Artificial Sequence; identical to SEQ ID NO: 134264
  derived and/or modified sequence opt3 from hemagglutinin__InfluenzaA__AHZ41682

SEQ ID NO: 134326 - RNA, 1701 nt, Artificial Sequence; identical to SEQ ID NO: 134264
  derived and/or modified sequence opt3 from hemagglutinin__InfluenzaA__AHZ41693

SEQ ID NO: 134327 - RNA, 1701 nt, Artificial Sequence; identical to SEQ ID NO: 134264
  derived and/or modified sequence opt3 from hemagglutinin__InfluenzaA__AHZ41704

SEQ ID NO: 134328 - RNA, 1701 nt, Artificial Sequence; identical to SEQ ID NO: 134264
  derived and/or modified sequence opt3 from hemagglutinin__InfluenzaA__AHZ41715

SEQ ID NO: 134329 - RNA, 1701 nt, Artificial Sequence; identical to SEQ ID NO: 134264
  derived and/or modified sequence opt3 from hemagglutinin__InfluenzaA__AHZ41726

SEQ ID NO: 134330 - RNA, 1701 nt, Artificial Sequence; identical to SEQ ID NO: 134264
  derived and/or modified sequence opt3 from hemagglutinin__InfluenzaA__AHZ41737

SEQ ID NO: 134331 - RNA, 1701 nt, Artificial Sequence; identical to SEQ ID NO: 134264
  derived and/or modified sequence opt3 from hemagglutinin__InfluenzaA__AHZ41748

SEQ ID NO: 134332 - RNA, 1701 nt, Artificial Sequence; identical to SEQ ID NO: 134264
  derived and/or modified sequence opt3 from hemagglutinin__InfluenzaA__AHZ41759

SEQ ID NO: 134333 - RNA, 1701 nt, Artificial Sequence; identical to SEQ ID NO: 132091
  derived and/or modified sequence opt3 from hemagglutinin__InfluenzaA__AHZ42561

SEQ ID NO: 134334 - RNA, 1701 nt, Artificial Sequence
  derived and/or modified sequence opt3 from hemagglutinin__InfluenzaA__AHZ42572
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgaggucgaagggcggauucaggaccuggagaaauacguugaggauaccaagauagacuuauggucauauaacgccgaacugcucguggcacuugagaaccaacauacgaucgaucugaccgacagugaaauggauaaauuguucgagaagacaaagaagcagcuacgagaaaaugcugaggacaugggcaacggaugcuuuaagauuuaccacaaaugugauaaugccugcaucggcuccauucgcaacgggacuuaugaccaugacguauacagagaugaggcucugaauaacagguuccagaucaagggaguggaacucaaaagcgguuacaaggacuggauacuguggaucucuuuugccauuucaugcuuccuucugugugucgcauugcucggcuuuaucaugugggccugccagaaagggaauauucgguguaacaucugcauauga

SEQ ID NO: 134335 - RNA, 1701 nt, Artificial Sequence; identical to SEQ ID NO: 133802
  derived and/or modified sequence opt3 from hemagglutinin__InfluenzaA__AHZ42584

SEQ ID NO: 134336 - RNA, 1701 nt, Artificial Sequence; identical to SEQ ID NO: 131899
  derived and/or modified sequence opt3 from hemagglutinin__InfluenzaA__AHZ42596

SEQ ID NO: 134337 - RNA, 1701 nt, Artificial Sequence; identical to SEQ ID NO: 132076
  derived and/or modified sequence opt3 from hemagglutinin__InfluenzaA__AHZ42608

SEQ ID NO: 134338 - RNA, 1701 nt, Artificial Sequence; identical to SEQ ID NO: 131899
  derived and/or modified sequence opt3 from hemagglutinin__InfluenzaA__AHZ42619

SEQ ID NO: 134339 - RNA, 1701 nt, Artificial Sequence
  derived and/or modified sequence opt3 from hemagglutinin__InfluenzaA__AHZ42631
augaagaccaucauugcccugagcuacauacucugccuuguguucgcucagaaacugcccggcaacuauaauuccacagcaacuuuguguuuagggcaccaugccgucccuaacggaacgaucguuaagaccauuacaaaugacagaaucgaggugacuaacgcgaccgaacugguacaaaauucuucaauuggugagaucugcgauaguccacaccagauacuagacggcgaaaacuguacacucaucgaugcucugcuuggggacccgcagugcgauggauuucagaauaaaaagugggaccuguucguggagaggagcaaagccuacuccaacuguuaucccuacgaugucccugacuaugcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguacccagcacugaacgugacuaugcccaacaaugagcaguucgauaaacuuuauaucuggggaguccaccauccuggcaccgacaaagaucagaucuuuuuguacgcccagagcucuggcagaauuacaguguccacuaagaggucacaacaggcuguaauaccaaacauugggagccggccccgcaucagaaauauuccuaguaggaucucuaucuacuggaccauuguuaaaccaggagacauacugcuaaucaacuccacagguaaucucauugccccgcggggcuauuucaagauccgcagcgggaaaucgucuauaaugcgauccgaugcgcccauuggaaaguguaagucagaaugcaucaccccuaacggcaguaucccaaaugacaaacccuuucagaacgugaauagaauuacguacggugcauguccuagguaugucaagcagagcacucugaaacuugccacagggaugcggaacgugccagagaagcaaacccguggaaucuucggcgcuauugccggcuuuauagaaaaugggugggagggaaugguggacgguugguacggcuuccgccaccagaacuccgaggggagaggacaggcagcugaucugaaaucuacucaagccgcgaucgaccagauuaauggcaaguugaacaggcucaucgguaaaacaaaugaaaaguuccaccagaucgagaaggaauuuagcgaggucgaagggcggauucaggaucuggagaaauauguugaggacaccaagauagauuuauggucauacaacgccgaacugcucguggcacuugagaaccaacauacgaucgaccugaccgauagugaaaugaauaaauuguucgagaagacaaagaagcagcuacgagaaaacgcugaggacaugggcaauggaugcuuuaagauuuaucacaaaugugauaacgccugcaucggcuccauucgcaaugggacuuacgaccaugauguauacagagacgaggcucugaacaauagguuccagaucaagggaguggaacucaaaagcgguuauaaggacuggauacuguggaucucuuuugccauuucaugcuuccuucugugugucgcauugcucggcuuuaucaugugggccugccagaaagggaacauucgguguaauaucugcauauga

SEQ ID NO: 134340 - RNA, 1701 nt, Artificial Sequence
  derived and/or modified sequence opt3 from hemagglutinin__InfluenzaA__AHZ42643
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuggaucggacaacggcacuugcuauccaggugauuuuaucgacuacgaagaguugagggagcagcucucaagcgugaguuccuucgaacgguuugagauuuucccgaaggccucuagcuggcccaaucacgauuccaacaagggggucacagcugcauguccucaugccggagcuaaaggcuuuuauaagaaucugaucuggcuggugaaaaagggcaacucauacccaaaacucaguauaagcuauaucaaugacaaggggaaggaaguauuaguucugugggguauucaccaccccucuaccacggccgaucaacagucccuuuaccagaacgcggacacuuacguguucgucggaaccucacgcuauagcaaaaaguuuaaaccugagaucgcaauucgaccaaaggugcgugaucaggagggcagaaugaauuacuauuggacauugguggaacccggggacaaaaucacuuucgaggccaccggaaaccuggucguuccuagguacgcuuuugccauggaacggaacgcaggcagugguauaauuaucucugauacaccagugcaugacugcaauaccacgugucaaacuccgaagggggcuauuaacacaucccuacccuuccagaauauccacccuaucaccauuggaaaaugcccaaaguauguaaagagcacuaaacuccgccuggccacaggccuuagaaacgugcccucgauacagucuaggggccuguuuggggcgaucgccggauucauugaggguggcuggaccgggauggucgacggaugguacggcuaucaucaccagaaugaacaagguuccggguacgcagcugauuugaagucaacgcagaacgccaucgacaaaauaaccaauaaggugaacaguguuauugagaaaaugaauacacaguuuacugcugugggcaaggaguucaaccaccucgaaaagcggaucgagaaucugaacaaaaaggucgaugacggauucuuagauaucuggaccuacaaugccgaacugcucgugcuucuggagaacgaacgcacauuggacuaucaugauagcaauguuaaaaaccuauacgagaagguacgaaaccagcugaaaaauaacgcaaaggagauuggcaauggguguuuugaguucuaucacaagugcgacaacacuuguauggaauccgugaaaaauggaaccuacgauuauccuaaguacucugaagaggccaaacucaacagagaaaagaucgacggugucaaacuggagagcacaaggauuuaucaaauacuugcuaucuacucaaccgcggcaaguucccugguguuggucgugagccucggcgccauuucuuuuuggaugugcucaaaugggagucugcagugccggaucuguaucuga

SEQ ID NO: 134341 - RNA, 1701 nt, Artificial Sequence; identical to SEQ ID NO: 131899
  derived and/or modified sequence opt3 from hemagglutinin__InfluenzaA__AHZ42654

SEQ ID NO: 134342 - RNA, 1701 nt, Artificial Sequence; identical to SEQ ID NO: 131874
  derived and/or modified sequence opt3 from hemagglutinin__InfluenzaA__AHZ42666

SEQ ID NO: 134343 - RNA, 1701 nt, Artificial Sequence; identical to SEQ ID NO: 131874
  derived and/or modified sequence opt3 from hemagglutinin__InfluenzaA__AHZ42678

SEQ ID NO: 134344 - RNA, 1701 nt, Artificial Sequence
  derived and/or modified sequence opt3 from hemagglutinin__InfluenzaA__AHZ42690
augaaggccauccuggugguccuccuuuacaccuaugcuacagcaaacgccgacacucugugcauuggcuaccacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuauauuguugagaccucuucgucagacaacggaacuugcuacccaggcgauuucaucaauuaugaggaacucagggagcagcugagcaguguguccucuuuugaacgguucgagauuuuuccgaagacaagcuccuggcccaaccacgacucaaauaagggugucaccgccgcuuguccucaugcaggggccaaaaguuucuacaagaaccugaucuggcucgugaaaaagggaaauagcuauccaaaauuaucuaaguccuacauaaacgauaagggcaaagaaguacugguucuuuggggcauccaccaccccucaacgacuaccgaccaacagagcuuguaccagaaugcugaugccuauguguuugucgggacaagucgcuacucuaagaaauucaagccugagauugcgauccgaccaaaagugcgugaccaggagggaagaaugaacuauuacuggacucugauugaacccggugauaagaucaccuuugaggcaacaggcaaccuaguggucccuagguaugccuucgcuauggaacggaaugccggguccggaauaauuaucagcgacaccccaguucaugauugcaacacgacuugucaaacaccggagggcgcaauuaauaccucgcuccccuuucagaacauccacccuaucacuauugguaaaugcccaaaguacgugaagucuacaaaacugcgccuugcuaccgggcugagaaauguacccuccauacagucaaggggauuguucggcgccaucgcgggcuuuauugaagggggauggacggguaugguggacggcugguauggguaccaucaccagaacgagcaaggaaguggcuacgccgcagaccucaagagcacccagaaugcuaucgauaaaauaacaaacaaggucaauuccgugauugagaaaaugaacacucaguucaccgccguugguaaggaauuuaaucaccuggagaagcggaucgaaaacuuaaauaaaaagguggacgauggguuccuggacaucuggacauauaacgcugagcuccuuguccuguuggaaaaugagcgcacucuagauuaccaugacucuaacgugaaaaaccuguaugagaagguacgaaaucagcucaaaaacaaugccaaggaaauuggcaacggauguuucgaguuuuaccacaagugcgauaauaccuguauggaaagcguuaaaaacggcacauaugacuacccuaaguauucagaggaagcaaaacugaauagagagaagaucgauggggugaaacuugagaguaccaggauuuaccaaauacuggccaucuacuccacugucgcuagcucuuuggugcucgucgugucacugggagcgauuaguuucuggaugugcagcaacgguuccuuacagugccggaucuguaucuga

SEQ ID NO: 134345 - RNA, 1701 nt, Artificial Sequence; identical to SEQ ID NO: 131899
  derived and/or modified sequence opt3 from hemagglutinin__InfluenzaA__AHZ42701

SEQ ID NO: 134346 - RNA, 1701 nt, Artificial Sequence; identical to SEQ ID NO: 131874
  derived and/or modified sequence opt3 from hemagglutinin__InfluenzaA__AHZ42713

SEQ ID NO: 134347 - RNA, 1701 nt, Artificial Sequence
  derived and/or modified sequence opt3 from hemagglutinin__InfluenzaA__AHZ42725
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcaacgggaaaagcucgauaaugcgaucugacgcgcccauuggaaaguguaaguccgaaugcaucaccccuaauggcucaaucccaaacgacaaacccuuucagaaugugaacagaauuacguauggugcauguccuagguacgucaagcagaguacucugaaacuugccacagggaugcggaaugugccagagaagcaaacccguggaaucuucggcgcuauugccggcuuuauagaaaacgggugggagggaaugguggaugguugguauggcuuccgccaccagaauagcgaggggagaggacaggcagcugaccugaaauccacucaagccgcgaucgaucagauuaacggcaaguugaauaggcucaucgguaaaacaaacgaaaaguuccaccagaucgagaaggaauuuucugaggucgaagggcggauucaggaccuggagaaauacguugaggauaccaagauagacuuauggagcuauaacgccgaacugcucguggcacuugagaaucaacauacgaucgaucugaccgacucagaaaugaacaaauuguucgagaagacaaagaagcagcuacgagaaaaugcugaggauaugggcaacggaugcuuuaagauuuaccacaaaugugacaaugccugcaucggcaguauucgcaacgggacuuaugaucaugacguauacagagacgaggcucugaauaacagguuccagaucaagggaguggaacucaaauccgguuacaaggauuggauacuguggaucagcuuugccauuucuugcuuccuucugugugucgcauugcucggcuuuaucaugugggccugccagaaagggaauauucgguguaacaucugcauauga

SEQ ID NO: 134348 - RNA, 1701 nt, Artificial Sequence
  derived and/or modified sequence opt3 from hemagglutinin__InfluenzaA__AHZ42737
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcgugaccaggagggaagaaugaacuacuauuggacacugauugaacccggugauaagaucacuuucgaggccaccggcaaccuaguggucccuagguacgcuuuugccauggaacggaaugcagaguccgggauaauuaucagcgacacaccaguucaugauugcaacaccacgugucaaacuccggaaggagcuauuaauacaucgcuccccuuccagaacauccacccuaucaccauuggcaaaugcccaaaguaugugaagucuacuaaacugcgccuugccacaggucugagaaauguacccuccauacagucaaggggguuguuuggagcgaucgccggcuucauugagggcggguggaccggaaugguggacgguugguacggcuaucaucaccagaacgagcaagggaguggauacgcagcugaccucaagagcacgcagaaugccaucgauaaaauaaccaacaaggucaauuccgugauugagaaaaugaacacacaguuuacugcuguuggcaaggaguucaaucaccuggaaaagcggaucgagaacuuaaauaaaaagguggacgaugguuuccuggacaucuggaccuacaacgccgaacuccuuguccuguuggagaaugagcgcacacuagauuaucaugacucuaacgugaaaaaccuguacgaaaagguacgaaaucagcucaaaaacaaugcaaaggagauugggaacggcuguuuugaguucuaucacaagugcgauaauacuuguauggaaagcguuaaaaacggaaccuacgacuauccuaaguacucagaagaggccaaacugaauagagagaagaucgauggcgugaaacuugaaaguacaaggauuuaucaaauacuggcuaucuacuccaccgucgcgagcucuuuggugcucgucgugucacugggggcaauuaguuuuuggaugugcagcaacggauccuuacagugccggaucuguaucuga

SEQ ID NO: 134349 - RNA, 1701 nt, Artificial Sequence; identical to SEQ ID NO: 131899
  derived and/or modified sequence opt3 from hemagglutinin__InfluenzaA__AHZ42748

SEQ ID NO: 134350 - RNA, 1701 nt, Artificial Sequence; identical to SEQ ID NO: 131919
  derived and/or modified sequence opt3 from hemagglutinin__InfluenzaA__AHZ42760

SEQ ID NO: 134351 - RNA, 1701 nt, Artificial Sequence
  derived and/or modified sequence opt3 from hemagglutinin__InfluenzaA__AHZ42772
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgacagaaucgaagugacuaaugcgaccgagcugguacaaucuucaaguacaggugaaauuugcaacagcccacaccagauccuagauggcgagaauuguacccucauagacgcucugcuuggggauccgcagugcgacggauuucagaacaagaaaugggaucuguucguggaaagguccaaggcccauucuaauuguuaucccuacgacgucccugauuaugcaucguugcggucacucguggccagcaguggcacucuggaguuuaacaaugaguccuucaacuggacagguguuacccaaaaugggacgucuagcgcuugcauccgccgauccaacaauucauuuuucagucgucugaacuggcucacucacuuaaauuuuaaauacccagcacugaacgugaccaugcccaacaaugaacaguucgacaaacuuuauauuuggggaguccaucacccuggcacagauaaggaccagaucuuuuuguacgcccaggcuagcggcagaauuacugugucuaccaagaggucccaacagacaguaaucccaaacauagggucacggccccgcguuagaaauauuccuagcagggugaguaucuauuggaccauugucaagccaggagauauccugcuaaucaacucuacggguaaucucauugccccgcggggcuacuucaaaauacgcuccggaaagagcucgaucaugcgaucugacgcgcccauugggaaauguaacuccgcaugcaucacuccuaauggcucaauaccaaacgacaagcccuuucagaaugugaacagaauuacauacggugccuguccuagguaugugaagcagaauacccugaaacuugcuacugggaugcggaacgucccagagaagcaaacacguggaaucuucggcgccaucgcaggcuuuauugaaaaugggugggagggaaugguugaugguugguacggcuuccgccaccagaacagugaggggagaggacaggcugccgaccugaaaagcacccaagcggccaucgaucagauuaauggcaaguugaacaggcucauagguaaaacgaacgaaaaguuccaucagaucgagaaagaauuuuccgagguggaagggcggauucaggaccuggagaaguauguagaggauaccaagaucgacuuauggucuuacaaugcagaacugcucguggcucuugagaaccaacacacaaucgaucugacugacagcgaaaugaauaaauuguucgagaagaccaaaaagcagcuacgagaaaacgccgaggauaugggcaauggaugcuuuaaaauuuaucauaagugugacaacgcuugcauaggcucaauccgcaaugggacauacgaucacgacgucuauagagacgaggcccugaacaauagguuccagauuaaggaaguggagcucaaaaguggauacaaggauuggauccuguggauuuccuuugcaaucagcugcuuccuucuguguguugccuugcucgguuuuauaaugugggcuugccagaaaggcaacauccgguguaauauuugcaucuga

SEQ ID NO: 134352 - RNA, 1701 nt, Artificial Sequence; identical to SEQ ID NO: 131899
  derived and/or modified sequence opt3 from hemagglutinin__InfluenzaA__AHZ42784

SEQ ID NO: 134353 - RNA, 1701 nt, Artificial Sequence; identical to SEQ ID NO: 131874
  derived and/or modified sequence opt3 from hemagglutinin__InfluenzaA__AHZ42796

SEQ ID NO: 134354 - RNA, 1701 nt, Artificial Sequence; identical to SEQ ID NO: 131874
  derived and/or modified sequence opt3 from hemagglutinin__InfluenzaA__AHZ42808

SEQ ID NO: 134355 - RNA, 1701 nt, Artificial Sequence; identical to SEQ ID NO: 134348
  derived and/or modified sequence opt3 from hemagglutinin__InfluenzaA__AHZ42820

SEQ ID NO: 134356 - RNA, 1701 nt, Artificial Sequence; identical to SEQ ID NO: 132483
  derived and/or modified sequence opt3 from hemagglutinin__InfluenzaA__AHZ42831

SEQ ID NO: 134357 - RNA, 1701 nt, Artificial Sequence
  derived and/or modified sequence opt3 from hemagglutinin__InfluenzaA__AHZ42843
augaagaccaucauugcccugagcuacauacucugccuuguguucgcucagaaacugcccggcaacgacaauuccacagcaacuuuguguuuagggcaccaugccgucccuaacggaacgaugguuaagaccaucacaaaugauagaauugaggugacuaacgcgaccgaacugguacaaaauucuucaaucggugagauuugcgacaguccacaccagauccuagauggcgaaaacuguacacucauagacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauccgccgaagcaauuccucauuuuucagucgucugaacuggcucacgcauuuaaauuuuaaguauccagcacugaacgugacuaugcccaacaaugagcaguucgacaaacuuuacauuuggggaguccaccauccuggcaccgauaaagaccagaucuuuuuguaugcccagagcucuggcagaauuacaguguccacuaagaggucacaacaggcuguaaucccaaacauagggagccggccccgcauuagaaauaucccuaguaggauuucuaucuacuggaccaucguuaaaccaggagauauucugcuaauaaacuccacagguaaucucaucgccccgcggggcuacuucaagauucgcagcgggaaaucgucuaucaugcgauccgacgcgcccauaggaaaguguaagucagaaugcauuaccccuaacggcaguaucccaaaugacaaacccuuucagaacgugaauagaaucacguauggugcauguccuagguacgucaagcagagcacucugaaacuugccacagggaugcggaacgugccagagaagcaaacccguggaauuuucggcgcuaucgccggcuuuauugaaaaugggugggagggaaugguggaugguugguauggcuuccgccaccagaacuccgaggggagaggacaggcagcugaccugaaaucuacucaagccgcgauagaucagaucaauggcaaguugaacaggcucauugguaaaacaaaugaaaaguuccaccagaucgagaaggaauuuagcgaggucgaagggcggauccaggaccuggagaaauacguugaggauaccaagauugacuuauggucauauaacgccgaacugcucguggcacuugagaaccaacauacgauagaucugaccgacagugaaaugaauaaauuguucgagaagacaaagaagcagcuacgagaaaacgcugaggauaugggcaauggaugcuuuaagaucuaccacaaaugugacaacgccugcauuggcuccauccgcaaugggacuuaugaucauaacguauacagagacgaggcucugaauaacagguuccagauuaagggaguggaacucaaaagcgguuacaaggacuggauccuguggauaucuuuugccaucucaugcuuccuucugugugucgcauugcucggcuuuauuaugugggccugccagaaagggaauauccgguguaacauuugcaucuga

SEQ ID NO: 134358 - RNA, 1701 nt, Artificial Sequence
  derived and/or modified sequence opt3 from hemagglutinin__InfluenzaA__AHZ42855
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacaugacuaugcccaacaaugagcaguucgacaaacuuuacaucuggggagugcaccauccuggcaccgauaaagaccagaucuuuuuguaugcccagagcucuggcagaauuacagucuccacuaagaggucacaacaggcugugauaccaaacauugggagccggccccgcaucagaaauauuccuaguaggaucucuaucuacuggaccauuguaaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacguuaauagaauuacguauggugcauguccuagguacgugaagcagagcacucugaaacuugccacagggaugcggaacgucccagagaagcaaacccguggaaucuucggcgcuauugccggcuuuauagaaaaugggugggagggaaugguggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgagguggaagggcggauucaggaccuggagaaauacgucgaggauaccaagauagacuuauggucauauaacgccgaacugcucguugcacuugagaaccaacauacgaucgaucugaccgacagugaaaugaauaaauuguucgagaagacaaagaagcagcuacgagaaaacgcugaggauaugggcaauggaugcuuuaagauuuaccacaaaugugacaacgccugcaucggcuccauucgcaaugggacuuaugaucauaacguguacagagacgaggcucugaauaacagguuccagaucaagggaguagaacucaaaagcgguuacaaggacuggauacuguggaucucuuuugccauuucaugcuuccuucuguguguggcauugcucggcuuuaucaugugggccugccagaaagggaauauucgguguaacaucugcauauga

SEQ ID NO: 134359 - RNA, 1701 nt, Artificial Sequence
  derived and/or modified sequence opt3 from hemagglutinin__InfluenzaA__AHZ42867
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacccuggaauuuaauaacgagaguuucaauugggcugguguuacucagaacgggacauccucugcaugcauucggggaagcaauuccucauuuuucagucgccugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucaaagcucugggcgaaucaccguguccacaaagcguucacagcaggccguaauaccaaacauuggaagcagacccaggauccggaauauuccuagucgcaucucuaucuacuggacuauuguuaaaccaggugauauacugcuaaucaacuccaccggcaaucucauugcgccgagaggguacuucaagaucaggagcggaaaaucgucuauaaugcgguccgacgcacccauuggcaaguguaagucagaaugcaucacaccuaacgguaguaucccaaaugacaaacccuuucagaacgugaaucgcauuaccuauggggccuguccucgauacgucaagcaaagcacgcugaaacuugcuacuggaaugagaaacgugccagagaagcagacaaggggcaucuucggcgccauugcaggguuuauagaaaauggaugggaggguaugguggauggcugguauggguuccggcaccagaacuccgagggacguggccaagcugccgaccugaaaucuacccaggcggccaucgaucagauuaaugguaaguugaaccgccucaucgggaaaacuaaugaaaaguuccaccagaucgagaaggaauuuagcgaggucgaaggcaggauucaagaccuggagaaauacguugaggauacaaagauagacuuauggucauauaacgcagaacugcucguggcucuugagaaccagcauaccaucgaucugacggacagugaaaugaauaaauuguucgagaagaccaaaaagcagcuaagagaaaacgccgaggauaugggaaauggcugcuuuaagauuuaccacaaaugugacaacgcuugcaucggguccauucggaauggaacauaugaucaugacguauaccgagacgaggcccugaacaaucgcuuccagaucaaggguguggaacucaaaagcgaguacaaggauuggauacuguggaucucuuuugcaauuucaugcuuccuucugugugucgccuugcucggcuuuaucaugugggcuugccaaaaagggaacauuagauguaauaucugcauauga

SEQ ID NO: 134360 - RNA, 1701 nt, Artificial Sequence; identical to SEQ ID NO: 131874
  derived and/or modified sequence opt3 from hemagglutinin__InfluenzaA__AHZ42879

SEQ ID NO: 134361 - RNA, 1701 nt, Artificial Sequence
  derived and/or modified sequence opt3 from hemagglutinin__InfluenzaA__AHZ42891
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccucuuguuaccccuaugacgucccugauuacgcaucguugcggucacucguggccagcaguggcacccuggaauuuaacaaugaguccuucaacugggcugguguuacucaaaaugggacaucuagcgcaugcauucgccgauccaacucaaguuucuuuagccgucugaauuggcucacccauuuaaacuuuaaguauccagcccugaaugugacgaugcccaacaacgagcaguucgacaaguuguacaucuggggaguccaccauccuggcacugauaaagaccagauuuuucuuuaugcucagucuuccggcagaaucaccgugucaacaaagaggagccaacaggccguaauaccaaauauugggagucggccccgcaucagaaacauuccuucuaggaucuccaucuacuggacuauuguuaaaccaggagauauacugcuaaucaauagcaccgguaaccucauugcgccgcggggcuacuucaagauccgcucggggaaaucuuccauaaugcgaucagacgcacccauuggaaaguguaagagugaaugcaucacaccuaauggcagcaucccaaacgacaaacccuuucagaaugugaacagaauuaccuauggugccuguccuagguacgucaagcaguccacgcugaaacuugcuacugggaugcggaaugugccagagaagcaaacacguggaaucuucggcgccauugcaggcuuuauagaaaacgggugggagggaaugguggaugguugguauggcuuccgccaccaaaauucugaggggagaggacaggcugccgaccugaaaagcacccaggcggccaucgaucagauuaacggcaaguugaauaggcucaucgguaaaacuaacgaaaaguuccaccagaucgagaaggaauuuucagaggucgaagggcggauucaggaccuggagaaauacguugaggauacaaagauagacuuauggaguuauaaugcagaacugcucguggcucuugagaaccaacauaccaucgaucugacggacuccgaaaugaacaaauuguucgagaagaccaaaaagcagcuacgagaaaaugccgaggauaugggcaacggaugcuuuaagauuuaccacaaaugugacaaugcuugcaucggcagcauucgcaacgggacauaugaucaugacguauacagagacgaggcccugaauaacagguuccagaucaagggaguggaacucaaaucugguuacaaggauuggauacuguggaucucauuugcaauuaguugcuuccuucugugugucgccuugcucggcuuuaucaugugggcuugccagaaagggaauauucgguguaacaucugcauauga

SEQ ID NO: 134362 - RNA, 1701 nt, Artificial Sequence
  derived and/or modified sequence opt3 from hemagglutinin__InfluenzaA__AHZ42903
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcaauuccucauuuuucagucgucugaacuggcugacgcaucucaauuuuaaguauccagcauuaaacgugacuaugcccaacaaugagcaguucgacaagcuguacauuuggggaguccaccauccuggcaccgauaaagaccagaucuuucuuuaugcccagagcucuggcagaauaacaguguccacuaagaggucacaacaggcuguaauuccaaacaucgggagccggccccgcauuagaaauaucccuaguaggaucucuauuuacuggaccauaguuaaaccaggagauaucuugcugauuaacuccacagguaaucuaaucgccccgcggggcuacuucaagauacgcagcgggaaaucgucuauuaugcgauccgacgcgcccaucggaaaguguaagucagaaugcaucaccccuaacggcaguauuccaaaugacaaacccuuucagaacgugaauagaaucacguauggugcauguccuagguacgucaagcagagcacucucaaacuggccacagggaugcggaacgugccagagaagcaaacccguggaauuuucggcgcuauagccggcuuuaucgaaaaugggugggagggaaugguggaugguugguauggcuuccgccaccagaacuccgaggggagaggacaggcagcugaccuuaaaucuacucaagccgcgauugaucagaucaauggcaagcugaacagguugaucgguaaaacaaaugaaaaguuccaccagauugagaaggaauuuagcgaggucgaagggcggauacaggaccucgagaaauacguugaggauaccaagaucgaccuguggucauauaacgccgaauuacugguggcacucgagaaccaacauacgauugaucuuaccgacagugaaaugaauaaacuguucgagaagacuaaaaagcaguugcgagaaaacgcugaggauaugggcaauggaugcuuuaagaucuaccacaaaugugacaacgccugcauuggcuccauccgcaaugggacauaugaucauaacguauacagagacgaggcucuaaauaacagguuccagauaaagggaguggaacugaaaagcgguuacaaggacuggauccucuggauuucuuuugccaucucaugcuuccugcuuugugucgcacuguugggcuuuauuaugugggccugccagaaagggaauauccgguguaacauaugcauuuga

SEQ ID NO: 134363 - RNA, 1701 nt, Artificial Sequence; identical to SEQ ID NO: 131851
  derived and/or modified sequence opt3 from hemagglutinin__InfluenzaA__AHZ42915

SEQ ID NO: 134364 - RNA, 1683 nt, Artificial Sequence; identical to SEQ ID NO: 132004
  derived and/or modified sequence opt3 from hemagglutinin__InfluenzaA__AHZ59747

SEQ ID NO: 134365 - RNA, 1683 nt, Artificial Sequence
  derived and/or modified sequence opt3 from hemagglutinin__InfluenzaA__AHZ59759
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaacgcacaguggauuugggccaaugcggguuacugggaaccaucacuggcccaccgcagugugaccaguuucuagaguucucugcugaucucauaaucgaacgacgugaggguucagacguuugcuaccccgggaaguuugugaacgaggaagcccugagacagauucuuagggagaguggaggcaucgauaaagaagcaaugggcuucacauauagcgggauucggaccaauggagccacguccgcuugucgcagaucugguucgucauuuuacgcagagaugaaguggcuguugagcaacacugacaaugccgcuuucccucaaaugaccaagaguuauaaaaacacaaggaaguccccagcccucaucgucuggggcauacaccauucugugagcacugcggagcagaccaaacuguacggguccggaaauaagcugguaacaguuggcucaaguaacuaucagcagagcuuugugcccucuccuggugcacggccacaagucaaugggcucuccggacgcauugauuuccacugguuaaugcugaaccccaaugacaccgugacguuuucauucaacggcgccuuuaucgcuccugaucgagccagcuuccuuagaggcaaaaguauggggauucagucuggagugcaggucgacgcaaacugcgaaggugauuguuaccauuccggcgggacuaucaucagcaauuugccauuucagaacauugacucgagggcuguuggaaagugcccgcgguaugugaagcaacguucucugcuacucgccacaggcaugaaaaauguacccgagauaccuaagggucgcgggcuguucggcgcgaucgccggauucauugaaaacggcugggaggggcuuaucgauggaugguacgguuuuagacaccagaaugcacagggcgaagggaccgcugccgacuacaaauccacucaaucagcuauagaccagauuacaggaaagcugaacagguugaucgagaaaaccaaucagcaguucgagcucaucgauaacgaauuuaaugagguggaaaagcaaauuggcaacgucaucaauuggacgcgggacaguauuaccgagguguggagcuauaacgccgaacuguuaguugcaauggagaaucagcacacaauagaucuggccgacuccgagauggauaaacucuacgaacgagugaagcgccagcuuagagagaacgcugaagaggacgguacuggguguuucgaaaucuuucauaagugcgaugacgauuguauggcgucuauuaggaauaacaccuaugaccacagcaaaucacgggaggaggcaaugcagaaccgcauccaaaucgauccagucaagcugaguuccggcuacaaagacgugauuuugugguucagcuuuggagccucuugcuucauacuacuggcuaucguaaugggccucguuuuuauuugcgugaagaaugggaacaugagauguacaaucugcauuuga

SEQ ID NO: 134366 - RNA, 1683 nt, Artificial Sequence
  derived and/or modified sequence opt3 from hemagglutinin__InfluenzaA__AHZ59771
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaacgcacaguggauuugggccaaugcggguuacugggaaccaucacuggcccaccgcagugugaccaguuucuagaguucucugcugaucucauaaucgaacgacgugaggguucagacguuugcuaccccgggaaguuugugaacgaggaagcccugagacagauucuuagggagaguggaggcaucgauaaagaagcaaugggcuucacauauagcgggauucggaccaauggagccacguccgcuugucgcagaucugguucgucauuuuacgcagagaugaaguggcuguugagcaacacugacaaugccgcuuucccucaaaugaccaagaguuauaaaaacacaaggaaguccccagcccucaucgucuggggcauacaccauucugugagcacugcggagcagaccaaacuguacggguccggaaauaagcugguaacaguuggcucaaguaacuaucagcagagcuuugugcccucuccuggugcacggccacaagucaaugggcaguccggacgcauugauuuccacuggcucauguuaaaccccaaugacaccgugacguuuucauucaacggcgccuuuaucgcuccugaucgagccagcuuccugagaggcaaaaguauggggauucagucuggagugcaggucgacgcaaacugcgaaggugauuguuaccauuccggcgggacuaucaucagcaaucuuccauuucaaaacauugacucgagggcuguuggaaagugcccgcgguaugugaagcagcguucuuugcugcuagccacaggcaugaaaaauguacccgagauaccuaagggucgcgggcuuuucggcgcgaucgccggauucauugaaaacggcugggaggggcugaucgauggaugguacgguuuuagacaccagaaugcacaaggcgaagggaccgcugccgacuacaaauccacucagucagcuauagaccagauuacaggaaagcucaacaggcugaucgagaaaaccaaucagcaauucgaguugaucgauaacgaauuuaaugagguggaaaagcagauuggcaacgucaucaauuggacgcgggacaguauuaccgagguguggagcuauaacgccgaacuccugguugcaauggagaaucagcacacaauagauuuagccgacuccgagauggauaaacuguacgaacgagugaagcgccagcucagagagaacgcugaagaggacgguacuggguguuucgaaaucuuucauaagugcgaugacgauuguauggcgucuauuaggaauaacaccuaugaccacagcaaauaccgggaggaggcaaugcaaaaccgcauccagaucgauccagucaaacuuucaaguggcuauaaggacgugauucugugguucuccuuuggagccagcugcuucauauugcuagcuaucguaaugggccugguuuuuauuugcgugaagaaugggaacaugagauguacaaucugcauuuga

SEQ ID NO: 134367 - RNA, 1683 nt, Artificial Sequence
  derived and/or modified sequence opt3 from hemagglutinin__InfluenzaA__AHZ59795
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaacgcacaguggauuugggccaaugcggguuacugggaaccaucacuggcccaccgcagugugaccaguuucuagaguucucugcugaucucauaaucgaacgacgugaggguucagacguuugcuaccccgggaaguuugugaacgaggaagcccugagacagauucuuagggagaguggaggcaucgauaaagaagcaaugggcuucacauauagcgggauucggaccaauggaacgacuuccgccugucgcagaucugguucgucauuuuacgcugagaugaaguggcuguugagcaacaccgacaaugcagccuucccucaaaugacaaagaguuauaaaaacacuaggaaguccccagcucucaucgucuggggcauacaccauucugugagcaccgccgagcagacaaaacuguacggguccggaaauaagcugguaaccguuggcucaaguaacuaucagcagagcuuugugcccucuccuggugcgcggccacaagucaaugggcucuccggacgcauugauuuccacugguuaaugcugaaccccaaugacacggugacuuuuucauucaacggcgcauuuaucgccccugaucgagcuagcuuccuuagaggcaaaaguauggggauucagucuggagugcaggucgacgccaacugcgaaggugauuguuaccauuccggcgggacaaucaucagcaauuugccauuucagaacauugacucgagggcaguuggaaagugcccgcgguaugugaagcaacguucucugcuacucgcuaccggcaugaaaaauguacccgagauaccuaagggucgcgggcuguucggcgccaucgcgggauucauugaaaacggcugggaggggcuuaucgauggaugguacgguuuuagacaccagaaugcccagggcgaagggacugcagcugacuacaaauccacacaaucagccauagaccagauuaccggaaagcugaacagguugaucgagaaaacgaaucagcaguucgagcucaucgauaacgaauuuaaugagguggaaaagcaaauuggcaacgucaucaauuggacccgggacaguauuacagagguguggagcuauaacgcugaacuguuaguugccauggagaaucagcacacuauagaucuggcagacuccgagauggauaaacucuacgaacgagugaagcgccagcuuagagagaacgccgaagaggacgguaccggguguuucgaaaucuuucauaagugcgaugacgauuguauggcuucuauuaggaauaacacauaugaccacagcaaauaccgggaggaggcgaugcagaaccgcauccaaaucgauccagucaagcugucaaguggcuauaaagacgugauuuugugguucuccuuuggagcaagcugcuucauacuacuggccaucguaaugggccucguuuuuauuugcgugaagaaugggaacaugagauguacuaucugcauuuga

SEQ ID NO: 134368 - RNA, 1683 nt, Artificial Sequence; identical to SEQ ID NO: 134367
  derived and/or modified sequence opt3 from hemagglutinin__InfluenzaA__AHZ59807

SEQ ID NO: 134369 - RNA, 1683 nt, Artificial Sequence; identical to SEQ ID NO: 134367
  derived and/or modified sequence opt3 from hemagglutinin__InfluenzaA__AHZ59819

SEQ ID NO: 134370 - RNA, 1683 nt, Artificial Sequence; identical to SEQ ID NO: 132004
  derived and/or modified sequence opt3 from hemagglutinin__InfluenzaA__AHZ59831

SEQ ID NO: 134371 - RNA, 1683 nt, Artificial Sequence; identical to SEQ ID NO: 132004
  derived and/or modified sequence opt3 from hemagglutinin__InfluenzaA__AHZ59843

SEQ ID NO: 134372 - RNA, 1683 nt, Artificial Sequence; identical to SEQ ID NO: 132004
  derived and/or modified sequence opt3 from hemagglutinin__InfluenzaA__AHZ59855

SEQ ID NO: 134373 - RNA, 1683 nt, Artificial Sequence; identical to SEQ ID NO: 134366
  derived and/or modified sequence opt3 from hemagglutinin__InfluenzaA__AHZ59867

SEQ ID NO: 134374 - RNA, 1683 nt, Artificial Sequence; identical to SEQ ID NO: 132004
  derived and/or modified sequence opt3 from hemagglutinin__InfluenzaA__AHZ59879

SEQ ID NO: 134375 - RNA, 1683 nt, Artificial Sequence; identical to SEQ ID NO: 134366
  derived and/or modified sequence opt3 from hemagglutinin__InfluenzaA__AHZ59915

SEQ ID NO: 134376 - RNA, 1683 nt, Artificial Sequence; identical to SEQ ID NO: 132004
  derived and/or modified sequence opt3 from hemagglutinin__InfluenzaA__AHZ59927

SEQ ID NO: 134377 - RNA, 1683 nt, Artificial Sequence; identical to SEQ ID NO: 134366
  derived and/or modified sequence opt3 from hemagglutinin__InfluenzaA__AHZ59939

SEQ ID NO: 134378 - RNA, 1683 nt, Artificial Sequence; identical to SEQ ID NO: 132004
  derived and/or modified sequence opt3 from hemagglutinin__InfluenzaA__AHZ59951

SEQ ID NO: 134379 - RNA, 1683 nt, Artificial Sequence; identical to SEQ ID NO: 132004
  derived and/or modified sequence opt3 from hemagglutinin__InfluenzaA__AHZ59963

SEQ ID NO: 134380 - RNA, 1683 nt, Artificial Sequence; identical to SEQ ID NO: 132004
  derived and/or modified sequence opt3 from hemagglutinin__InfluenzaA__AHZ59988

SEQ ID NO: 134381 - RNA, 1683 nt, Artificial Sequence; identical to SEQ ID NO: 132004
  derived and/or modified sequence opt3 from hemagglutinin__InfluenzaA__AHZ60000

SEQ ID NO: 134382 - RNA, 1683 nt, Artificial Sequence; identical to SEQ ID NO: 132004
  derived and/or modified sequence opt3 from hemagglutinin__InfluenzaA__AHZ60012

SEQ ID NO: 134383 - RNA, 1683 nt, Artificial Sequence; identical to SEQ ID NO: 132004
  derived and/or modified sequence opt3 from hemagglutinin__InfluenzaA__AHZ60024

SEQ ID NO: 134384 - RNA, 1683 nt, Artificial Sequence; identical to SEQ ID NO: 134367
  derived and/or modified sequence opt3 from hemagglutinin__InfluenzaA__AHZ60036

SEQ ID NO: 134385 - RNA, 1683 nt, Artificial Sequence; identical to SEQ ID NO: 134367
  derived and/or modified sequence opt3 from hemagglutinin__InfluenzaA__AHZ60048

SEQ ID NO: 134386 - RNA, 1683 nt, Artificial Sequence; identical to SEQ ID NO: 134367
  derived and/or modified sequence opt3 from hemagglutinin__InfluenzaA__AHZ60060

SEQ ID NO: 134387 - RNA, 1683 nt, Artificial Sequence; identical to SEQ ID NO: 134367
  derived and/or modified sequence opt3 from hemagglutinin__InfluenzaA__AHZ60072

SEQ ID NO: 134388 - RNA, 1683 nt, Artificial Sequence; identical to SEQ ID NO: 134367
  derived and/or modified sequence opt3 from hemagglutinin__InfluenzaA__AHZ60084

SEQ ID NO: 134389 - RNA, 1683 nt, Artificial Sequence
  derived and/or modified sequence opt3 from hemagglutinin__InfluenzaA__AHZ60096
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaacgcacaguggauuugggccaaugcggguuacugggaaccaucacuggcccaccgcagugugaccaguuucuagaguucucugcugaucucauaaucgaacgacgugaggguucagacguuugcuaccccgggaaguuugugaacgaggaagcccugagacagauucuuagggagaguggaggcaucgauaaagaagcaaugggcuucacauauagcgggauucggaccaauggagccacguccgcuugucgcagaucugguucgucauuuuacgcagagaugaaguggcuguugagcaacacugacgaugccgcuuucccucaaaugaccaagaguuauaaaaauacaaggaaguccccagcccucaucgucuggggcauacaccauucugugagcacugcggagcagaccaaacuguacggguccggaaacaagcugguaacaguuggcucaaguaauuaucagcagagcuuugugcccucuccuggugcacggccacaagucaacgggcucuccggacgcauugacuuccacugguuaaugcugaaucccaacgauaccgugacguuuucauucaauggcgccuuuaucgcuccugaccgagccagcuuccuuagaggcaaaaguauggggauucagucuggagugcaggucgaugcaaacugcgaaggugacuguuaccauuccggcgggacuaucaucagcaacuugccauuucagaauauugauucgagggcuguuggaaagugcccgcgguaugugaagcaacguucucugcuacucgccacaggcaugaaaaacguacccgagauaccuaagggucgcgggcuguucggcgcgaucgccggauucauugaaaauggcugggaggggcuuaucgacggaugguacgguuuuagacaccagaacgcacagggcgaagggaccgcugccgacuacaaauccacucaaucagcuauagaucagauuacaggaaagcugaauagguugaucgagaaaaccaaccagcaguucgagcucaucgacaaugaauuuaacgagguggaaaagcaaauuggcaaugucaucaacuggacgcgggauaguauuaccgagguguggagcuauaaugccgaacuguuaguugcaauggagaaccagcacacaauagaccuggccgauuccgagauggacaaacucuacgaacgagugaagcgccagcuuagagagaaugcugaagaggaugguacuggguguuucgaaaucuuucauaagugcgacgaugacuguauggcgucuauuaggaacaauaccuaugaucacagcaaauaccgggaggaggcaaugcagaaccgcauccaaaucgacccagucaagcugucaaguggcuauaaagacgugauuuugugguucuccuuuggagccagcugcuucauacuacuggcuaucguaaugggccucguuuuuauuugcgugaagaacgggaauaugagauguacaaucugcauuuga

SEQ ID NO: 134390 - RNA, 1701 nt, Artificial Sequence
  derived and/or modified sequence opt3 from hemagglutinin__InfluenzaA__AIC64889
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaaggaaaacagcuacccaaaacucucuaaguccuauaucaaugacaagggaaaagagguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcguggccaggaaggaagaaugaauuacuauuggacuuugguggagcccggugauaagaucaccuucgaagccacaggcaaccuggucguuccuagguacgcuuuugccauggagcggaacgcagggucgggaauaauuaucucugacacuccagugcaugauugcaauaccacaugucaaaccccgaaaggcgcuauuaacacgucccuacccuuccagaauauccacccuaucacuauugguaagugcccaaaguauguaaaaucaacaaagcuccgccuggccaccgggcuuagaaacgugcccaguauacagagcaggggacuguuuggcgcgaucgccggcuucauugaagggggauggacugguauggucgacggcugguacggguaucaucaccagaaugagcaaggauccggcuacgcagcugacuugaaaucuacacagaacgccaucgaugagauaaccaauaaggugaacagcguuauugaaaagaugaauacgcaguuuaccgcuguggguaaagaguucaaccaccucgaaaagcggaucgagaaucugaacaaaaaggucgacgauggguucuuagacaucuggacauacaaugccgaacugcucgugcuucuggagaacgagcgcacuuuggauuaucaugacucaaauguuaaaaaccuauacgaaaagguacgaagucagcugaaaaacaaugcaaaggagauuggcaacggauguuuugaguucuaucacaagugcgauaauaccuguauggaauccgugaaaaacggcacauacgacuauccuaaguacagcgaagaggccaaacucaauagagaggaaaucgauggggucaagcuggagucuacuaggauuuaucaaauacuugcuaucuacucaaccguggcgaguagccuggucuuggugguuucccucggagcaauuucuuuuuggaugugcucgaacgguagccugcagugccggaucuguaucuga

SEQ ID NO: 134391 - RNA, 1701 nt, Artificial Sequence; identical to SEQ ID NO: 132056
  derived and/or modified sequence opt3 from hemagglutinin__InfluenzaA__AIC73738

SEQ ID NO: 134392 - RNA, 1701 nt, Artificial Sequence
  derived and/or modified sequence opt3 from hemagglutinin__InfluenzaA__AIC73739
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggcaugccggguccggaaucauaauuagcgacaccccagugcacgauugcaauacgacuugucagacaccggagggcgcaaucaacaccucgcuccccuuccagaauauucauccuaucacuaucgguaagugcccaaaauauguaaagucuacaaagcugcgccuugcuaccgggcugagaaacgugcccuccauucagucaaggggauuguuuggcgccauagcgggcuucaucgaagggggauggacggguauggucgacggcugguacggguaucaccaccaaaaugagcagggaaguggcuacgccgcagaccucaaaagcacccagaacgcuauugauaagaucacaaauaaagugaacuccguuauagagaagaugaauacucaguuuaccgccguggguaaagaguucaaccaucuggagaagcggauugaaaauuuaaacaagaaagucgacgauggguuccuggacaucuggacauacaaugcugagcuccuugugcuguuggaaaacgagcgcacucuagauuaucacgacucuaauguaaagaaccuguacgagaaaguucgaaaccaacucaagaauaacgccaaagaaaucggcaauggauguuuugaguucuaucauaagugcgauaacaccuguauggaaagcgugaagaauggcacauacgacuauccuaaauacucagaggaagcaaagcugaacagagagaaaauugauggggucaaacuugagaguaccaggaucuaucagauucuggccauauacuccacuguggcuagcucuuugguccucgugguuucacugggagcgaucaguuuuuggaugugcagcaaugguuccuuacagugccggauuuguaucuga

SEQ ID NO: 134393 - RNA, 1701 nt, Artificial Sequence
  derived and/or modified sequence opt3 from hemagglutinin__InfluenzaA__AIC73740
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaagaacucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuaucucaauccuauauaaacgauaagggcaaggaaguacugguucuuuggggcauccaccaucccccuacuaccgccgaccagcagucauuguaccagaaugcugaugccuacguguucgucgggacaagccgcuauaguaaaaaguuuaaaccagagauugcgauccgacccaaggugcgugaccaagagggaagaaugaacuacuauuggacucugguggaaccuggugauaaaauuaccuucgaggcaacaggcaaccuagucguuccaagguacgccuuuaccauggaacggaaugcugggucuggaaucauaauuuccgacacgccggugcacgauugcaacacuacaugucagacccccgagggcgccaucaauacuagccucccuuuccagaacauucacccaaucacaaucgguaagugccccaaauauguaaagucgaccaagcugcgccuugcaacggggcugagaaaugugccuucuauucaguccaggggauuguuuggcgcuauagccggcuucaucgaagggggauggaccgguauggucgacggcugguacggguaucaucaccaaaacgagcagggaucaggcuacgcggccgaccucaaaaguacacagaaugcaauugauaagaucacuaacaaagugaauagcguuauagagaagaugaacacccaguuuacagcuguggguaaagaguucaaucaccuggagaagcggauugaaaacuuaaauaagaaagucgacgauggguuccuggacaucuggacuuacaacgccgagcuccuugugcuguuggaaaaugagcgcacccuagauuaucaugacuccaacguaaagaaccuguacgagaaaguucgaaaucaacucaagaacaaugcuaaagaaaucggcaacggauguuuugaguucuaucacaagugcgauaauacauguauggaaucugugaagaacggcaccuacgacuauccaaaauacagcgaggaagccaagcuggauagagagaaaauugacggggucaggcuugagucaacucggaucuaucagauucuggcaauauacaguacgguggccuccagcuugguccucgugguuucucugggagcuaucucauuuuggaugugcaguaaugguagcuuacagugccguauuuguaucuga

SEQ ID NO: 134394 - RNA, 1701 nt, Artificial Sequence
  derived and/or modified sequence opt3 from hemagglutinin__InfluenzaA__AIC73741
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcauugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucagaacgggacauccucugcaugcauucgcggaagcaauuccucauuuuucagucgacugaacuggcucacccacuuaaauuuuaaguauccagcccugaacgugacgaugcccaacaaugagcaauucgacaaguuguacaucuggggcguccaucacccuggcacugauaaagaccagauuuuucuuuaugcucagagcucugggcguaucaccguguccacaaagagaucacagcaagccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcagacacggggcaucuucggcgccauugcaggguuuauagaaaauggaugggaggguaugauggauggcugguauggguuccgucaccaaaacuccgagggacgcggccaggcugccgaccugaaaucuacccaggcggccaucgaucaaauuaaugguaaguugaacagacucaucgggaaaacuaaugaaaaguuccaucagaucgagaaggaauuuagcgagguggaaggcaggauucaggaccuggagaaauacgucgaggauacaaagauagacuuauggucauauaacgcagaacugcucguugcucuugagaaccagcacaccaucgaucugacggacagugaaaugaauaaauuguucgagaagaccaaaaagcaacuacgggaaaacgccgaggauaugggaaauggcugcuuuaagauuuaccaucgaugugacaacgcuugcaucggguccauucgcaauggaacauaugaucacaacguguacagagacgaggcccugaauaacagguuccagauccgggguguagaacucaaaagcggcuacaaggacuggauacuguggaucucuuuugcaauuucaugcuuccuucuguguguggccuugcucggguuuaucaugugggcuugccagaaaggaaauauucgcuguaacaucugcauauga

SEQ ID NO: 134395 - RNA, 1701 nt, Artificial Sequence
  derived and/or modified sequence opt3 from hemagglutinin__InfluenzaA__AIC73742
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuacgccaaucuuauauaaacgauaagggcaaggaaguacugguucuuuggggcauccaccaccccuccacgacuaccgaccagcagucauuguaccagaaugcugaugccuacguguucgucgggacaagccgauauaguaaaaaguuuaaaccugagauugcgauccguccaaaggugagagaccaagagggaaggaugaacuacuauuggacucugguggaacccggugauaaaauuaccuucgaggcaacaggcaaccuagucguuccucgguacgccuuuaccauggaacgcaaugcugggucuggaaucauaauuuccgacacgccagugcaugauugcaacacuacaugucagaccccggagggcgccaucaauacuagccuccccuuccagaacauucacccuaucacaaucgguaagugcccaaaauauguaaagucgaccaagcugagacuugcaacggggcugaggaaugugcccucuauucagucccggggauuguuuggcgcuauagccggcuucaucgaagggggauggaccgguauggucgacggcugguacggguaucaucaccaaaacgagcagggaucaggcuacgcggccgaccucaaaaguacacagaaugcaauugauaagaucacuaacaaagugaauagcguuauagagaagaugaacacccaguuuacagcuguggguaaagaguucaaucaccuggagaagcgcauugaaaacuuaaaucgaaaggucgacgauggguuccuggacaucuggacuuacaacgccgagcuccuugugcuguuggaaaaugagagaacccuagauuaucaugacuccaacguuaaaaaccuguacgagaagguaaggaaucaacucaaaaacaaugcuaaggaaaucggcaacggauguuuugaguucuaucacaaaugcgauaauacauguauggaaucugugaagaacggcaccuacgacuauccuaaguacagcgaggaagccaaacugaaucgggagaagauugauggggucaaacuugagucaacucguaucuaucagauucuggcaauauacaguacgguggccuccagcuugguccucgugguuucucugggagcuaucucauuuuggaugugcaguaacgguagcuuacagugccgcauuuguaucuga

SEQ ID NO: 134396 - RNA, 1701 nt, Artificial Sequence; identical to SEQ ID NO: 134395
  derived and/or modified sequence opt3 from hemagglutinin__InfluenzaA__AIC73743

SEQ ID NO: 134397 - RNA, 1701 nt, Artificial Sequence
  derived and/or modified sequence opt3 from hemagglutinin__InfluenzaA__AIC73744
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaaaccaaucuuauauaaaugauaagggcaaggaaguacugguucuuuggggcauccaccaccccuccacgacugcugaccagcagucauuguaccagaacgccgaugcguacguguucgucgggaccagccgcuauaguaaaaaguuuaaaccugagauugcaauccgaccaaaggugcgugaccaagagggaagaaugaacuacuauuggacacugguggaacccggugauaaaauuacuuucgaggccaccggcaaucuagucguuccuagguacgcuuuuacaauggaacggaacgccgggucuggaaucauaauuuccgacaccccagcacaugauugcaauacgacuugucagacaccggagggcgcuaucaacaccagccuccccuuccagaauauucacccuaucacuaucgguaagugcccaaaauaugugaagucgacaaagcugcgccuugccaccgggcugagaaacguacccucuauucaguccaggggauuguuuggcgcgauagccggcuucaucgaagggggauggacggguaugguggacggcugguacggguaucaucaccaaaaugagcagggaucaggcuacgcagcugaccucaaaaguacccagaacgccauugauaagaucacaaauaaagucaacagcgugauagagaagaugaauacucaguuuaccgcuguugguaaagaguucaaccaccuggagaagcggauugaaaauuuaaacaagaaaguggacgauggguuccuggacaucuggacauacaaugccgagcuccuuguccuguuggaaaacgagcgcacucuagauuaucaugacuccaacgugaagaaucuguacgagaaaguacgaaaccaacucaagaauaacgcaaaagaaaucggcaauggauguuuugaguucuaucacaagugcgauaacaccuguauggaaucuguuaagaauggcacauacgacuauccuaaauacagcgaggaagccaagcugaacagagagaaaauugauggggugaaacuugagucaaccaggaucuaucagauucuggcuauauacaguacugucgcguccagcuuggugcucgucgugucucugggagcaaucucauuuuggaugugcaguaaugguagcuuacagugccggauuuguaucuga

SEQ ID NO: 134398 - RNA, 1701 nt, Artificial Sequence
  derived and/or modified sequence opt3 from hemagglutinin__InfluenzaA__AIC73745
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauugggcccugguggaacccggugauaaaauuacauucgaggcuacuggcaaccuagucguuccuagguacgccuuuaccauggaacggaaugcaggguccggaaucauaauuagcgacacaccagugcaugauugcaacaccacgugucagacuccggagggcgcuaucaauacaucgcuccccuuccagaacauucacccuaucaccaucgguaagugcccaaaauauguaaagucuacuaagcugcgccuugccacagggcugagaaauauucccuccauacagucaaggggauuguuuggcgcgaucgccggcuucauugaagggggauggaccgguaugguggacggcugguacggguaucaucaccaaaacgagcagggaaguggcuacgcagcugaccucaaaagcacgcagaaugccaucgauaagauaaccaacaaagucaauuccgugauugagaagaugaacacacaguuuacugcuguugguaaagaguucaaucaccuggagaagcggaucgaaaacuuaaauaagaaaguggacgauggguuccuggacaucuggaccuacaacgccgagcuccuuguccuguuggaaaaugagcgcacacuagauuaucaugacucuaacgugaagaaccuguacgagaaaguacgaaaucaacucaagaacaaugcaaaagaaauuggcaacggauguuuugaguucuaucacaagugcgauaauacuuguauggaaagcguuaagaacggcaccuacgacuauccuaaauacucagaggaagccaagcugaauagagagaaaaucgauggggugaaacuugagaguacaaggauuuaucagauacuggcuaucuacuccaccgucgcgagcucuuuggugcucgucgugucacugggagcaauuaguuuuuggaugugcagcaacgguuccuuacagugccggaucuguaucuga

SEQ ID NO: 134399 - RNA, 1701 nt, Artificial Sequence
  derived and/or modified sequence opt3 from hemagglutinin__InfluenzaA__AIC73746
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggagugacaccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaagaacucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuaucucaauccuauauaaacgauaagggcaaggaaguacugguucuuuggggcauccaccaccccucaacuaccacagaccagcagagcuuguaccagaaugccgaugcuuacguguucgucgggacuucccgcuauucuaaaaaguuuaaaccugagauugccauccgaccaaaggugcgugaccaagagggaagaaugaacuacuauuggacccugguggaacccggugauaaaauuacauucgaggcgaccggcaaccuagucguuccuagguacgcauuuacgauggaacggaaugccggguccggaaucauaauuagcgacacuccagugcaugauugcaacacaaccugucagacuccggagggcgcuaucaauacaucgcuccccuuccagaacauucacccuaucaccaucgguaagugcccaaaauauguaaagucuacgaagcugcgccuugccaccgggcugagaaaugugcccuccauucagucaaggggauuguuuggcgcaauagcuggcuucaucgaagggggauggacagguauggucgacggcugguacggguaucaucaccaaaacgagcagggaaguggcuacgccgcggaccucaaaagcacucagaaugccauugauaagaucaccaacaaagugaauaguguuauagagaagaugaacacacaguuuacugcaguggguaaagaguucaaucaccuggagaagcggauugaaaacuuaaauaagaaagucgacgauggguuccuggacaucuggaccuacaacgcugagcuccuugugcuguuggaaaaugagcgcacacuagauuaucaugacucuaacguaaagaaccuguacgagaaaguucgaaaucaacucaagaacaaugccaaagaaaucggcaacggauguuuugaguucuaucacaagugcgauaauaccuguauggaaagcgugaagaacggcacuuacgacuauccuaaauacucagaggaagcuaagcugaauagagagaaaauugauggggucaaacuugagaguacgaggaucuaucagauucuggccauauacuccacaguggcaagcucuuugguccucgugguuucacugggagccaucaguuuuuggaugugcagcaacgguuccuuacagugccggauuuguaucuga

SEQ ID NO: 134400 - RNA, 1701 nt, Artificial Sequence
  derived and/or modified sequence opt3 from hemagglutinin__InfluenzaA__AIC73747
augaaggccauccuggugguccuccuuuacacccuggcuacagcaaacgccgacacuuugugcauuggcuaucacgcgaauaacagcacggauaccguugacacaguguuagagaaaaauguaacugugacccauuccgucaaccugcuagaagauaagcacaaugggaaacucuguaagcugagaggaguggcuccccuucaucuggguaaaugcaacauagccggcuggaucuuggggaauccugagugugaaucucucucaacagcaaguagcugguccuacauuguugagaccucuucgucagacaacggaacuugcuauccaggcgauuucaucaauuacgaggaacugagggagcagcugagcaguguguccucuuuugaacgguucgagauuuuuccgaagacaagcuccuggcccaaccacgacucaaauaagggugucaccgccgcuuguccucaugcaggggccaaaaguuucuauaagaaccucaucugguuagugaaaaagggaaauagcuacccaaaacugucucaauccuauauaaacgauaagggcaaggaaguacuuguuuuguggggcauccaccaccccucaacgacugcugaccagcagagccuguaccagaaugccgaugcguacguguuugucgggaccagucgcuauucuaaaaaguucaaaccugagauugcaauccgaccaaaggugcgugaccaagagggaagaaugaacuacuauuggacacuuguggaacccggugauaaaauuacuuuugaggccaccggcaaccucgucguuccuagguacgcuuucacaauggaacggaauaccggguccggaaucauaauuagcgacacgccagugcaugauugcaacacuacaugucagaccccggagggcgccaucaauacuucgcugcccuuucagaacauucacccuaucacaaucgguaagugcccaaaauauguaaagucuaccaagcuacgccuggcaacgggguugagaaaugugcccuccauucagucaaggggacucuucggcgcuauagccggcuuuaucgaagggggauggaccgguauggucgacggcugguacggguaucaucaccaaaacgagcagggaaguggcuacgcggccgaccugaaaagcacacagaaugcaauugauaagaucacuaacaaaguuaauuccgugauagagaagaugaacacccaguucacagcuguggguaaagaauuuaaucacuuagagaagcggauugaaaaccugaauaagaaagucgacgauggguuccucgacaucuggacuuacaacgccgagcuucugguguugcuagaaaaugagcgcacccuggauuaucaugacucuaacguaaagaaccucuacgagaaaguucgaaaucaacugaagaacaaugcuaaagaaaucggcaacggauguuucgaguuuuaucacaagugcgauaauacauguauggaaagcgugaagaacggcaccuacgacuauccuaaauacucagaggaagccaaacuuaauagagagaagauugauggggucaagcuggagaguacuaggaucuaucagauuuuggcaauauacuccacgguggccagcucucucguccuggugguuucauuaggagcuaucaguuucuggaugugcagcaacgguucccugcagugccggauuuguaucuga

SEQ ID NO: 134401 - RNA, 1701 nt, Artificial Sequence; identical to SEQ ID NO: 132056
  derived and/or modified sequence opt3 from hemagglutinin__InfluenzaA__AIC73748

SEQ ID NO: 134402 - RNA, 1701 nt, Artificial Sequence
  derived and/or modified sequence opt3 from hemagglutinin__InfluenzaA__AIC73749
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcaaaaacuguacacucaucgacgcucugcuuggggauccgcagugcgacggauuucagaauaagaggugggaucuguucguggaacggagcaaagccuauuccaacuguuaccccuaugacgucccugauuacgcaucuuugcgcucgcucguggccucaagcggcacccuggaguuuaaugacgaaaguuucaacugggcugguguuacucaaaaugggacauccucugcaugcauucgaggaagcaacuccucauuuuucagucgucugaauuggcucacccauagcaacuuuaaguauccagccuuaaaugugacgaugcccaacaacgagcaguucgauaagcuguacaucuggggcguccaccauccuggcacugacaaagaucagauuuuucuuuaugcucacucuuccgggagaaucaccgugucaacaaagaggagccagcaagccguaauaccaaauauuggaagucggccccgcaucagaaacauuccuucuaggaucuccaucuacuggacuauuguuaaaccaggugacauauugcugaucaauagcaccggcaaccuaauugcgccgcggggguacuucaagauccagucgggaaaaucuuccauaaugcgcucagacgcacccauuggcaaguguaagagugagugcaucacaccuaaugguagcaucaccaacgauaaaccauuucagaaugugaaccgaauuacguauggggccugucccagauacgucaagcaguccacucucaaacuggcuacaggaaugaggaaugugccugaaaagcaaacccggggcaucuucggcgccauugcaggguuuauagagaacggaugggaagguaugaaagacggcugguauggguuccgucaccaaaauucugagggacgcggccaggcugccgaucuuaagagcacucaggcggccaucgaccagauuaacgguaaacugaauagauugaucgggaagacaaacgagaaguuccaucagaucgaaaaagaguuuucagaaguggagggcaggauucaggaucucgaaaaguacgucgaggacaccaaaauagaucuguggaguuauaaugcagaguuacugguugcucucgaaaaccaacacacgaucgaccuuaccgauuccgagaugaacaagcuguucgagaaaacaaagaagcaguugcgggaaaaugccgaagacaugggaaacggcugcuuuaaaauuuaccauaagugugauaaugcuugcaucgggagcauucgaaacggaacuuaugaccacgacguguaccgcgaugaggcccuaaauaacagauuccagaucaaagguguagagcugaagucuggcuacaaagacuggauacucuggaucucauuugcaauuaguugcuuccugcuuuguguggcccuguugggguuuaucaugugggcuugccagaagggaaauauuagguguaacaucugcauauga

SEQ ID NO: 134403 - RNA, 1701 nt, Artificial Sequence; identical to SEQ ID NO: 132056
  derived and/or modified sequence opt3 from hemagglutinin__InfluenzaA__AIC73750

SEQ ID NO: 134404 - RNA, 1701 nt, Artificial Sequence
  derived and/or modified sequence opt3 from hemagglutinin__InfluenzaA__AIC73754
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucucgaaaauuuaagccugagauugcaauccguccaaaagugagagaccaagagggaaggaugaacuacuauuggacacugguggaacccggugauaagauuacuuucgaggccaccggcaaccuagucguuccucgguacgcuuuuacaauggaacgcaaugccggguccggaaucauaauuagcgacaccccagugcaugauugcaacacgacuugucagacaccggagggcgcaaucaauaccucgcuccccuuccagaacauucacccuaucacuaucgguaaaugcccaaaguauguaaaaucuacaaagcugagacuugcuaccgggcugaggaaugugcccuccauucagucacggggauuguuuggcgccauagcgggcuucaucgaagggggauggacggguauggucgacggcugguacggguaucaucaccaaaacgagcagggaaguggcuacgccgcagaccucaagagcacccagaaugcuauugauaaaaucacaaacaagguaaauuccguuauagagaaaaugaacacucaguuuaccgccguggguaaggaguucaaucaccuggagaaacgcauugaaaacuuaaauaagaaggucgacgauggguuccuggacaucuggacauacaacgcugagcuccuugugcuguuggaaaaugagcgaacucuagauuaucaugacucuaacgugaaaaaccuguacgagaagguuagaaaucaacucaaaaacaaugccaaggaaaucggcaacggauguuuugaguucuaucacaaaugcgauaauaccuguauggaaagcgugaagaacggcacauacgacuauccuaaguacucagaggaagcaaaacugaauagggagaagauugauggggucaaacuugagaguacccggaucuaucagauucuggccauauacuccacuguggcuagcucuuugguccucgugguuucacugggagcgaucaguuuuuggaugugcagcaacgguuccuuacagugccguauuuguaucuga

SEQ ID NO: 134405 - RNA, 1701 nt, Artificial Sequence; identical to SEQ ID NO: 132056
  derived and/or modified sequence opt3 from hemagglutinin__InfluenzaA__AIC73755

SEQ ID NO: 134406 - RNA, 1701 nt, Artificial Sequence; identical to SEQ ID NO: 132056
  derived and/or modified sequence opt3 from hemagglutinin__InfluenzaA__AIC73756

SEQ ID NO: 134407 - RNA, 1701 nt, Artificial Sequence; identical to SEQ ID NO: 132056
  derived and/or modified sequence opt3 from hemagglutinin__InfluenzaA__AIC73757

SEQ ID NO: 134408 - RNA, 1701 nt, Artificial Sequence
  derived and/or modified sequence opt3 from hemagglutinin__InfluenzaA__AIC73758
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaauagcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauuaauuacgaagaacucagggagcagcugagcaguguuuccucuuucgaacgguuugagaucuucccgaagacaagcuccuggcccaaccacgacucaaauaagggugugaccgccgcuuguccucaugcaggggccaaaaguuuuuauaagaaccugauauggcucgucaaaaagggaaauagcuacccaaaauuaucucaauccuauaucaacgauaagggcaaggaagugcugguacuuuggggcauucaccaccccucaacgacugcugaccagcagagcuuguaccagaaugccgaugcguacguuuucguggggaccagucgcuauucuaaaaaguuuaaaccugagaucgcaauucgaccaaagguccgugaccaagagggaagaaugaacuacuauuggacacugguggaacccggugauaaaaucacuuucgaggccaccggcaaccuaguggucccuagguacgcuuuuacaauggaacggaaugccggguccggaauaauuaucagcgacaccccaguucaugauugcaacacgacuugucagacaccggagggcgcaauuaauaccucgcuccccuuccagaacauccacccuaucacuauugguaagugcccaaaauaugugaagucuacaaagcugcgccuugcuaccgggcugagaaauguacccuccauacagucaaggggauuguuuggcgccaucgcgggcuucauugaagggggauggacggguaugguggacggcugguacggguaucaucaccaaaacgagcagggaaguggcuacgccgcagaccucaaaagcacccagaaugcuaucgauaagauaacaaacaaagucaauuccgugauugagaagaugaacacucaguuuaccgccguugguaaagaguucaaucaccuggagaagcggaucgaaaacuuaaauaagaaaguggacgauggguuccuggacaucuggacauacaacgcugagcuccuuguccuguuggaaaaugagcgcacucuagauuaucaugacucuaacgugaagaaccuguacgagaaaguacgaaaucaacucaagaacaaugccaaagaaauuggcaacggauguuuugaguucuaucacaagugcgauaauaccuguauggaaagcguuaagaacggcacauacgacuauccuaaauacucagaggaagcaaagcugaauagagagaaaaucgauggggugaaacuugagaguaccaggauuuaucagauacuggccaucuacuccacugucgcuagcucuuuggugcucgucgugucacugggagcgauuaguuuuuggaugugcagcaacgguuccuuacagugccggaucuguaucuga

SEQ ID NO: 134409 - RNA, 1701 nt, Artificial Sequence
  derived and/or modified sequence opt3 from hemagglutinin__InfluenzaA__AIC73760
augaaggccauccugauugugcuccuuuacaccuucgcuacagcaaacgccgacacucugugcauaggcuaucacgcgaauaacagcacggauaccgucgacacaguuuuggagaagaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauuaauuacgaagaacucagggagcagcugagcaguguuuccucuuucgaacgguuugagaucuucccgaagacaagcuccuggcccaaccacgacucaaauaagggugugaccgccgcuuguccucaugcaggggccaaaaguuuuuauaagaaccugauauggcucgucaaaaagggaaauagcuacccaaaauuaucucaauccuauaucaacgauaagggcaaggaagugcugguacuuuggggcauucaccaccccucaacgacugcugaccagcagagcuuguaccagaaugccgaugcguacguuuucguggggaccagucgcuauucuaaaaaguuuaaaccugagaucgcaauucgaccaaagguccgugaccaagagggaagaaugaacuacuauuggacacugguggaacccggugauaaaaucacuuucgaggccaccggcaaccuaguggucccuagguacgcuuuuacaauggaacggaaugccggguccggaauaauuaucagcgacaccccaguucaugauugcaacacgacuugucagacaccggagggcgcaauuaauaccucgcuccccuuccagaacauccacccuaucacuauugguaagugcccaaaauaugugaagucuacaaagcugcgccuugcuaccgggcugagaaauguacccuccauacagucaaggggauuguuuggcgccaucgcgggcuucauugaagggggauggacggguaugguggacggcugguacggguaucaucaccaaaacgagcagggaaguggcuacgccgcagaccucaaaagcacccagaaugcuaucgauaagauaacaaacaaagucaauuccgugauugagaagaugaacacucaguuuaccgccguugguaaagaguucaaucaccuggagaagcggaucgaaaacuuaaauaagaaaguggacgauggguuccuggacaucuggacauacaacgcugagcuccuuguccuguuggaaaaugagcgcacucuagauuaucaugacucuaacgugaagaaccuguacgagaaaguacgaaaucaacucaagaacaaugccaaagaaauuggcaacggauguuuugaguucuaucacaagugcgauaauaccuguauggaaagcguuaagaacggcacauacgacuauccuaaauacucagaggaagcaaagcugaauagagagaaaaucgauggggugaaacuugagaguaccaggauuuaucagauacuggccaucuacuccacugucgcuagcucuuuggugcucgucgugucacugggagcgauuaguuuuuggaugugcagcaacgguuccuuacagugccggaucuguaucuga

SEQ ID NO: 134410 - RNA, 1701 nt, Artificial Sequence; identical to SEQ ID NO: 134409
  derived and/or modified sequence opt3 from hemagglutinin__InfluenzaA__AIC73761

SEQ ID NO: 134411 - RNA, 1701 nt, Artificial Sequence; identical to SEQ ID NO: 133936
  derived and/or modified sequence opt3 from hemagglutinin__InfluenzaA__AIC73762

SEQ ID NO: 134412 - RNA, 1701 nt, Artificial Sequence
  derived and/or modified sequence opt3 from hemagglutinin__InfluenzaA__AIC73763
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaaauaucucaauccuauaucaacgauaagggcaaggaaguauuaguucuguggggcauucaccaccccucaacgacugcugaccagcagagccuuuaccagaaugccgaugcguacguguucgucgggaccagucgcuauucuaaaaaguuuaaaccugagaucgcaauucgaccaaaggugcgugaccaagagggaagaaugaacuacuauuggacauugguggaacccggugauaaaaucacuuucgaggccaccggcaaccuggucguuccuagguacgcuuuuacaauggaacggaaugccggguccggaauaauuaucagcgacaccccagugcaugauugcaacacgacuugucagacaccggagggcgcaauuaauaccucgcuacccuuccagaacauccacccuaucacuauugguaagugcccaaaauauguaaagucuacaaagcuccgccuggcuaccgggcuuagaaaugugcccuccauacagucaaggggacuguuuggcgccaucgcgggcuucauugaagggggauggacggguauggucgacggcugguacggguaucaucaccaaaacgagcagggaaguggcuacgccgcagacuugaaaagcacccagaaugcuaucgauaagauaacaaacaaaguuaauuccgugauugagaagaugaacacucaguuuaccgccguggguaaagaguucaaucaccucgagaagcggaucgaaaaccugaauaagaaagucgacgauggguucuuagacaucuggacauacaacgcugagcugcucgugcuucuggaaaaugagcgcacuuuggauuaucaugacucuaacguaaagaaccuauacgagaaaguucgaaaucaacugaagaacaaugccaaagaaauuggcaacggauguuuugaguucuaucacaagugcgauaauaccuguauggaaagcgugaagaacggcacauacgacuauccuaaauacucagaggaagcaaagcucaauagagagaaaaucgauggggucaagcuggagaguaccaggauuuaucagauacuugccaucuacuccacuguggcuagcucucuggucuuggugguuucacucggagcgauuaguuuuuggaugugcagcaacgguucccugcagugccggaucuguaucuga

SEQ ID NO: 134413 - RNA, 1701 nt, Artificial Sequence; identical to SEQ ID NO: 132056
  derived and/or modified sequence opt3 from hemagglutinin__InfluenzaA__AIC73765

SEQ ID NO: 134414 - RNA, 1701 nt, Artificial Sequence; identical to SEQ ID NO: 132056
  derived and/or modified sequence opt3 from hemagglutinin__InfluenzaA__AIC73766

SEQ ID NO: 134415 - RNA, 1701 nt, Artificial Sequence
  derived and/or modified sequence opt3 from hemagglutinin__InfluenzaA__AIC73767
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucauaaagaagggaaauagcuacccaaaauuaucucaauccuauaucaacgauaagggcaaggaagugcugguacuuuggggcauucaccaccccucaacgacugcugaccagcagagcuuguaccagaaugccgaugcguacguuuucguggggaccagucgcuauucuaaaaaguuuaaaccugagaucgcaauucgaccaaagguccgugaccaagagggaagaaugaacuacuauuggacacugguggaacccggugauaaaaucacuuucgaggccaccggcaaccuaguggucccuagguacgcuuuuacaauggaacggaaugccggguccggaauaauuaucagcgacaccccaguucaugauugcaacacgacuugucagacaccggagggcgcaauuaauaccucgcuccccuuccagaacauccacccuaucacuauugguaagugcccaaaauaugugaagucuacaaagcugcgccuugcuaccgggcugagaaauauacccuccauccagucaaggggauuguuuggcgccauugcgggcuucaucgaagggggauggacggguaugguagacggcugguacggguaucaucaccaaaacgagcagggaaguggcuacgccgcagaccucaaaagcacccagaaugcuauagauaagauuacaaacaaagucaauuccgugaucgagaagaugaacacucaguuuaccgccguggguaaagaguucaaucaccuggagaagcggaucgaaaacuuaaauaagaaaguugacgauggguuccuggacauuuggacauacaacgcugagcuccuugugcuguuggaaaaugagcgcacucuagauuaucaugacucuaacgucaagaaccuguacgagaaaauccgaaaucaacucaagaacaaugccaaagaaauuggcaacggauguuuugaguucuaucacaagugcgauaauauguguauggaaagcgugaagaacggcaccuacgacuauccuaaauacucagaggaagcaaagcugaauagagagaaaauagaugggguaaaacuugagaguacaaggaucuaucagauucuggccaucuacuccaccguugcuagcucuuuggugcucgucgugucacugggagcgaucaguuuuuggaugugcagcaacgguuccuuacagugccggauuuguauauga

SEQ ID NO: 134416 - RNA, 1701 nt, Artificial Sequence; identical to SEQ ID NO: 132056
  derived and/or modified sequence opt3 from hemagglutinin__InfluenzaA__AIC73768

SEQ ID NO: 134417 - RNA, 1701 nt, Artificial Sequence; identical to SEQ ID NO: 132056
  derived and/or modified sequence opt3 from hemagglutinin__InfluenzaA__AIC73769

SEQ ID NO: 134418 - RNA, 1701 nt, Artificial Sequence; identical to SEQ ID NO: 132056
  derived and/or modified sequence opt3 from hemagglutinin__InfluenzaA__AIC73770

SEQ ID NO: 134419 - RNA, 1701 nt, Artificial Sequence; identical to SEQ ID NO: 132056
  derived and/or modified sequence opt3 from hemagglutinin__InfluenzaA__AIC73771

SEQ ID NO: 134420 - RNA, 1701 nt, Artificial Sequence
  derived and/or modified sequence opt3 from hemagglutinin__InfluenzaA__AIC73772
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccucaaaagcacccagaaugcuauugauaagaucacaaacaaaguuaauuccgugauagagaagaugaacacucaguuuaccgccguggguaaagaguucaaucaccuggagaagcggauugaaaacuuaaauaagaaagucgacgauggguuccuggacaucuggacauacaacgcugagcuccuugugcuguuggaaaaugagcgcacucuagauuaucaugacucuaacguaaagaaccuguacgagaaaguucgaaaucaacucaagaacaaugccaaagaaaucggcaacggauguuuugaguucuaucacaagugcgauaauaccuguauggaaagcgugaagaacggcacauacgacuauccuaaauacucagaggaagcaaagcugaauagagagaaaauugauggggucaaacuugagaguaccaggguguaucagauccuggccauuuacuccacugucgcuagcucuuuggugcucguugugucacugggagcgauaaguuuuuggaugugcagcaacgguuccuuacagugccggaucuguauuuga

SEQ ID NO: 134421 - RNA, 1701 nt, Artificial Sequence; identical to SEQ ID NO: 132056
  derived and/or modified sequence opt3 from hemagglutinin__InfluenzaA__AIC73773

SEQ ID NO: 134422 - RNA, 1701 nt, Artificial Sequence; identical to SEQ ID NO: 132056
  derived and/or modified sequence opt3 from hemagglutinin__InfluenzaA__AIC73775

SEQ ID NO: 134423 - RNA, 1701 nt, Artificial Sequence; identical to SEQ ID NO: 132056
  derived and/or modified sequence opt3 from hemagglutinin__InfluenzaA__AIC73776

SEQ ID NO: 134424 - RNA, 1701 nt, Artificial Sequence; identical to SEQ ID NO: 134420
  derived and/or modified sequence opt3 from hemagglutinin__InfluenzaA__AIC73777

SEQ ID NO: 134425 - RNA, 1701 nt, Artificial Sequence
  derived and/or modified sequence opt3 from hemagglutinin__InfluenzaA__AIC73778
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagcccauuccaacuguuaucccuacgacgucccugauuaugcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcacuuaaauuuuaaguacccagcacugaacgugacuaugcccaacaaugagcaguucgacaaacuuuauaucuggggaguccaucacccuggcaccgauaaagaccagaucuuuuuguacgcccagagcucuggcagaauuacaguguccacuaagaggucacaacaggcuguaauaccaaacauugggagccggccccgcaucagaaauauuccuaguaggaucucuaucuauuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguacggugcauguccuagguaugucaagcagagcacucugaaacuugccacagggaugcggaacgugccagagaagcaaacccguggaaucuucggcgcuauugccggcuuuauagaaaaugggugggagggaaugguggaugguugguacggcuuccgccaccagaacuccgaggggagaggacaggcagcugaccugaaaucuacucaagccgcgaucgaucagauuaauggcaaguugaacaggcucaucgguaaaacaaaugaaaaguuccaucagaucgagaaggaauuuagcgaggucgaagggcggauucaggaccuggagaaauauguugaggauaccaagauagacuuauggucauacaacgccgaacugcucguggcacuugagaaccaacacacgaucgaucugaccgacagugaaaugaauaaauuguucgagaagacaaagaagcagcuacgagaaaacgcugaggauaugggcaauggaugcuuuaagauuuaucauaaaugugacaacgccugcaucggcuccauucgcaaugggacuuacgaucacaacguauauagagacgaggcucugaauaacagguuccagaucaagggaguggaacucaaaagcgguuacaaggacuggauacuguggaucucuuuugccauuucaugcuuccuucugugugucgcauugcucggcuuuaucaugugggccugccagaaagggaauauucgguguaacaucugcauauga

SEQ ID NO: 134426 - RNA, 1701 nt, Artificial Sequence; identical to SEQ ID NO: 134425
  derived and/or modified sequence opt3 from hemagglutinin__InfluenzaA__AIC73779

SEQ ID NO: 134427 - RNA, 1701 nt, Artificial Sequence; identical to SEQ ID NO: 134425
  derived and/or modified sequence opt3 from hemagglutinin__InfluenzaA__AIC73780

SEQ ID NO: 134428 - RNA, 1701 nt, Artificial Sequence; identical to SEQ ID NO: 133014
  derived and/or modified sequence opt3 from hemagglutinin__InfluenzaA__AIC73781

SEQ ID NO: 134429 - RNA, 1701 nt, Artificial Sequence; identical to SEQ ID NO: 134425
  derived and/or modified sequence opt3 from hemagglutinin__InfluenzaA__AIC73782

SEQ ID NO: 134430 - RNA, 1701 nt, Artificial Sequence; identical to SEQ ID NO: 134425
  derived and/or modified sequence opt3 from hemagglutinin__InfluenzaA__AIC73783

SEQ ID NO: 134431 - RNA, 1701 nt, Artificial Sequence; identical to SEQ ID NO: 134425
  derived and/or modified sequence opt3 from hemagglutinin__InfluenzaA__AIC73784

SEQ ID NO: 134432 - RNA, 1701 nt, Artificial Sequence; identical to SEQ ID NO: 132056
  derived and/or modified sequence opt3 from hemagglutinin__InfluenzaA__AIC73785

SEQ ID NO: 134433 - RNA, 1701 nt, Artificial Sequence; identical to SEQ ID NO: 134425
  derived and/or modified sequence opt3 from hemagglutinin__InfluenzaA__AIC73786

SEQ ID NO: 134434 - RNA, 1701 nt, Artificial Sequence; identical to SEQ ID NO: 132056
  derived and/or modified sequence opt3 from hemagglutinin__InfluenzaA__AIC73787

SEQ ID NO: 134435 - RNA, 1701 nt, Artificial Sequence; identical to SEQ ID NO: 132056
  derived and/or modified sequence opt3 from hemagglutinin__InfluenzaA__AIC73788

SEQ ID NO: 134436 - RNA, 1701 nt, Artificial Sequence
  derived and/or modified sequence opt3 from hemagglutinin__InfluenzaA__AIC73789
augaagaccaucauugcccugagcuacauacucugccuuguguucgcucagaaacccccuggcaacgacaauuccacagcaacucuguguuuggggcaccaugccgucccaaacggaacgaucguuaagaccauuacaaaugauagaaucgaggugacuaacgcgaccgaauuaguacaaaauucuucaauuggugagaucugcgacaguccgcaccagauacuggauggcgaaaacuguacacuaaucgacgcucuccugggggauccccagugcgacggauuucagaauaaaaagugggaucuuuucguggagaggagcaaagccuauuccaacuguuacccuuaugacgucccagauuacgcaucucugcggucguugguggccucaagcggcacccucgaauuuaauaacgagaguuucaauugggcugguguuacucaaaacgggacauccucugcaugcauucgcggaagcaauuccucauuuuucagucgacugaacuggcugacccaucucaauuuuaaguaucccgccuuaaacgugacgaugccuaacaaugagcaguucgacaagcuguacaucuggggcguccaccauccaggcacugauaaagaccagauuuuucuuuaugcucagagcucugggcguaucaccguguccacaaagagaucacaacaggccguaauacccaacauuggaagcaggccucggauccgcaauauuccaaguagaaucucuaucuacuggacuauuguuaaaccgggugauauauugcugaucaacuccaccggcaaucuaauugcgcccaggggguacuucaagauccggagcggaaaaucgucuauaaugcgcuccgacgcaccuauuggcaaguguaagucagaaugcaucacaccaaacgguaguauccccaaugacaaaccuuuucagaacgugaaucgaauuaccuauggggccuguccaagauacgucaagcagagcacgcucaaacuggcuacuggaaugaggaacgugcccgagaagcaaacacggggcaucuucggcgccauugcaggguuuauagaaaauggaugggaggguaugguggauggcugguauggguuccgucaccagaacuccgagggacgcggccaggcugccgaccuuaaaucuacccaagcggccaucgaucagauuaaugguaagcugaacagauugaucgggaaaacuaaugaaaaguuccaccagaucgagaaggaauuuagcgaggucgaaggcaggauucaggaccucgagaaauacguugaggauacaaagauagaccuguggucauauaacgcagaauuacugguggcucucgagaaccaacauaccaucgaucuuacggacagugaaaugaauaaacuguucgagaagaccaaaaagcaguugcgggaaaacgccgaggauaugggaaauggcugcuuuaagauuuaccacaaaugugacaacgcuugcaucggguccauucgaaauggaacauaugaucaugacguauaccgcgacgaggcccuaaacaauagauuccagaucaaggguguggaacugaaaagcggcuacaaggauuggauacucuggaucucuuuugcaauuucaugcuuccugcuuugugucgugcuguugggguuuaucaugugggccugccagaaaggaaacauuagguguaauaucugcauauga

SEQ ID NO: 134437 - RNA, 1701 nt, Artificial Sequence
  derived and/or modified sequence opt3 from hemagglutinin__InfluenzaA__AIC73790
augaaggccauccuggugguccuccuuuacaccuucgcuacaacuaacgcagacacgcugugcauuggcuaucacgccaauaacagcaccgauacaguugacacuguguuggagaagaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaagaacucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuacgccaaucuuauauaaacgauaagggcaaggaaguacugguucuuuggggcauccaccaccccuccacuaccacagaccagcagucauuguaccagaaugccgaugcuuacguguucgucgggacuagccgauauaguaaaaaguuuaaaccugagauugccauccguccaaaggugagagaccaagagggaaggaugaacuacuauuggacccugguggaacccggugauaaaauuacauucgaggcgaccggcaaccuagucguuccucgguacgcauuuacgauggaacgcaaugccgggucuggaaucauaauuuccgacacuccagugcaugauugcaacacaaccugucagacuccggagggcgcuaucaauacaagccuccccuuccagaacauucacccuaucaccaucgguaagugcccaaaauauguaaagucgacgaagcugagacuugccaccgggcugaggaaugugcccucuauucagucccggggauuguuuggcgcaauagcuggcuucaucgaagggggauggacagguauggucgacggcugguacggguaucaucaccaaaacgagcagggaucaggcuacgccgcggaccucaaaaguacucagaaugccauugauaagaucaccaacaaagugaauagcguuauagagaagaugaacacacaguuuacugcaguggguaaagaguucaaucaccuggagaagcgcauugaaaacuuaaauaagaaagucgacgauggguuccuggacaucuggaccuacaacgcugagcuccuugugcuguuggaaaaugagcgaacacuagauuaucaugacuccaacguaaagaaccuguacgagaaaguuagaaaucaacucaagaacaaugccaaagaaaucggcaacggauguuuugaguucuaucacaagugcgauaauaccuguauggaaucugugaagaacggcacuuacgacuauccuaaauacagcgaggaagcuaagcugaauagggagaaaauugauggggucaaacuugagucaacgcggaucuaucagauucuggccauauacaguacaguggcauccagcuugguccucgugguuucucugggagccaucucauuuuggaugugcaguaacgguagcuuacagugccguauuuguaucuga

SEQ ID NO: 134438 - RNA, 1701 nt, Artificial Sequence
  derived and/or modified sequence opt3 from hemagglutinin__InfluenzaA__AIC73791
augaaggccauccuggugguccuccuuuacaccuucgcuacagcaaacgccgacacucugugcauuggcuaucacgcgaauaacagcacggauaccauagacacaguuuuggagaagaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauuaauuacgaagaacucagggagcagcugagcaguguuuccucuuucgaacgguuugagaucuucccgaagacaagcuccuggcccaaccacgacucaaauaagggugugaccgccgcuuguccucaugcaggggccaaaaguuuuuauaagaaccugauauggcucgucaaaaagggaaauagcuacccaaaauuaucucaauccuauaucaacgauaagggcaaggaagugcugguacuuuggggcauucaccaccccucaacgacugcugaccagcagagcuuguaccagaaugccgaugcguacguuuucguggggaccagucgcuauucuaaaaaguuuaaaccugagaucgcaauucgaccaaagguccgugaccaagagggaagaaugaacuacuauuggacacugguggaacccggugauaaaaucacuuucgaggccaccggcaaccuaguggucccuagguacgcuuuuacaauggaacggaaugccggguccggaauaauuaucagcgacaccccaguucaugauugcaacacgacuugucagacaccggagggcgcaauuaauaccucgcuccccuuccagaacauccacccuaucacuauugguaagugcccaaaauaugugaagucuacaaagcugcgccuugcuaccgggcugagaaauguacccuccauacagucaaggggauuguuuggcgccaucgcgggcuucauugaagggggauggacggguaugguggacggcugguacggguaucaucaccaaaacgagcagggaaguggcuacgccgcagaccucaaaagcacccagaaugcuaucgauaagauaacaaacaaagucaauuccgugauugagaagaugaacacucaguuuaccgccguugguaaagaguucaaucaccuggagaagcggaucgaaaacuuaaauaagaaaguggacgauggguuccuggacaucuggacauacaacgcugagcuccuuguccuguuggaaaaugagcgcacucuagauuaucaugacucuaacgugaagaaccuguacgagaaaguacgaaaucaacucaagaacaaugccaaagaaauuggcaacggauguuuugaguucuaucacaagugcgauaauaccuguauggaaagcguuaagaacggcacauacgacuauccuaaauacucagaggaagcaaagcugaauagagagaaaaucgauggggugaaacuugagaguaccaggauuuaucagauacuggccaucuacuccacugucgcuagcucuuuggugcucgucgugucacugggagcgauuaguuuuuggaugugcagcaacgguuccuuacagugccggaucuguaucuga

SEQ ID NO: 134439 - RNA, 1701 nt, Artificial Sequence; identical to SEQ ID NO: 132056
  derived and/or modified sequence opt3 from hemagglutinin__InfluenzaA__AIC73792

SEQ ID NO: 134440 - RNA, 1701 nt, Artificial Sequence; identical to SEQ ID NO: 134420
  derived and/or modified sequence opt3 from hemagglutinin__InfluenzaA__AIC73793

SEQ ID NO: 134441 - RNA, 1701 nt, Artificial Sequence
  derived and/or modified sequence opt3 from hemagglutinin__InfluenzaA__AIC73794
augaagaccaucauuggcgugagcuacauacugugccucgucuucgcccagaaacuucccgggaacgacaauuccacagcuacucuguguuugggacaccaugcaguuccuaacgguacgaucgugaagaccauuacaaaugauagaaucgagguaacuaacgccaccgaauuagugcaaaauucuucaauuggcgagaucugcgacaguccacaccagauacuggauggggaaaacuguacacuaaucgacgcgcuccugggagauccgcagugcgacggcuuucagaauaaaaagugggaucuuuucgucgagaggagcaaggcuuauuccaacuguuaccccuaugacgugccugauuacgccucucugcggucguugguugcaucaagcgguacccucgaauuuaauaacgagaguuucaauugggccggggugacucaaaacggaacauccucuagcugcauucgcggcuccaauucaaguuucuucagccgacugaacuggcugacccaucucaauucuaaauauccagcuuuaaacgucacgaugcccaacaaugagcaguuugacaagcuguacaucuggggcgugcaccauccugggacugauaaagaccagauuuuccuuuaugcacaguccucaggacguaucaccguaagcacaaagagaagucaacaggccguuauaccaaacauugguucuaggccccggauccgcgauauuccuuccagaaucagcaucuacuggacuauugugaaaccaggcgacauauugcugaucaauucgaccgggaaccuaauugcuccgaggggauacuuuaagauccggucuggcaaauccucaauaaugcgcagugacgcccccauugguaaguguaagagcgaaugcaucacaccuaauggguccaucccaaacgauaaacccuuccagaaugucaaccgaauuaccuauggagcguguccuagauacgugaagcagucuacgcucaaacuggcaacuggcaugaggaaugugccagagcggcaaacacguggcaucuuuggggccauugcuggauucauagaaaacgguugggagggcauggucgacgggugguauggauuucgccaccagaauagcgagggcagaggucaggccgcagaucuuaagucaacccaagcugccaucgaccagauuaacgggaaacugaauagguugaucggcaagacuaacgaaaaauuccaccagaucgagaaggaauuuagugagguugaaggacggauucaggaucucgagaaguacguggaggacacaaaaauagaucugugguccuauaaugcggaauuacugguagcccucgagaaccaacauaccaucgaccuuacggauagcgaaaugaacaagcuguuugagaaaaccaagaaacaguugcgagaaaaugcagaggacaugggcaacgggugcuucaagauuuaccacaagugugauaaugcuugcaucggaucuauucgcaacgguacauaugaccaugacguguacagagaugaggcccuaaauaacagguuucagaucaaaggcgucgaacugaagucaggguacaaagacuggauacucuggaucaguuucgcuauuagcugcuuucugcuuuguguggcccuguugggauucaucaugugggcaugccagaagggcaauauucgguguaacaucugcauauga

SEQ ID NO: 134442 - RNA, 1701 nt, Artificial Sequence; identical to SEQ ID NO: 132056
  derived and/or modified sequence opt3 from hemagglutinin__InfluenzaA__AIC73796

SEQ ID NO: 134443 - RNA, 1701 nt, Artificial Sequence
  derived and/or modified sequence opt3 from hemagglutinin__InfluenzaA__AIC73797
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucuagcugcauucgcggauccaauucaaguuucuucagccgacugaacuggcucacccauuuaaauucuaaguauccagcacugaacgugacgaugcccaacaaugagcaguuugacaaacuuuacaucuggggcguccaccauccuggcacugauaaggaccagauuuucuuguaugcccaguccucagggcguaucaccgugagcacaaagagaagucaacaggcuguaauaccaaacauuggaucuaggccccggauccgcgauauuccuuccagaaucagcaucuacuggacuauuguuaaaccaggugacauacugcuaaucaauucgaccggcaaccucauugccccgaggggguacuuuaagauccggucuggaaaauccucaauaaugcgcagugacgcgcccauuggcaaguguaagagcgaaugcaucacaccuaaugguuccaucccaaacgauaaacccuuccagaaugugaaccgaauuaccuauggggcauguccuagauacgucaagcagucuacgcugaaacuugccacuggaaugaggaaugugccagagcggcaaacacguggcaucuuuggcgcuauugccggguucauagaaaacggaugggaggguaugguggacggcugguauggguuucgccaccagaauagcgagggaagaggccaggcagcugaucugaagucaacccaagccgcgaucgaccagauuaacgguaaauugaauaggcucaucgggaagacuaacgaaaaauuccaccagaucgagaaggaauuuagugaggucgaaggccggauucaggaucuggagaaguacguugaggacacaaaaauagauuuaugguccuauaaugccgaacugcucguggcacuugagaaccaacauaccaucgaccugacggauagcgaaaugaacaaguuguuugagaaaaccaagaaacagcuacgagaaaaugcugaggacaugggaaacggcugcuucaagauuuaccacaagugugauaaugccugcaucgggucuauucgcaacggaacauaugaccaugacguauacagagaugaggcucugaauaacagguuucagaucaaagguguggaacucaagucaggcuacaaagacuggauacuguggaucaguuucgccauuagcugcuuucuucugugugucgcauugcucggguucaucaugugggccugccagaagggaaauauucgguguaacaucugcauauga

SEQ ID NO: 134444 - RNA, 1701 nt, Artificial Sequence; identical to SEQ ID NO: 134443
  derived and/or modified sequence opt3 from hemagglutinin__InfluenzaA__AIC73798

SEQ ID NO: 134445 - RNA, 1701 nt, Artificial Sequence; identical to SEQ ID NO: 134443
  derived and/or modified sequence opt3 from hemagglutinin__InfluenzaA__AIC73800

SEQ ID NO: 134446 - RNA, 1701 nt, Artificial Sequence; identical to SEQ ID NO: 134443
  derived and/or modified sequence opt3 from hemagglutinin__InfluenzaA__AIC73801

SEQ ID NO: 134447 - RNA, 1701 nt, Artificial Sequence; identical to SEQ ID NO: 134443
  derived and/or modified sequence opt3 from hemagglutinin__InfluenzaA__AIC73802

SEQ ID NO: 134448 - RNA, 1701 nt, Artificial Sequence; identical to SEQ ID NO: 134443
  derived and/or modified sequence opt3 from hemagglutinin__InfluenzaA__AIC73803

SEQ ID NO: 134449 - RNA, 1701 nt, Artificial Sequence; identical to SEQ ID NO: 134443
  derived and/or modified sequence opt3 from hemagglutinin__InfluenzaA__AIC73804

SEQ ID NO: 134450 - RNA, 1701 nt, Artificial Sequence; identical to SEQ ID NO: 134443
  derived and/or modified sequence opt3 from hemagglutinin__InfluenzaA__AIC73805

SEQ ID NO: 134451 - RNA, 1701 nt, Artificial Sequence; identical to SEQ ID NO: 134443
  derived and/or modified sequence opt3 from hemagglutinin__InfluenzaA__AIC73806

SEQ ID NO: 134452 - RNA, 1701 nt, Artificial Sequence
  derived and/or modified sequence opt3 from hemagglutinin__InfluenzaA__AIC73807
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacaauaagggcaaggaaguacugguucuuuggggcauccaccaccccucaacgacugcugaucagcagagcuuguaccagaacgccgacgcguacguguucgucgggaccagucgcuauucuaaaaaguuuaaaccugagauugcaauccgaccaaaggugcgugaucaagagggaagaaugaacuacuauuggacacugguggaacccggugacaaaauuacuuucgaggccaccggcaaucuagucguuccuagguacgcuuuuacaauggaacggaacgccggguccggaaucauaauuagcgauaccccagugcaugacugcaauacgacuugucagacaccggagggcgcaaucaacaccucgcuccccuuccagaauauucacccuaucacuaucgguaagugcccaaaauauguaaagucuacaaagcugcgccuugcuaccgggcugagaaacgugcccuccauucagucaaggggauuguuuggcgccauagcgggcuucaucgaagggggauggacggguauggucgauggcugguacggguaucaucaccaaaaugagcagggaaguggcuacgccgcagaccucaaaagcacccagaacgcuauugacaagaucacaaauaaagugaacuccguuauagagaagaugaauacucaguuuaccgccguggguaaagaguucaaccaccuggagaagcggauugaaaauuuaaacaagaaagucgaugacggguuccuggauaucuggacauacaaugcugagcuccuugugcuguuggaaaacgagcgcacucuagacuaucaugauucuaacguaaagaaucuguacgagaaaguucgaaaccaacucaagaauaacgccaaagaaaucggcaauggauguuuugaguucuaucacaagugcgacaacaccuguauggaaagcgugaagaauggcacauacgauuauccuaaauacucagaggaagcaaagcugaacagagagaaaauugacggggucaaacuugagaguaccaggaucuaucagauucuggccauauacuccacuguggcuagcucuuugguccucgugguuucacugggagcgaucaguuuuuggaugugcagcaaugguuccuuacagugccggauuuguaucuga

SEQ ID NO: 134453 - RNA, 1701 nt, Artificial Sequence; identical to SEQ ID NO: 134443
  derived and/or modified sequence opt3 from hemagglutinin__InfluenzaA__AIC73808

SEQ ID NO: 134454 - RNA, 1701 nt, Artificial Sequence
  derived and/or modified sequence opt3 from hemagglutinin__InfluenzaA__AIC73809
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuacgccaaucuuauauaaacgauaagggcaaggaaguacugguucuuuggggcauccaccaccccuccacgacuaccgaccagcagucauuguaccagaaugcugaugccuacguguucgucgggacaagccgauauaguaaaaaguuuaaaccugagauugcgauccguccaaaggugagagaccaagagggaaggaugaacuacuauuggacucugguggaacccggugauaaaauuaccuucgaggcaacaggcaaccuagucguuccucgguacgccuuuaccauggaacgcaaugcugggucuggaaucauaauuuccgacacgccagugcaugauugcaacacuacaugucagaccccggagggcgccaucaauacuagccuccccuuccagaacauucacccuaucacaaucgguaagugcccaaaauauguaaagucgaccaagcugagacuugcaacggggcugaggaaugugcccucuauucagucccggggauuguuuggcgcuauagccggcuucaucgaagggggauggaccgguauggucgacggcugguacggguaucaucaccaaaacgagcagggaucaggcuacgcggccgaccucaaaaguacacagaaugcaauugauaagaucacuaacaaagugaauagcguuauagagaagaugaacacccaguuuacagcuguggguaaagaguucaaucaccuggagaagcgcauugaaaacuuaaauaagaaagucgacgauggguuccuggacaucuggacuuacaacgccgagcuccuugugcuguuggaaaaugagcgaacccuagauuaucaugacuccaacguaaagaaccuguacgagaaaguuagaaaucaacucaagaacaaugcuaaagaaaucggcaacggauguuuugaguucuaucacaagugcgauaauacauguauggaaucugugaagaacggcaccuacgacuauccuaaauacagcgaggaagccaagcugaauagggagaaaauugaugaggucaaguuagaaucaacucggaucuaucagauucuggcaauauacaguacgguggccuccagcuugguccucgugguuucucugggggcuaucucauuuuggaugugcaguaacggaagccuucagugccguauuuguaucuga

SEQ ID NO: 134455 - RNA, 1701 nt, Artificial Sequence
  derived and/or modified sequence opt3 from hemagglutinin__InfluenzaA__AIC73810
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccucaaaagcacccagaaugcuauugauaagaucacaaacaaaguuaauuccgugauagagaagaugaacacucaguuuaccgccguggguaaagaguucaaucaccuggagaagcggauugaaaacuuaaauaagaaagucgacgauggguuccuggacaucuggacauacaacgcugagcuccuugugcuguuggaaaaugagcgcacucuagauuaucaugacucuaacguaaagaaccuguacgagaaaguucgaaaucaacucaagaacaaugccaaagaaaucggcaacggauguuuugaguucuaucacagaugcgauaauaccuguauggaaagcgugaagaacggcacauacgacuauccuaaguacucagaggaagcaaaacugaauagggagaagauugauggggucaaacuugagaguacccggaucuaucagauucuggccauauacuccacuguggcuagcucuuugguccucgugguuucacugggagcgaucaguuuuuggaugugcagcaacgguuccuuacagugccguauuuguaucuga

SEQ ID NO: 134456 - RNA, 1701 nt, Artificial Sequence
  derived and/or modified sequence opt3 from hemagglutinin__InfluenzaA__AIC73813
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccucaaaagcacccagaaugcuauugauaagaucacaaacaaaguuaauuccgugauagagaagaugaacacucaguuuaccgccguggguaaagaguucaaucaccuggagaagcggauugaaaacuuaaauaagaaagucgacgauggguuccuggacaucuggacauacaacgcugagcuccuugugcuguuggaaaaugagcgcacucuagauuaucaugacucuaacguaaagaaccuguacgagaaaguucgaaaucaacucaagaacaaugccaaagaaaucggcaacggauguuuugaguucuaucacaagugcgauaauaccuguauggaaagcgugaagaacggcacauacgacuauccuaaauacucagaggaagcaaagcugaauagagagaaaauugauggggucaaacuugagaguaccaggaucuaucagauucuggccauauacuccacugcugcgagcucuuuggugcucgucaucucacugggagcaauuaguuuuuggaugugcagcaacgguuccuuacagugccggaucuguaucuga

SEQ ID NO: 134457 - RNA, 1701 nt, Artificial Sequence
  derived and/or modified sequence opt3 from hemagglutinin__InfluenzaA__AIC73815
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacucaagcuggccaccgggaugcggaacgugccagagaaacagacucguggaauuuuuggcgcuauagccggcuucaucgaaaaugggugggagggaaugguggacgguugguacggcuuucgccaccaaaacucugaggggagaggacaggcagcugaucuuaagagcacacaggccgcgauugaccaaaucaauggcaaacugaacagguugaucgguaagaccaaugaaaaauuccaucagauugagaaggaauuuucagaggucgaagggcggauacaggaucucgagaaguauguugaggacacgaaaaucgaucuguggaguuacaacgccgaauuacugguggcacucgagaaucagcacaccauugaccuuacagauuccgaaaugaacaagcuguuugagaaaacuaagaaacaauugcgagaaaacgcugaggacaugggcaauggaugcuucaagaucuaucauaagugugauaacgccugcauuggcagcauccgcaaugggaccuacgaccacaacguauacagagacgaggcucuaaauaacagguuucagauaaaaggaguggaacugaagucugguuauaaagauuggauccucuggauuucauucgccaucaguugcuuucugcuuugugucgcacuguugggcuucauuaugugggccugccagaaggggaauauccgguguaacauaugcauuuga

SEQ ID NO: 134458 - RNA, 1701 nt, Artificial Sequence; identical to SEQ ID NO: 133936
  derived and/or modified sequence opt3 from hemagglutinin__InfluenzaA__AIC73817

SEQ ID NO: 134459 - RNA, 1701 nt, Artificial Sequence; identical to SEQ ID NO: 132056
  derived and/or modified sequence opt3 from hemagglutinin__InfluenzaA__AIC73819

SEQ ID NO: 134460 - RNA, 1701 nt, Artificial Sequence
  derived and/or modified sequence opt3 from hemagglutinin__InfluenzaA__AIC73820
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacucaagcuggccaccgggaugcggaacgugccagagaaacagacucguggaauuuuuggcgcuauagccggcuucaucgaaaaugggugggagggaaugguggacgguugguacggcuuucgccaccaaaacucugaggggagaggacaggcagcugaucuuaagagcacacaggccgcgauugaccaaaucaauggcaaacugaacagguugaucgguaagaccaaugaaaaauuccaucagauugagaaggaauuuucagaggucgaagggcggauacaggaucucgagaaguauaucgaggacacgaaaauugaucuguggaguuacaacgccgaauuacugguugcacucgagaaucagcacaccaucgaccuuacagauuccgaaaugaacaagcuguuugagaaaacuaagaaacaauugcgagaaaacgcugaggacaugggcaauggaugcuucaagauuuaucauaagugugauaacgccugcaucggcagcauacgcaaugggaccuacgaccacaacguguacagagacgaggcucuaaauaacagguuucagaucaaaggaguagaacugaagucugguuauaaagauuggauucucuggaucucauucgccauuaguugcuuucugcuuuguguggcacuguugggcuucaucaugugggccugccagaaggggaauauacgguguaacauuugcaucuga

SEQ ID NO: 134461 - RNA, 1701 nt, Artificial Sequence; identical to SEQ ID NO: 132056
  derived and/or modified sequence opt3 from hemagglutinin__InfluenzaA__AIC73821

SEQ ID NO: 134462 - RNA, 1701 nt, Artificial Sequence; identical to SEQ ID NO: 134420
  derived and/or modified sequence opt3 from hemagglutinin__InfluenzaA__AIC73824

SEQ ID NO: 134463 - RNA, 1701 nt, Artificial Sequence; identical to SEQ ID NO: 132056
  derived and/or modified sequence opt3 from hemagglutinin__InfluenzaA__AIC73825

SEQ ID NO: 134464 - RNA, 1701 nt, Artificial Sequence
  derived and/or modified sequence opt3 from hemagglutinin__InfluenzaA__AIC73827
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaccauugucuacagcaucaaguuggagcuacauuguugagaccuccucuucggacaacggaacuugcuauccgggcgauuuuaucaauuacgaagaacucagggagcagcugucaagcgugaguuccuucgaacgguuugagauuuuccccaagacaucuagcuggccuaaccacgacuccaauaagggugucaccgccgcuuguccacaugcaggggccaaaucauuuuauaagaaccugaucuggcucgugaaaaagggaaauaguuaccccaaauuaagccaaucuuauauaaacgauaagggcaaggaaguacugguucuuuggggcauccaccacccuuccacgacugcugaccagcagucauuguaccagaaugccgaugcguacguguucgucgggaccagccgcuauaguaaaaaguuuaaaccagagauugcaauccgacccaaggugcgugaccaagagggaagaaugaacuacuauuggacacugguggaaccuggugauaaaauuacuuucgaggccaccggcaaccuagucguuccaagguacgcuuuuacaauggaacggaaugccgggucuggaaucauaauuuccgacaccccggugcaugauugcaacacgacuugucagacacccgagggcgcaaucaauaccagccucccuuuccagaacauucacccaaucacuaucgguaagugccccaaauauguaaagucgacaaagcugcgccuugcuaccgggcugagaaaugugccuucuauucaguccaggggauuguuuggcgccauagcgggcuucaucgaagggggauggacggguauggucgacggcugguacggguaucaucaccaaaacgagcagggaucaggcuacgccgcagaccucaaaaguacccagaaugcuauugauaagaucacaaacaaagugaauagcguuauagagaagaugaacacucaguuuaccgccguggguaaagaguucaaucaccuggagaagcggauugaaaacuuaaauaagaaagucgacgauggguuccuggacaucuggacauacaacgcugagcuccuugugcuguuggaaaaugagcgcacucuagauuaucaugacuccaacguaaagaaccuguacgagaaaguucgaaaucaacucaagaacaaugccaaagaaaucggcaacggauguuuugaguucuaucacaagugcgauaauaccuguauggaaucugugaagaacggcacauacgacuauccaaaauacagcgaggaagcaaagcugaauagagagaaaauugauggggucaaacuugagucaaccaggaucuaucagauucuggccauauacaguacuguggcuuccagcuugauccucgucgugucucugggagcgauuucauuuuggaugugcaguaacgguagcuuacagugccggaucuguaucuga

SEQ ID NO: 134465 - RNA, 1701 nt, Artificial Sequence
  derived and/or modified sequence opt3 from hemagglutinin__InfluenzaA__AIC73828
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccucaaaagcacccagaaugcuauugauaagaucacaaacaaaguuaauuccgugauagagaagaugaacacucaguuuaccgccguggguaaagaguucaaucaccuggagaagcggauugaaaacuuaaauaagaaagucgacgauggguuccuggacaucuggacauacaacgcugagcuccuugugcuguuggaaaaugagcgcacucuagauuaucaugacucuaacguaaagaaccuguacgagaaaguucgaaaucaacucaagaccaacgccaaagaaaucggcaauggauguuuugaguucuaucacaagugcgauaacacauguauggaaagcgugaagaauggcaccuacgacuauccuaaauacucagaggaagcaaagcugaacagagagaaaauugauggggucaaacuugagaguacuaggaucuaucagauucuggccauauacuccacggcugcgagcucuuuggugcucgucgugucacugggagcaaucaguuuuuggaugugcagcaaugguuccuuacagugccggauuuguaucuga

SEQ ID NO: 134466 - RNA, 1701 nt, Artificial Sequence
  derived and/or modified sequence opt3 from hemagglutinin__InfluenzaA__AIC73830
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucaaaggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagagagcagcugagcaguguguccucuuucgaaagguuugagauuuucccgaagacaagcuccuggcccaaccacgacucaaauaaaggugucaccgccgcuuguccucaugcaggggccaagaguuuuuauaaaaaccugaucuggcucgugaagaaaggaaauagcuacccaaaguuaucucaauccuauauaaacgauaagggcaaagaaguacugguucuuuggggcauccaccaccccucaacgacugcugaccagcagagcuuguaccagaaugccgaugcguacguguucgucgggaccagucgguauucuaagaaauuuaagccugagauugcaauccgcccaaaagugcgagaccaagagggacguaugaacuacuauuggacacugguggaacccggugauaagauuacuuucgaggccaccggcaaccuagucguuccuagauacgcuuuuacaauggaaaggaaugccggguccggaaucauaauuagcgacaccccagugcaugauugcaacacgacuugucagacaccggagggcgcaaucaauaccucgcuccccuuccagaacauucacccuaucacuaucgguaaaugcccaaaguauguaaagucuacaaaacugcggcuugcuaccgggcugcgcaaugugcccuccauucagucaagaggauuguuuggcgccauagcgggcuucaucgaagggggauggacggguauggucgacggcugguacggguaucaucaccaaaacgagcagggaaguggcuacgccgcagaccucaagagcacccagaaugcuauugauaaaaucacaaacaagguaaauuccguuauagagaaaaugaacacucaguuuaccgccguggguaaggaguucaaucaccuggagaagaggauugaaaacuuaaauaaaaaggucgacgauggguuccuggacaucuggacauacaacgcugagcuccuugugcuguuggaaaaugagcggacucuagauuaucaugacucuaacgugaaaaaccuguacgagaagguucgcaaucaacucaaaaacaaugccaaggaaaucggcaacggauguuuugaguucuaucacaagugcgauaauaccuguauggaaagcgugaaaaacggcacauacgacuauccuaaguacucagaggaagcaaaacugaaucgagagaagauugauggggucaaacuugagaguaccagaaucuaucagauucuggccauauacuccacuguggcuagcucuuugguccucgugguuucacugggagcgaucaguuuuuggaugugcagcaacgguuccuuacagugcaggauuuguaucuga

SEQ ID NO: 134467 - RNA, 1701 nt, Artificial Sequence
  derived and/or modified sequence opt3 from hemagglutinin__InfluenzaA__AIC73833
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccucaaaagcacccagaaugcuauugauaagaucacaaacaaaguuaauuccgugauagagaagaugaacacucaguuuaccgccguggguaaagaguucaaucaccuggagaagcggauugaaaacuuaaauaagaaagucgacgauggguuccuggacaucuggacauacaacgcugagcuccuugugcuguuggaaaaugagcgcacucuagauuaucaugacucuaacguaaagaaccuguacgagaaaguucgaaaucaacucaagaacaaugccaaagaaaucggcaacggauguuuugaguucuaucacaagugcgauaauaccuguauggaaagcgugaagaacggcacauacgacuauccuaaauacucagaggaagcaaagcugaauagagagaaaauugauggggucaaacuugagaguaccaggaucuaucagauucuggccauauacuccacugcugcgagcucuuuggugcucgucgugucacugggagcaaucaguuuuuggaugugcagcaacgguuccuuacagugccggauuuguaucuga

SEQ ID NO: 134468 - RNA, 1701 nt, Artificial Sequence
  derived and/or modified sequence opt3 from hemagglutinin__InfluenzaA__AIC73834
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugauggggcaaaaaguuuuuauaagaaccugaucuggcucgugaaaaagggaaauagcuacccaaaauuaucucaauccuauauaaacgacaagggcaaggaaguacugguucuuuggggcauccaccaccccucaacgacugccgggcagcagagcuuguaccagaaugcugaugccuacguguucgucggaaccagucgcuauucuaaaaaguuuaaaccugagauugcgauccgaccaaaggugcgugaccaagaggguagaaugaacuacuauuggacacugguggaacccggcgauaaaauuacuuucgaggcaaccgggaaccuagucguuccuagguacgccuuuacaauggaacggaaugcuggauccggcaucauaauuagcgacaccccagugcaugauugcaacacgacuugucagacaccggagggugccaucaauaccucgcuccccuuccagaacauucacccuaucacuaucgggaagugcccaaaauauguaaagucuacaaagcugcgccuugcaaccggacugagaaaugugcccuccauucagucaaggggcuuguuuggcgcuauagccggguucaucgaaggagguuggacgggcauggucgacgggugguacggauaucaucaccaaaacgagcagggcagugguuacgcggccgaccucaaaagcacccagaaugcaauugauaagaucacaaacaaaguuaauuccgugauagagaagaugaacacucaguuuaccgcuguggggaaagaguucaaucaccuggagaagcggauugaaaacuuaaauaagaaagucgacgauggcuuccuggacaucuggacauacaacgccgagcuccuugugcuguuggaaaaugagcgcacucuagauuaucaugacucuaacguaaagaaccuguacgagaaaguucgaaaucaacucaagaacaaugcuaaagaaaucggaaacggcuguuuugaguucuaucacaagugcgauaauaccuguauggaaagcgugaagaacgggacauacgacuauccuaaauacucagaggaagccaagcugaauagagagaaaauugauggagucaaacuugagaguaccaggaucuaucagauucuggcaauauacuccacuguggccagcucuuugguccucgugguuucacugggugcuaucaguuuuuggaugugcagcaacggcuccuuacagugccggauuuguaucuga

SEQ ID NO: 134469 - RNA, 1701 nt, Artificial Sequence
  derived and/or modified sequence opt3 from hemagglutinin__InfluenzaA__AIC73835
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugauugaacccggugauaaaaucacuuucgaggccaccggcaaccuaguggucccuagguacgcuuuuacaauggaacggaaugccggguccggaauaauuaucagcgacaccccaguucaugauugcaacacgacuugucagacaccggagggcgcaauuaauaccucgcuccccuuccagaacauccacccuaucacuauugguaagugcccaaaauaugugaagucuacaaagcugcgccuugcuaccgggcugagaaauguacccuccauacagucaaggggauuguuuggcgccaucgcgggcuucauugaagggggauggacggguaugguggacggcugguacggguaucaucaccaaaacgagcagggaaguggcuacgccgcagaccucaaaagcacccagaaugcuaucgauaagauaacaaacaaagucaauuccgugauugagaagaugaacacucaguuuaccgccguugguaaagaguucaaucaccuggagaagcggaucgaaaacuuaaauaagaaaguggacgauggguuccuggacaucuggacauacaacgcugagcuccuuguccuguuggaaaaugagcgcacucuagauuaucaugacucuaacgugaagaaccuguacgagaaaguacgaaaucaacucaagaacaaugccaaagaaauuggcaacggauguuuugaguucuaucacaagugcgauaauaccuguauggaaagcguuaagaacggcacauacgacuauccuaaauacucagaggaagcaaagcugaauagagagaaaaucgauggggugaaacuugagaguaccaggauuuaucagauacuggccaucuacuccacugucgcuagcucuuuggugcucgucgugucacugggagcgauuaguuuauggaugugcagcaacgguucccugcagugccggaucuguaucuga

SEQ ID NO: 134470 - RNA, 1701 nt, Artificial Sequence; identical to SEQ ID NO: 134412
  derived and/or modified sequence opt3 from hemagglutinin__InfluenzaA__AIC73836

SEQ ID NO: 134471 - RNA, 1701 nt, Artificial Sequence
  derived and/or modified sequence opt3 from hemagglutinin__InfluenzaA__AIC73837
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugaaagauggcugguauggguuccgucaccagaacuccgagggacgcggccaggcugccgaccugaagucuacccaagcggccaucgaucagauuaaugguaaauugaacagacucaucgggaagacuaaugaaaaguuccaccagaucgagaaagaauuuagcgagguggaaggcaggauucaggaccuggagaaguacgucgaggauacaaaaauagacuuauggucauauaacgcagaacugcucguugcucuugagaaccaacauaccaucgaucugacggacagugaaaugaauaaguuguucgagaaaaccaagaagcagcuacgggaaaacgccgaggauaugggaaauggcugcuuuaaaauuuaccacaagugugacaacgcuugcaucggguccauucgaaauggaacauaugaucaugacguguaccgcgacgaggcccugaacaauagauuccagaucaaagguguagaacucaagagcggcuacaaagauuggauacuguggaucucuuuugcaauuucaugcuuccuucuguguguggccuugcucggguuuaucaugugggcuugccagaagggaaacauuagguguaauaucugcauauga

SEQ ID NO: 134472 - RNA, 1701 nt, Artificial Sequence
  derived and/or modified sequence opt3 from hemagglutinin__InfluenzaA__AIC73838
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcaacaguccacaccagauacuagacggcgaaaauuguacacucaucgaugcucugcuuggggacccgcagugcgauggauuucagaacaaaaagugggaccuguucguggagaggagcaaagccuauuccaauuguuaccccuaugaugucccugacuacgcaucuuugcggucgcucguggccucaagcggcacccuggaauuuaacaaugagaguuucaacugggcugguguuacucaaaaugggacauccucugcaugcauucgcggaagcaacuccucauuuuucagucgacugaauuggcucacccauagcaacuuuaaguauccagccuuaaacgugacgaugcccaauaacgagcaguucgauaagcuguacaucuggggcguccaccauccuggcacugacaaagaucagauuuuucuuuaugcucagucuuccgggcguaucaccgugucaacaaagagaagccaacaggccguaauaccaaauauuggaaguaggccccggauccgcaacauuccuucuagaaucuccaucuacuggacuauuguuaaaccaggugacauauugcugaucaauagcaccggcaaccuaauugcgccgaggggguacuucaagauccggucgggaaaaucuuccauaaugcgcucagaugcacccauuggcaaguguaagagugaaugcaucacaccuaaugguagcaucccaaacgacaaacccuuucagaaugugaaccgaauuaccuauggggccuguccuagauacgucaagcaguccacgcucaaacuggcuacuggaaugaggaaugugccagagaagcaaacacggggcaucuucggcgccauugcaggguuuauagaaaacggaugggaggguaugauggacggcugguauggguuccgucaccaaaauucugagggacgcggccaggcugccgaucuuaaaagcacccaggcggccaucgaccagauuaacgguaagcugaauagauugaucgggaaaacuaacgaaaaguuccaccagaucgagaaggaauuuucagagguggaaggcaggauucaggaucucgagaaauacgucgaggacacaaagauagaucuguggaguuauaacgcagaauuacugguugcucucgagaaucaacauaccaucgaccuuacggauuccgaaaugaacaaacuguucgagaagaccaaaaagcaguugcgggaaaaugccgaggaccuaggaaacggcugcuuuaagauuuaccacaaaugugauaaugcuugcaucgggagcauucgaaacggaacauaugaccaugauguguaccgcgacgaggcccugaauaacagauuccagaucaaggguguagaacucaaaucuggcuacaaggacuggauacuguggaucucauuugcaauuaguugcuuccuucuguguguggccuugcucggguuuaucaugugggcuugccagaaaggaaauauuagguguaacaucugcauauga

SEQ ID NO: 134473 - RNA, 1701 nt, Artificial Sequence
  derived and/or modified sequence opt3 from hemagglutinin__InfluenzaA__AIC73839
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccgaccacgauucaaacaagggugucaccgccgcuuguccucaugcaggggccaaaaguuuuuauaagaaucugaucuggcucgugaaaaagggaaacagcuacccaaaauuaucucaauccuauauaaaugacaagggcaaggaaguacugguucuuuggggcauccaccaccccucaacgacugcugaucagcagagcuuguaccagaacgccgacgcguacguguucgucgggaccagucgcuauucuaaaaaguuuaaaccugagauugcaauccgaccaaaggugcgugaucaagagggaagaaugaauuacuauuggacacugguggaacccggugacaaaauuacuuucgaggccaccggcaaccuagucguuccuagguacgcuuuuacaauggaacggaacgccggguccggaaucauaauuagcgauaccccagugcaugacugcaauacgacuugucagacaccggagggcgcaaucaacaccucgcuccccuuccagaauauucacccuaucacuaucgguaagugcccaaaauauguaaagucuacaaagcugcgccuugcuaccgggcugagaaacgugcccuccauucagucaaggggauuguuuggcgccauagcgggcuucaucgaagggggauggacggguauggucgacggcugguacggguaucaucaccaaaaugagcagggaaguggcuacgccgcagaucucaaaagcacccagaacgcuauugacaagaucacaaauaaagugaacuccguuauagagaagaugaauacucaguuuaccgccguggguaaagaguucaaccaccuggagaagcggauugaaaauuuaaacaagaaagucgaugacggguuccuggauaucuggacauacaaugcugagcuccuugugcuguuggaaaacgagcgcacucuagacuaucaugauucuaauguaaagaaccuguacgagaaaguucgaaaccaacucaagaauaacgccaaagaaaccggcaauggauguuuugaguucuaucacaagugcgacaacacauguauggaaagcgugaagaauggcaccuacgauuauccuaaauacucagaggaagcaaagcugaacagagagaaaaucgacggggucaaacuugagaguacuaggauuuaucagauccuggccauuuacuccacgguggcuagcucuuugguccucgugguuucacugggagcgauaaguuuuuggaugugcagcaaugguuccuuacagugccggaucuguauuuga

SEQ ID NO: 134474 - RNA, 1701 nt, Artificial Sequence; identical to SEQ ID NO: 132056
  derived and/or modified sequence opt3 from hemagglutinin__InfluenzaA__AIC73840

SEQ ID NO: 134475 - RNA, 1701 nt, Artificial Sequence
  derived and/or modified sequence opt3 from hemagglutinin__InfluenzaA__AIC73841
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgauugcugaccagcagagcuuguaccagaaugccgaugcguacguguucgucgggaccagucgcuauucuaaaaaguuuaaaccugagaucgcaauucgaccaaaggugcgugaccaagagggaagaaugaacuacuauuggacucugguggaacccggugauaaaaucacauucgaggccacuggcaaccuagucguuccuagguacgcuuuuaccauggaacggaaugccggguccggaauaauuaucagcgacacaccagugcaugauugcaacaccacgugucagacuccggagggcgcaauuaauacaucgcuccccuuccagaacauccacccuaucaccauugguaagugcccaaaauauguaaagucuacuaagcugcgccuugcuacagggcugagaaauauacccuccauccagucaaggggauuguuuggcgccauugcgggcuucaucgaagggggauggaccgguaugguggacggcugguacggguaucaucaccaaaacgagcagggaaguggcuacgccgcagaccucaaaagcacgcagaaugcuauagauaagauuaccaacaaagucaauuccgugaucgagaagaugaacacacaguuuacugccguugguaaagaguucaaucaccuggagaagcggaucgaaaacuuaaauaagaaaguggacgauggguuccuggacauuuggaccuacaacgcugagcuccuuguccuguuggaaaaugagcgcacacuagauuaucaugacucuaacgugaagaaccuguacgagaaaguacgaaaucaacucaagaacaaugccaaagaaaucggcaacggauguuuugaguucuaucacaagugcgauaauacuuguauggaaagcguuaagaacggcaccuacgacuauccuaaauacucagaggaagcaaagcugaauagagagaaaauugauggggugaaacuugagaguacaaggauauaucagauccuggccauuuacuccaccgucgcuagcucuuuggugcucgucgugucacugggagcgaucaguuuuuggaugugcagcaacgguuccuuacagugccggaucuguauuuga

SEQ ID NO: 134476 - RNA, 1701 nt, Artificial Sequence; identical to SEQ ID NO: 134471
  derived and/or modified sequence opt3 from hemagglutinin__InfluenzaA__AIC73842

SEQ ID NO: 134477 - RNA, 1707 nt, Artificial Sequence
  derived and/or modified sequence opt3 from hemagglutinin__InfluenzaA__AID48082
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggaaaagacccacaaugggaaguugugugauuuagacggagucaaaccccugauucuaagagauugcucaguggccgguuggcuccugggcaacccuaugugugacgaguuuaucaauguuccagaauggaguuauauaguggagaaggcgaacccggucaaugaucuuugcuaccccggggacuucaacgauuaugaggaacugaagcauuugcucagcaggaucaaucacuuugagaaaauucagaucauuccuaaguccucuuggucgucacaugaagcuagccugggagugaguuccgccuguccauaccagggcaaaucuagcuucuuucggaacguaguuuggcugaucaagaaaaauuccacauaucccacuauaaagcgcucauacaacaauaccaaccaagaggaccucuuagugcugugggguauucaccacccuaaugaugcagccgagcagacaaaacuuuaucagaacccaaccacuuacaucagugucgggacaagcaccuugaaccagcgacuggugccccguauugcuacgagaucuaaagugaauggacaauccggcaggauggaguucuuuuggacuauccuaaagccuaacgacgcaaucaauuucgaaucaaacggcaauuuuauugccccagaauacgcuuauaaaauagucaagaaaggggauagcaccaucaugaagagugagcucgaauacggaaacugcaauacaaaaugucagacuccgaugggugccauuaacucuuccaugcccuuccauaauauccacccucugaccauaggcgagugcccaaaguauguuaagagcaaccggcuugugcuggcgacaggguugcgcaauucgccccagagagagaggcggcgcaaaaagcgaggacucuuuggcgcaauugccgguuucaucgaagggggauggcagggcaugguagacggcugguacggguaucaucacucuaacgagcaaggauccgguuacgcugccgacaaagaaucaacccagaaggcaaucgauggcgugacgaauaaagucaacaguauuaucgacaagaugaauacucaguuugaggcuguggggagagaguucaaccaccuggaaaggcggauugagaacuuaaauaagaaaauggaagauggauuccuggacguuuggacauauaacgccgagcuccuugugcugauggaaaaugagcguaccuuggauuuucaugacagcaacgucaagaaucuauacgauaaagugcgccugcaacucagagacaacgcgaaggaacugggcaaugguuguuucgaguuuuaccacaaaugcgaugacgaguguauggaauccguaaggaacgggacuuaugauuacccucaguauucugaggaagcccggcuuaagcgagaggagauaagcggcguuaagcuggaaucaaucggaauuuaccagaucuugaguaucuauuccacaguggcaagcucucucgcucuggccauuauggucgcuggcuuaucacuguggaugugcaguaaugggagccuacagugccgcauauguaucuga

SEQ ID NO: 134478 - RNA, 1701 nt, Artificial Sequence
  derived and/or modified sequence opt3 from hemagglutinin__InfluenzaA__AID70444
augaaggccgugcuggucguucuccuuuacaccuucgcuacagcaaacgccgacacucugugcaucggcuaucacgcgaauaacagcacggauaccguggacacaguauuggagaaaaaugugacugucacccauuccgugaacuuacuggaagauaagcacaaugggaaacuauguaagcucagaggaguugcuccccugcaucuugguaaaugcaacauugccggcuggauacuggggaauccugagugugaaucuuuggcaacagccucaaguuggagcuacaucguggagaccuccaacucugacaauggaacuugcuauccaggcgauuuuauugacuacgaagaacucagggagcagcugucgucagucagcaguuucgaacgguuugagaucuucccgaagacauccucuuggcccaaccacgauagcaauaagggugugaccgcugcauguccucaugccggggcuaaauccuuuuauaagaaccugauuuggcucguuaaaaagggaaauucauacccaaaauuaaguaagagcuauaucaacgacaagggccgcgaaguacuggugcuuuggggcauacaccaccccucuacguccgccgaucaacagucauuguaccagaaugcggacacuuacgucuucguggggaccagccgauauaguaaaaaguuuaaaccugagaucgcaauucguccaaaggugagagaucaggagggaaggaugaacuacuauuggacacuggucgaacccggugacaaaaucacuuucgaggccaccggcaaccuaguugugccucgguacgcuuuugccauggaacgcaaugcagggucuggaauuaucauauccgauacaccaguacaugacugcaacaccacgugucaaacuccgaagggcgcuauuaauacaagccuccccuuccagaacauccacccuauuaccaucgguaaaugcccaaaguaugugaagucgacuaaacugagacuugccacagggcugaggaauguccccucuauccagucccggggauuguuuggcgcgauugccggcuucauagaagggggauggaccgguaugguggacggcugguacggguaucaucaccagaacgaacaaggaucaggcuacgcagcugaucucaagaguacgcagaaugccaucgacgagauuaccaacaaaguuaauagcgugaucgagaagaugaacacacaguuuacugcugucgguaaagaguucaaucaccuggagaagcgcauagaaaacuuaaauaagaaaguggaugacggguuccuggauauuuggaccuacaacgccgagcuccuuguaguucuggaaaaugagcgaacauuggaguaucaugacuccaacgugaagaaccuauacgaaaaagucagaucucaggugaagaauaacgcaaaagagaucggcaauggauguuuugaguucuaucacaagugcgauaacacuuguauggagagcgucaagaauggcaccuacgacuauccuaaauacucagaagaggccaagcugaacagggaggaaaucgauggggugaaacucgagaguacacggauuuaucaaauccuggcuauuuacuccaccguugcgagcucucuugugcugguagucucauugggagcaauaaguuuuuggaugugcuucaaugguagccuccagugccguaucuacauuuga

SEQ ID NO: 134479 - RNA, 1701 nt, Artificial Sequence
  derived and/or modified sequence opt3 from hemagglutinin__InfluenzaA__AID70445
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagagcuuguaccagaacgccgacaccuacguguucgucgggacaagucgcuauucuaagaaauuuaagccugagauugcgauccgaccaaaagugcgugaucaggagggaagaaugaauuacuauuggacucugguggaacccggugacaagauuaccuucgaggcaacaggcaaccuagucguuccuagguacgccuuugcuauggaacggaacgccggguccggaaucauaauuagcgauaccccagugcaugacugcaauacgacuugucaaacaccgaaaggcgcaaucaacaccucgcuccccuuccagaauauucacccuaucacuaucgguaagugcccaaaguauguaaaaucuacaaagcugcgccuugcuaccgggcugagaaacgugcccuccauucagucaaggggauuguuuggcgccauagcgggcuucaucgaagggggauggacggguauggucgacggcugguacggguaucaucaccagaaugaacaaggaaguggcuacgccgcagaucucaaaagcacccagaacgcuauugacaagaucacaaauaaagugaacuccguuauagagaagaugaauacucaguuuaccgccguggguaaggaguucaaccaccuggaaaaacggauugagaauuuaaacaagaaagucgaugacggguuccuggauaucuggacauacaaugcugaacuccuugugguacuggagaacgaacgcacuuuggaguaucaugacucuaauguuaagaaccuauacgagaaagugcgaaaccagcugaagaauaacgccaaggaaaucggcaauggauguuuugaguucuaucacaaaugcgauaacaccuguauggaaagcgucaagaauggcauuuacgacuauccuaaauacucagaggaagcaaagcucaacagagaggagaucgauggggugaaacuggaaaguacaaggauuuaucaaauacuugccaucuacuccaccgucgcuagcucucuggugcagguugugucauugggagcgauuaguuuuuggaugugcuucaaugguagccuccagugccggaucuguaucuga

SEQ ID NO: 134480 - RNA, 1701 nt, Artificial Sequence
  derived and/or modified sequence opt3 from hemagglutinin__InfluenzaA__AID70446
augaaggccgugcuggucguucuccuuuacaccuucgcuacagcaaacgccgacacucugugcaucggcuaucacgcgaauaacagcacggauaccguggacacaguauuggagaaaaaugugacugucacccauuccgugaacuuacuggaagauaagcacaaugggaaacuauguaagcucagaggaguugcuccccugcaucuugguaaaugcaacauugccggcuggauacuggggaauccugagugugaaucuuugucaacagcaaguagcugguccuacaucguggagaccucuucgucagacaacggaacuugcuauccaggcgauuuuauugacuacgaggaacucagggagcagcugagcagugucuccucuuucgaacgguuugagaucuucccgaagacaagcuccuggcccaaucacgauucaaacaagggugugaccgccgcuuguccucaugcaggggccaaaaguuuuuauaagaaucugauuuggcucguuaaaaagggaaacagcuacccaaaauuaucuaaguccuauaucaaugacaagggcaaagaaauacugguacuuuggggcauccaccaccccucaacgacugcugaucaacagagcuuguaccagaacgccgacaccuacguguucgucgggacaagucgcuauucuaagaaauuuaagccugagauugcgauccgaccaaaagugcgugaucaggagggaagaaugaauuacuauuggacucugguggaacccggugacaagauuaccuucgaggcaacaggcaaccuagucguuccuagguacgccuuugcuauggaacggaacgccggguccggaaucauaauuagcggcaccccagugcaugauugcaauacgacuugucaaacaccgaaaggugcaaucaacaccucgcuccccuuccagaauauucacccuaucacuaucgggaagugcccaaaguauguaaaaucuacaaagcugcgccuugcuaccggacugagaaacgugcccuccauucagucaaggggcuuguuuggcgccauagcgggguucaucgagggagguuggacgggcauggucgacgggugguacggauaucaucaccagaaugaacaaggcagugguuacgccgcagaccucaaaagcacccagaacgcuauugauaagaucacaaauaaagugaacuccguuauagagaagaugaauacucaguuuaccgccguggggaaggaguucaaccaccuggaaaaacggauugagaauuuaaacaagaaagucgacgauggcuuccuggacaucuggacauacaaugcugaacuccuugugguacuggagaacgaacgcacuuuggaguaucaugauucuaauguuaagaaccuauacgagaaagugcgaaaccagcugaagaauaacgccaaggaaaucggaaauggcuguuuugaguucuaucacaaaugcgacaacaccuguauggaaagcgucaagaaugggauuuacgauuauccuaaauacucagaggaagcaaagcucaacagagaggagaucgacggagugaaacuggaaaguacaaggauuuaucaaauacuugccaucuacuccaccgucgcuagcucucuggugcagguugugucauugggugcgauuaguuuuuggaugugcuucaauggcagccuccagugccggaucuguaucuga

SEQ ID NO: 134481 - RNA, 1701 nt, Artificial Sequence
  derived and/or modified sequence opt3 from hemagglutinin__InfluenzaA__AID70447
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggaacucagggagcagcugagcaguguguccucuuucgaacgguuugagauuuucccgaagacaagcuccuggcccaaucacgauucaaacaagggugucaccgccgcuuguccucaagcaggggccaaaggauuuuauaagaaucugcucugguuagugaaaaagggcaacaguuacccaaaacugagcaagucuuauaucaaugacaagggcaaagaaguacuuguuuugugggggauacaucaccccuccacgacugcugaucagcagucacuguaccagaacgccgacaccuacguguucgucggaacaagccgcuauaguaagaaauuuaagccugagaucgcgauucgaccaaaagugcgugaucaagaggguagaaugaauuacuauuggacucuaguggaacccggcgacaagaucaccuucgaggcaacagggaaccucgucguuccuagguacgccuuugcuauggaacggaacgccggaucuggcauuaucauauccgauaccccagugcacgacugcaauacgacuugucagacaccgaaaggugcaauuaacaccagccugcccuuccagaauauccauccuauuacuaucgggaagugcccaaaguauguaaaaucgacaaaacuucgccuggcuaccggauugagaaacgugcccucuauccaguccaggggccucuuuggcgccauugcgggguucauagagggagguuggacgggcauggucgacgggugguacggauaucaccaucaaaaugaacagggcucagguuacgccgcagaucugaagaguacccagaacgcuaucgacaagauuacaaauaaagugaacagcguuaucgagaagaugaauacucaguuuaccuccguggggaaggaguucaaccacuuagaaaaacggauggagaaucugaacaagaaagucgaugacggcuuccucgauauauggacauacaaugccgaacuucuggugguauuggagaacgaacgcacucuagaguaucacgacucuaauguuaagaaccuguacgagaaagugcgaaaccaacucaagaauaacgcuaaggaaauuggaaauggcuguuuugaguucuaucauaaaugcgauaacaccuguauggaaagcgucaagaaugggaucuacgacuauccuaaauacucagaggaagccaagcugaacagagaggagaucgauggagugaaacuugaaaguacaaggauuuaucagauccuggcaauuuacuccaccgucgccagcucuuuggugcucguugugucacugggugcuauaaguuuuuggaugugcuucaauggcagcuuacagugccggaucuguauuuga

SEQ ID NO: 134482 - RNA, 1701 nt, Artificial Sequence
  derived and/or modified sequence opt3 from hemagglutinin__InfluenzaA__AID70448
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugaucaggaggguagaaugaauuacuauuggacucugguggaacccggcgacaagauuaccuucgaggcaacagggaaccuagucguuccuagguacgccuuuaccauggaacgggaugcuggaucuggcaucauaauuuccgacacgccagugcaugacugcaacacuacaugucaaaccccgaaaggugccaucaauacuagccuccccuuccagaacauucacccuaucacaaucgggaagugcccaaaguauguaaaaucgaccaagcugcgccuugcaacgggacugagaaaugugcccucuauucaguccaggggcuuguuuggcgcuauagccggguucaucgagggagguuggaccggcauggucgaugggugguacggauaucaucaccagaacgaacaaggcucagguuacgcggccgaccucaaaaguacacagaaugcaauugauaagaucacuaacaaagugaauagcguuauagagaagaugaacacccaguuuacagcuguggggaaggaguucaaucaccuggaaaaacggauugagaacuuaaauaagaaagucgacgauggcuuccuggacaucuggacuuacaacgccgaacuccuugugguacuggagaaugaacgcaccuuggaguaucaggauuccaacguuaagaaucuauacgagaaagugcgaaaccaacugaagaacaaugcuaaggaaaucggaaacggcugucucgaguuuuaucauaaauucgacaauacaugcauggaaucugucaagaacgggaccuacgauuauccuaaauacagcgaggaagccaagcugaauagagagaaaauugacggagugaaacuugagucaacuaggaucuaucagauucuggcaauauacaguacggucgccuccagcuuggugcucguugugucucuggguacaaucucauuuuggauguguuucaacggcaguuuacagugccggauuugcaucuga

SEQ ID NO: 134483 - RNA, 1701 nt, Artificial Sequence
  derived and/or modified sequence opt3 from hemagglutinin__InfluenzaA__AID70449
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagagcuuguaccagaacgccgacaccuacguguucgucgggacaagucgcuauucuaagaaauuuaagccugagauugcgauccgaccaaaagugcgugaucaggagggaagaaugaauuacuauuggacucugguggaacccggugacaagauuaccuucgaggcaacaggcaaccuagucguuccuagguacgccuuugcuauggaacggaacgccggguccggaaucauaauuagcgauaccccagugcaugacugcaauacgacuugucaaacaccgaaaggcgcaaucaacaccucgcuccccuuccagaauauucacccuaucacuaucgguaagugcccaaaguauguaaaaucuacaaagcugcgccuugcuaccgggcugagaaacgugcccuccauucagucaaggggauuguuuggcgccauagcgggcuucaucgaagggggauggacggguauggucgacggcugguacggguaucaucaccagaaugaacaaggaaguggcuacgccgcagaucucaaaagcacccagaacgcuauugacaagaucacaaauaaagugaacuccguuauagagaagaugaauacucaguuuaccgccguggguaaggaguucaaccaccuggaaaaacggauugagaauuuaaacaagaaagucgaugacggguuccuggauaucuggacauacaaugcugaacuccuugugguacuggagaacgaacgcacuuuggaguaucaugacucuaauguuaagaaccuauacgagaaagugcgaaaccagcugaagaauaacgccaaggaaaucggcaauggauguuuugaguucuaucacaaaugcgauaacaccuguauggaaagcgucaagaauggcacauacgacuauccuaaauacucagaggaagcaaagcucaacagagaggagauugauggggugaaacuggaaaguaccaggaucuaucaaauucuugccauauacuccacugucgcuagcucucugguguugguugugucacucggagcgaucaguuuuuggaugugcuucaaugguagccugcagugccggauuuguguauga

SEQ ID NO: 134484 - RNA, 1701 nt, Artificial Sequence
  derived and/or modified sequence opt3 from hemagglutinin__InfluenzaA__AID70450
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugaucaggaggguagaaugaauuacuauuggacucugguggaacccggcgacaagauuaccuucgaggcaacagggaaccuagucguuccuagguacgccuuugcuauggaacgggaugccggaucuggcaucauaauuuccgacaccccagugcaugacugcaacacgacuugucaaacaagcaaaggugcaaucaauaccucgcucccguuccagaacauucaccccaucacuaucgggaagugcccuaaguauguaaaaucuacaaagcugcgccuugcuaccggacugagaaaugugccauccauucagucaaggggcuuguuuggcgccauagcgggguucaucgagggagguuggacgggcauggucgaugggugguacggauaucaucaccagaacgaacaaggcagugguuacgccgcagaccucaaaagcacccagaaugcuauugauaagaucacaaacaaaguuaauuccgugauagagaagaugaacacucaguuuaccgccguggggaaggaguucaaucaccuggaaaaacggauugagaacuuaaauaagaaagucgacgauggcuuccuggacaucuggacauacaacgcugaacuccuugugguacuggagaaugaacgcacuuuggaguaucaugauucuaacguuaagaaucuauacgagaaagugcgaaaccagcugaagaacaaugccaaggaaaucggaaacggcuguuuugaguucuaucacaaauuugacaauaccugcauggaaagcgucaagaacgggacauacgauuaucccaaauacucagaggaagcaaagcucaauagagagaaaauugacggagugaagcuggagaguaccaggaucuaucaaauucuugccauauacuccacugucgcuagcucucuggugcagguugugucauugggugcgaucaguuucuggauguguuuuaacggcagccuccagugccggauuugcaucuga

SEQ ID NO: 134485 - RNA, 1701 nt, Artificial Sequence
  derived and/or modified sequence opt3 from hemagglutinin__InfluenzaA__AID70451
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugagggagcagcucagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcuggugaaaaagggcaacaguuacccaaaacucagcaagucuuauauaaaugacaagggcaaagaaguauuaguucugugggggauccaccaccccuccacgacugcugaucaacagucacuuuaccagaacgccgacaccuacguguucgucggaacaagccgcuauaguaagaaauuuaagccugagauugcgauccgaccaaaagugcgugaucaggaggguagaaugaauuacuauuggacuuugguggaacccggcgacaagauuaccuucgaggcaacagggaaccuggucguuccuagguacgccuuugcuauggaacggaacgccggaucuggcaucauaauuuccgauaccccagugcaugacugcaauacgacuugucaaacaccgaaaggugcaaucaacaccagccuacccuuccagaauauucacccuaucacuaucgggaagugcccaaaguauguaaaaucgacaaagcuccgccuggcuaccggacuuagaaacgugcccucuauucaguccaggggccuguuuggcgccauagcgggguucaucgagggagguuggacgggcauggucgacgggugguacggauaucaucaccagaaugaacaaggcucagguuacgccgcagauuugaaaaguacccagaacgcuauugacaagaucacaaauaaagugaacagcguuauagagaagaugaauacucaguuuaccgccguggggaaggaguucaaccaccucgaaaaacggauugagaaucugaacaagaaagucgaugacggcuucuuagauaucuggacauacaaugcugaacugcucgugguacuugagaacgaacgcacucuggaguaucaugacuccaauguuaagaacuuguacgagaaagugcgaaaccagcuaaagaauaacgccaaggaaaucggaaauggcuguuuugaguucuaucacaaauuugauaauaccugcauggaaucugucaagaacgggacauacgacuauccuaaauacagcgaggaagcaaagcugaacagagaggagauugauggagugaaacucgaaucaaccaggaucuaucaaauucuggccauauacaguacugucgcuuccagccuugugcugguugugucuuugggugcgaucucauucuggauguguuuuaauggcagucuccagugccggauuugcaucuga

SEQ ID NO: 134486 - RNA, 1701 nt, Artificial Sequence
  derived and/or modified sequence opt3 from hemagglutinin__InfluenzaA__AID70452
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcuggguagcgugaguuccuucaagcgguuugaaauuuucccgaagacaucuagcuggcccaaucacgauuccaacaaaggggucaccgccgcuuguccucaugcaggagccaagggcuuuuauaaaaaucugaucuggcucgugaagaaaggcaacucauacccaaaguuaaguaagagcuauauaaaugacaaagggaaggagguacugguucuuuggggaauccaccaccccucuacgacugcugaucaacaguccuuguaccagaacgccgacaccuacguguucgucgguacaucacgcuauagcaaaaaguuuaaaccugaaauugcgauccgaccaaaggugcgugaucaggagggcagaaugaauuacuauuggacucugguggagcccggggacaaaauuaccuucgaagcaacaggaaaccuagucguuccuagguacgccuuugcuauggagcgggaugccggcagugguaucauaauuucugacaccccagugcaugacugcaacacgacuugucaaacaccgaagggggcaaucaauaccucccuccccuuccagaacauucacccuaucacuaucggaaagugcccaaaauauguaaagagcacaaaacugcgccuugcuaccggccugagaaaugugcccucgauucagucuaggggcuuguuuggggccauagcgggauucaucgaagguggcuggacggggauggucgauggaugguacggcuaucaucaccagaacgagcaagguuccggguacgccgcagaccucaagucaacccagaaugcuauugauaaaaucacaaacaaggugaauaguguuauagaaaagaugaacacucaguuuaccgccgugggcaaagaguucaaucaccuggagaagcggauugaaaacuuaaauaaaaaggucgacgauggauuccuggacaucuggacauacaacgcugagcuccuugugguacuggaaaaugagcgcacuuuggaauaucaugauagcaacguuaaaaaucuauacgagaaggugcgaaaccagcugaagaacaaugccaaagagaucggcaacggguguuuugaguucuaucacaagugcgacaauaccuguauggaguccgucaaaaacggaauuuacgauuauccuaaguacucugaagaggcaaaacucaauagagaaaagaucgacggugugaagcuggagagcacaaggauuuaucaaauacuugccaucuacucaaccgucgcuaguucccugguguugguugugagccucggcgcgauuucuuuuuggaugcgguucaacgggucacugcagugcaguaucugcaucuga

SEQ ID NO: 134487 - RNA, 1701 nt, Artificial Sequence
  derived and/or modified sequence opt3 from hemagglutinin__InfluenzaA__AID70453
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugaucaggaggguagaaugaauuacuauuggacucugguggaacccggcgacaagauuaccuucgaggcaacagggaaccuagucguuccuagguacgccuuugcuauggaacgggaugccggaucuggcaucauaauuuccgacaccccagugcaagacugcaacacgacuugucagacaccgaaaggugcaaucaauaccagccuccccuuccagaacauucauccuaucacuaucgggaagugcccaaaguauguaaaaucgacaaagcugcgccuugugaccggacugagaaauguccccucuauucaguccaggggcuuguuuggcgcuauagccggguucaucgagggagguuggacgggcaugguggaugggugguacggauaucaccaucaaaacgaacagggcucagguuacgcggccgaccucaaaaguacccagaaugcaauugauaagaucacaaacaaaguuaauagcgugauagagaagaugaacacucaguuuaccgcugucgggaaggaguucaaucaccuggaaaaacggauugagaacuuaaauaagaaaguggacgauggcuuccuggacaucuggacauacaacgccgaacuccuuguaguucuggagaaugaacgcacuuuggaguaucacgauuccaaccuaaagaaucuguacgagaaagugcgaaaccaacucaagaacaaugcuaaggaaaucggaaacggcuguuuugaguucuaucauaaauuugacaauaccugcauggaaucugucaagaacgggacauacgauuauccuaaauacagcgaggaagccaagcugaauagagaggagauugacggagugaaacuugaaucaaccaggaucuaucagauucuggcaauauacaguacugucgccuccagcuuggugcagguugugucucucggugcuaucucauucuggaugcgguuuaacggcagucugcacugucguauuugcaucuga

SEQ ID NO: 134488 - RNA, 1701 nt, Artificial Sequence
  derived and/or modified sequence opt3 from hemagglutinin__InfluenzaA__AID70454
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcgugaccaggagggaagaaugaacuacuauuggacacugguggaacccggugauaagauuacuuucgaggccaccggcaaccuagucguuccuagguacgcuuuugccauggaacggaaugcaggguccggaaucauaauuagcgacacaccagugcaugauugcaacaccacgugucaaacuccgaaaggcgcuaucaauacaucgcuccccuuccagaacauucacccuaucaccaucgguaagugcccaaaguauguaaaaucuacuaagaugcgccuggccacagggcuuagaaaugugcccuguauucaguccaggggacuguuuggcgcgauagccggcuucaucgaagggggauggaccgguauggucgacggcugguacggguaucaucaccagaacgaacaaggaucaggcuacgcagcugacuugaaaaguacgcagaaugccauugauaagaucaccaacaaagugaauagcguuauagagaagaugaacacacaguuuacugcuguggguaaggaguucaaucaccucgaaaaacggauugagaaccugaauaagaaagucgacgauggguucuuagacaucuggaccuacaacgccgaacugcucgugguacuugagaaugaacgcacacuggauuaucaugacuccaacguuaagaacuuguacgagaaagugcgaaaucagcuaaagaacaaugcaaaggagaucggcaacggaugcuuugaguucuaucacaaaugugauaauacuugcauggaaucugucaagaacggcaccuacgacuauccuaaauacagcgaagaggccaagcugaauagagaagagauugauggggugaaacucgagucaacaaggaucuaucaaauucuggcuauauacaguaccgucgcguccagccuugugcugguugugucuuugggagcaaucucauuuuggaugugcaguaacgguagccuccagugucggauuugcaucuga

SEQ ID NO: 134489 - RNA, 1701 nt, Artificial Sequence
  derived and/or modified sequence opt3 from hemagglutinin__InfluenzaA__AID70455
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucggagguguggcuccccugcaucuuggcaaaugcaacauagccggguggauccugggaaauccugagugugaaucuuugucaacagcaaguagcugguccuacauuguugagaccucuucgucagacaacggcacuugcuauccaggugauuuuaucgacuacgaagaacucagagagcagcugagcaguguguccucuuucgaaagguuugagauuuucccgaagacaagcuccuggcccaaucacgauucaaacaagggggucaccgccgcuuguccucaugcaggagccaaaggcuuuuauaagaaucugaucuggcucgugaaaaagggcaacaguuacccaaaaauaagcaagucuuauaucaaugacaaggggaaagaaguauuaguucugugggguauucaccaccccuccacgacugcugaucaacagucacuuuaccagaacgccgacaccuacaucuucgugggaacaagccgguauaguaagaaauuuaagccugagauugcgauccgcccaaaaguccgagaucaggagggccguaugaauuacuauuggacuuugguggaacccggggacaagauaaccuucgaggcaacaggaaaccugguggucccuagauacgccuuugcuauggaaagggaugccggcucugguauuaucauuuccgacaccccaguucaugacugcaacacgacuugucaaacaccgaaaggggcaaucaauaccagccuacccuuccagaacauccacccuauuacuauaggaaagugcccaaaguaugugaaaucgacaaagcuccggcuggcuaccggccuucgcaauguacccucuauccaguccagaggccuguuuggggccauugcgggauucaucgaggguggcuggacggggaugguggauggaugguacggcuaucaucaccagaacgaacaagguucaggguacgccgcagacuugaaaaguacccagaaugcuauagauaagauuacaaacaaagucaauagcgugaucaagaagaugaacacucaguuuaccgccguuggcaaagaguucaaucaccucgagaagaggaucgaaaaccugaauaaaaagguggacgauggauucuuagacauuuggacauacaacgcugagcugcucgucgugcuugaaaaugagcggacucuggaauaucaugauuccaacguuaaaaauuuguacgagaagguacgcaaccagcuaaagaacaaugccaaagagaucggcaacggguguuuugaguucuaucacaaguuugacaauaccugcauggagucugugaaaaacggaacauacgauuauccuaaguacagcgaagaggcaaaacugaaucgagaagagauugacggugucaagcucgagucaaccagaauauaucaaauccuggccauuuacaguacuguggcuuccagccuuguccuggugguuucuuugggcgcgaucucauucuggauguguuuuaacgggagucuccagugcaggaucugcauuuga

SEQ ID NO: 134490 - RNA, 1701 nt, Artificial Sequence
  derived and/or modified sequence opt3 from hemagglutinin__InfluenzaA__AID70456
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagagcuuguaccagaacgccgacaccuacguguucgucgggacaagucgcuauucuaagaaauuuaagccugagauugcgauccgaccaaaagugcgugaucaggagggaagaaugaauuacuauuggacucugguggaacccggugacaagauuaccuucgaggcaacaggcaaccuagucguuccuagguacgccuuugcuauggaacggaacgccggguccggaaucauaauuagcgauaccccagugcaugacugcaauacgacuugucaaacaccgaaaggcgcaaucaacaccucgcuccccuuccagaauauucacccuaucacuaucgguaagugcccaaaguauguaaaaucuacaaagcugcgccuugcuaccgggcugagaaacgugcccuccauucagucaaggggauuguuuggcgccauagcgggcuucaucgaagggggauggacggguauggucgacggcugguacggguaucaucaccagaaugaacaaggaaguggcuacgccgcagaucucaaaagcacccagaacgcuauugacaagaucacaaauaaagugaacuccguuauagagaagaugaauacucaguuuaccgccguggucaaggaguucaaccaccuggaaaaacggauugagaauuuaaacaagaaaguggaugacgguuuccuggauaucuggacauacaaugcugaacuccuuguaguucuggagaacgaacgcacuuuggaguaucaugacucuaaucuaaagaaccuguacgagaaagugcgaaaccagcucaagaauaacgccaaggaaaucgggaauggcuguuuugaguucuaucacaaauuugauaauaccugcauggaaagcgucaagaacggaacauacgacuauccuaaauacucagaggaagcaaagcugaacagagaggagauugauggcgugaaacuugaaaguaccaggaucuaucaaauucuggccauauacuccacugucgcuagcucuuuggugcagguugugucacucggggcgaucaguuucuggauguguuuuaauggaagccugcagugccggauuugcaucuga

SEQ ID NO: 134491 - RNA, 1701 nt, Artificial Sequence
  derived and/or modified sequence opt3 from hemagglutinin__InfluenzaA__AID70457
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugaucaggaggguagaaugaauuacuauuggacucugguggaacccggcgacaagauuaccuucgaggcaacagggaaccuagucguuccuagguacgccuuugcuauggaacgggaugccggaucuggcaucauaauuuccgacaccccagugcaugacugcaacacgacuugucaaacaccgaaaggugcaaucaauaccagccuccccuuccagaacauucacccuaucacuaucgggaagugcccaaaguauguaaaaucgacaaagcugcgccuugcuaccggacugagaaaugugcccucuauucaguccaggggcuuguuuggcgccauagcgggguucaucgagggagguuggacgggcauggucgaugggugguacggauaucaucaccagaacgaacaaggcucagguuacgccgcagaccucaaaaguacccagaaugcuauugauaagaucacaaacaaagugaauagcguuauagagaagaugaacacucaguuuaccgccguggggaaggaguucaaucaccuggaaaaacggauugagaacuuaaauaagaaagucgacgauggcuuccuggacaucuggacauacaacgcugaacuccuugugguacuggagaaugaacgcacuuuggaguaucaugauuccaacguuaagaaucuauacgagaaagugcgaaaccagcugaagaacaaugccaaggaaaucggaaacggcuguuuugaguucuaucacaaauuugacaauaccugcauggaaucugucaagaacgggacauacgauuauccuaaauacagcgaggaagcaaagcucaauagagagaaaauugacggagugaagcuggagucaaccaggaucuaucaaauucuugccauauacaguacugucgcuuccagccuggugcagguugugucuuugggugcgaucucauucuggaaguguuuuaacggcagucuccagugccggauuugcagcuga

SEQ ID NO: 134492 - RNA, 1701 nt, Artificial Sequence
  derived and/or modified sequence opt3 from hemagglutinin__InfluenzaA__AID70458
augaagaccaucauugcccugagcuacauacucugccuuguguucgcucagaaauuucccggcaacgacaauuccauggcaacacuguguuuggggcaccaugccgucccuaacggaacuaugguuaagacgaucaccaaugaucaaauugaggugacaaacgcgacugaauuaguacagucuucaaguaccgguggcaucugcaauagcccacaccagauucuggacgggggaaacuguacacuaaucgaugcucuccugggcgacccgcagugcgaugguuuccaaaauaaaaagugggaccuuuuuguggagagauccaaagccuauucuaacuguuaccccuaugaugucccugacuacgcaucgcugaggucaauaguggccagcagugggaccuuggaguucaauaacgaauccuuuaauuggacuggaguuacacagaacggcaagucugcuagcugcaagcggggcuccgauaauucauucuuuagucgccucaacuggcugacccaucugaauuauaaauacccagcacucaaggugacgaugcccaacaacgaaaaauucgacaaguuauauaucuggggaguccaccauccugggacuuacaaugaucagauuagccuguacgcccaggcuucugguaucauuaccguguccacaaaacgaaaccaacagacuguaaucccaaauauaggcucacgucccagaguuagggacauuccuagccggaucaguauuuauuggaccaucgugaagccaggggauauccuuuugauuaacucuacaggaaaucugauagccccgcgcggcuacuuuaagauccaguccgguaaaagcucgauuaugagaucugacgcgcccaucgggaaguguaacuccgagugcauaaccccuaauggaucaauuccaaacgacaaacccuuccagaaugucaacaggaucacguauggcgcauguccucgguacgugaagcaaaauacucuaaaacucgccacaggcaugcgcaacgugccagagaagcagacccgagggaucuuuggagcuauugccgguuucaucgaaaauggcugggaggggauggucgauggaugguauggcuuuagacaccagaacagugaagguauggggcaagcagcugaccugaaaagcacucaggccgcgauuaaucagauaaacggcaaacuuaacaggcugaucggaaagacaauugagaaguuccaccagaucgagaaggaguucuccgaaguugaaggccggauccaagauuuggagaaauacguggaagacaccaagauugaucucuggucuuauaaugccgagcuguuaguagcacuggagaaccagcauacgauagaccucaccgauagcgaaauggacaaacuuuuugagcguacaaagaagcagaugcgcgaaaaugcugaggauauggggaacggaugcuucaaaaucuaccacaagugugacaaugccugcauugguucaaucagaaacggcauuuacgauagggacaucuaucgggacgaagcucugaguaaucgauuucagauaaaagggguggaguugaaggccggauacaaagauuggauccuauggauuuccuucgcaaucagcugcuuucugcucugugucgugcugcuuggcuucauuaugugggccugccaaaaggguaaccugcgcuguaauaucugcauauga

SEQ ID NO: 134493 - RNA, 1701 nt, Artificial Sequence
  derived and/or modified sequence opt3 from hemagglutinin__InfluenzaA__AID70459
augaagaccaucauugcccugagcuacauacucugccuuguguucgcucagaaaguccccggcaacgacaauuccacagcaacucuguguuuggggcaccaugccguuccuaacggaacgaucgugaagaccauuacaaaugaucaaaucgagguaacuaacgcgaccgaauuagugcagucuucaaguacaggugagauuugcaauagcccacaccagauccuggacggcgaaaacuguacccuaauagaugcucuccugggggacccgcagugcgauggauuucaaaauaaaaagugggaccuuuucgucgagagauccaaagcccauucuaacuguuaucccuacgaugugccugacuaugcaucgcugaggucauugguugccagcaguggcacucucgaauuuaauaacgaguccuucaauuggacaggugugacccagaacgggacgucuagcgcuugcauccggcgcuccaauaacucauuuuucagucgacugaauuggcugacucaccucaacuuuaaguacccagcauuaaacgucaccaugcccaauaacgagcaguucgauaagcuguauauuuggggagugcaucacccuggcacagacaaagaucagaucuuucuuuacgcccaagcuagcggccguauuacuguaucuaccaagaaaucccagcaggccguuaucccaaauauagggucaagacccagggugcggaacauuccuagccgcgucaguaucuauuggacaauugugaagccaggagacaucuugcugaucaauucuaccgguaaccuaauugcgccgagaggcuacuucaaaauaagguccgggaaaagcucgaucaugcggucugaugcacccauuggaaaguguaauuccgccugcaucacgccuaacggcucaauaccaaaugacaaacccuuucagaacgugaaucgcauuacuuacggugcuuguccucgauaugucaagcaaaacacacucaaacuggccccagggaugagaaauguucccgaaaagcagaccaggggaaucuucggcgcaaucgcuggcuuuauugagaacgggugggaaggaaugguggacgguugguacggcuuccggcaccagaauagugaggggcguggacaagccgcggaucuuaaaagcacucaggccgcaaucgaccagauuaacggcaagcugaaccgcuugauagguaaaacaaucgagaaguuccaucagauugaaaaugaguuuuccgaaguagaggggagaauccaagaucucgaaaaguauguggaggacaccaaaaucgaucuguggucuuacauugcugaguuacuggucgcccucgaaaaccagcacacgauagaccuuaccgauagcgagaugaauaagcuguucgaaaagacaaagaaacaguugagggagaacgcugaagacaugggcaauggaugcuuuaagaucuaucauaagugugauaacgccugcauuggcucaauccggaaugggauuuacgaccacgauguguaucgagacgaggcacuaaacaaucgcuuccagaucaaaggaguugagcugaagagugguuacaaagacuggauacucuggaucuccuuugccauuagcugcuuccugcuuuguguggcucuguugggcuuuaucaugugggcgugccaaaaggggaacauuagauguaauaucugcauauga

SEQ ID NO: 134494 - RNA, 1701 nt, Artificial Sequence
  derived and/or modified sequence opt3 from hemagglutinin__InfluenzaA__AID70460
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaggaucagaucuuuuuguacgcccaagcuagcggccguauuacugugucuaccaagaaaucccagcaggccguaaucccaaauauagggucaagacccaggguucggaacauuccuagccgcgugaguaucuauuggacaauugucaagccaggagacauccugcuaaucaauucuaccgguaaccucauugcgccgagaggcuacuucaaaauaagguccggaaagagcucgaucaugcggucugaugcacccauugggaaguguaauuccgccugcaucacgccuaacggcucaauaccaaaugacaaacccuuucagaacgugaaucgcauuacuuacggugcuuguccucgauaugugaagcaaaacacacugaaacuugccaccgggaugagaaaugucccagaaaagcagacuaggggaaucuucggcgcaaucgcuggcuuuauugagaacgggugggaaggaaugguugacgguugguacggcuuccggcaccagaauagugaggggcguggacaagccgcggaucugaaaagcacacaggccgcaaucgaccagauuaacggcaaguugaaccgccucauagguaaaaccaucgagaaguuccaucagauugaaaaggaguuuuccgaaguggaggggagaauccaagaucuggaaaaauauguagaggacacgaagaucgauuuauggucuuacaaugcugagcugcucguggcccuugaaaaccagcacaccauugaccugacagauagcgagaugaauaaauuguucgaaaagacuaaaaagcagcuaagggagaacgcugaagacaugggcaauggaugcuuuaagauauaucauaaaugugauaacgccugcaucggcucaauucggaaugggaucuacgaccacgaugucuaucgagacgaggcacugaacaaucgcuuccagauuaagggaguggagcucaaaagugguuacaaggacuggauccuguggauauccuuugccaucagcugcuuccuucuguguguugcuuugcucggcuuuauuaugugggcgugccaaaaagggaacaucagauguaauauuugcaucuga

SEQ ID NO: 134495 - RNA, 1701 nt, Artificial Sequence
  derived and/or modified sequence opt3 from hemagglutinin__InfluenzaA__AID70461
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaggaucagaucuuuuuguacgcccaagcuagcggccguauuacugugucuaccaagaaaucccagcaggccguaaucccaaauauagggucaagacccaggguucggaacauuccuagccgcgugaguaucuauuggacaauugucaagccaggagacauccugcuaaucaauucuaccgguaaccucauugcgccgagaggcuacuucaaaauaagguccggaaagagcucgaucaugcggucugaugcacccauugggaaguguaauuccgaaugcaucacgccuaacggcucaauaccaaaugacaaacccuuucagaacgugaaucgcauuacuuacggugccuguccucgauaugugaagcaaaacacacugaaacuugcuaccgggaugagaaaugucccagagaagcagacuaggggaaucuucggcgccaucgcaggcuuuauugaaaacgggugggagggaaugguugacgguugguacggcuuccggcaccagaauagugaggggcguggacaagcugccgaucugaaaagcacacaggcggccaucgaccagauuaacggcaaguugaaccgccucauagguaaaaccaucgaaaaguuccaucagauugagaaggaauuuuccgagguggaagggagaauccaagaucuggagaaauauaucgaggacacgaagauugauuuauggucuuacaaugcagaacugcucguagcucuugagaaccagcacaccauagaccugacagauagcgaaaugaauaaauuguucgagaagacuaaaaagcagcuaagggaaaacgccgaggacaugggcaauggaugcuuuaagaucuaucauaaaugugauaacgcuugcauuggcucaauccggaaugggauuuacgaccacgauguguaucgagacgaggcccugaacaaucgcuuccagaucaagggagucgaacucaaaagugguuacaaggacuggauacuguggaucuccuuugcaauuagcugcuuccuucuguguguggccuugcucggcuuuaucaugugggcuugccaaaaagggaacauuagauguauaaccugcaucuga

SEQ ID NO: 134496 - RNA, 1701 nt, Artificial Sequence
  derived and/or modified sequence opt3 from hemagglutinin__InfluenzaA__AID70463
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacagucuucaaguacaggugagaucugcaauagcccacaccagauacuggacggcgaaaacuguacccuaaucgaugcucuccugggggacccgcagugcgauggauuucaaaauaaaaagugggaccuuuucguggagagauccaaagcccauucuaacuguuaucccuacgaugucccugacuaugcaucgcugaggucauugguggccagcaguggcacucucgaauuuaauaacgaguccuucaauuggacagguguuacccagaacgggacgucuagcgcuugcauucggcgcuccaauaacucauuuuucagucgacugaauuggcugacucaccucaacuuuaaguacccagcauuaaacgugaccaugcccaauaacgagcaguucgauaagcuguauaucuggggaguccaucacccuggcacagacaaagaucagauuuuucuuuacgcccaagcuagcggccguaucacugugucuaccaagaaaucccagcaggccguaauaccaaauauugggucaagacccaggguucggaacaucccuagccgcgugaguauuuauuggacaaucgucaagccaggagacaucuugcugauuaauucuaccgguaaccuaauagcgccgagaggcuacuucaaaaucagguccggaaagagcucgauuaugcggucugaugcacccaucgggaaguguaauuccgccugcauaacgccuaacggcucaauuccaaaugacaaacccuuucagaacgugaaucgcaucacuuacggugcuuguccucgauaugugaagcaaaacacacucaaacuggccaccgggaugagaaaugucccagaaaagcagacuaggggaaucuucggcgcaauugcuggcuuuaucgagaacgggugggaaggaaugguugacgguugguacggcuuccggcaccagaauagugaggggcguggacaagccgcggaucuuaaaagcacacaggccgcaauugaccagauaaacggcaagcugaaccgcuugaucgguaaaaccauugagaaguuccaucagaucgaaaaggaguuuuccgaaguggaggggagaauccaagaucucgaaaaauauguagaggacacgaagauugaucuguggucuuacaaugcugaguuacugguggcccucgaaaaccagcacaccauagaccuuacagauagcgagaugaauaaacuguucgaaaagacuaaaaagcaguugagggagaacgcugaagacaugggcaauggaugcuuuaagaucuaucauaaaugugauaacgccugcauuggcucaauccggaaugggauuuacgaccacgaugucuaucgagacgaggcacuaaacaaucgcuuccagaucaagggaguggagcugaaaagugguuacaaggacuggauacucuggaucuccuuugccauuagcugcuuccugcuuuguguugcucuguugggcuuuaucaugugggcgugccaaaaagggaacauuagauguaauaucugcauauga

SEQ ID NO: 134497 - RNA, 1701 nt, Artificial Sequence
  derived and/or modified sequence opt3 from hemagglutinin__InfluenzaA__AID70464
augaagaccaucauugcccugagcuacauacucugccuuguguucgcucagaaacugcccggcgacgauaacuccacagcaacuuuguguuuagggcaccaugccgucccuaauggaacgaucguuaagaccauuacaaacgaccaaaucgaggugacuaaugcgaccgaacugguacagucuucaaguacaggugagauuugcaacagcccacaccagauccuagauggcgaaaauuguacccucauagacgcucugcuuggggauccgcagugcgacggauuucaaaacaaaaagugggaucuguucguggagagauccaaagcccauucuaauuguuaucccuacgacgucccugauuaugcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucacuuaaauuuuaaguacccagcacugaacgugaccaugcccaacaaugagcaguucgacaaacuuuauauuuggggaguccaucacccuggcacagauaaggaccagaucuuuuuguacgcccaagcuagcggccguauuacugugucuaccaagaaaucccagcaggccguaaucccaaacauagggucaagacccaggguucggaauauuccuagccgcgugaguaucuauuggacaauugucaagccaggagauauccugcuaaucaacucuaccgguaaucucauugcgccgagaggcuacuucaaaauaagguccggaaagagcucgaucaugcggucugacgcacccauugggaaguguaacuccgccugcaucacgccuaauggcucaauaccaaacgacaaacccuuucagaaugugaaccgcauuacuuacggugcuuguccucgauaugugaagcaaaauacacugaaacuugccaccgggaugagaaacgucccagaaaagcagacuaggggaaucuucggcgcaaucgcuggcuuuauugagaaugggugggaaggaaugguugaugguugguacggcuuccggcaccagaacagugaggggcguggacaagccgcggaccugaaaagcacacaggccgcaaucgaucagauuaauggcaaguugaaccgccucauagguaaaaccaucgagaaguuccaucagauugaaaaggaguuuuccgaaguggaggggagaauccaagaccuggaaaaauauguagaggauacgaagaucgacuuauggucuuacaacgcugagcugcucguggcccuugaaaaucagcacaccauugaucugacagacagcgagaugaacaaauuguucgaaaagacuaaaaagcagcuaagggagaaugcugaagauaugggcaacggaugcuuuaagauauaucauaaaugugacaaugccugcaucggcucaauucggaacgggaccuacgaucacgacgucuaucgagacgaggcacugaauaaccgcuuccagaucaagggaguggagcucaaaagugguuacaaggauuggauucuguggaucuccuuugccauaagcugcuuccuucuguguguugcuuugcucggcuuuaucaugugggcgugccaaaaagggaauauuagauguaacaucugcauuuga

SEQ ID NO: 134498 - RNA, 1701 nt, Artificial Sequence
  derived and/or modified sequence opt3 from hemagglutinin__InfluenzaA__AID70465
augaagaccaucauugcccugagcuacauacucugccuuguguucgcucagaaacugcccggcgacgauaacuccacagcaacuuuguguuuagggcaccaugccgucccuaauggaacgaucguuaagaccauuacaaacgaccaaaucgaggugacuaaugcgaccgaacugguacagucuucaaguacaggugagauuugcaacagcccacaccagauccuagauggcgaaaauuguacccucauagacgcucugcuuggggauccgcagugcgacggauuucaaaacaaaaagugggaucuguucguggagagauccaaagcccauucuaauuguuaucccuacgacgucccugauuaugcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucacuuaaauuuuaaguacccagcacugaacgugaccaugcccaacaaugagcaguucgacaaacuuuauauuuggggaguccaucacccuggcacagauaaagaccagaucuuuuuguacgcccaagcuagcggccguauuacugugucuaccaagaaaucccagcaggccguaaucccaaacauagggucaagacccaggguucggaauauuccuagccgcgugaguaucuauuggacaauugucaagccaggagauauccugcuaaucaacucuaccgguaaucucauugcgccgagaggcuacuucaaaauaagguccggaaagagcucgaucaugcggucugacgcacccauugggaaguguaacuccgccugcaucacgccuaauggcucaauaccaaacgacaaacccuuucagaaugugaaccgcauuacuuacggugcuuguccucgauaugugaagcaaaauacacugaaacuugccaccgggaugagaaacgucccagaaaagcagacuaggggaaucuucggcgcaaucgcuggcuuuauugagaaugggugggaaggaaugguugaugguugguacggcuuccggcaccagaacagugaggggcguggacaagccgcggaccugaaaagcacacaggccgcaaucgaucagauuaauggcaaguugaaccgccucauagguaaaaccaucgagaaguuccaucagauugaaaaggaguuuuccgaaguggaggggagaauccaagaccuggaaaaauauguagaggauacgaagaucgacuuauggucuuacaacgcugagcugcucguggcccuugaaaaucaccaugcuauugaucugaccgacagcgagaugaacaaauuguucgaaaagacaaagaagcagaugagggagaaugccgaagauaugggcaacggaugcuuuaagauauaucuaaaaugugacaaugcaugcaucggcucaauucggaacgggaucuacgaucacgacgucuaucgagacgaggcccugaauaaccgcuuccagauuaagggaguggagcucaaaagugguuacaaggauuggauccuguggauauccuuuacugaaagcugcuuccuucuguguguugcuuugcucggcuuuaucaugugggcgugccagaaagggaauauuagauguaacaucugcauuuga

SEQ ID NO: 134499 - RNA, 1701 nt, Artificial Sequence
  derived and/or modified sequence opt3 from hemagglutinin__InfluenzaA__AID70466
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcuagcggccguauuacugugucuaccaagaaaucccagcaggccguaaucccaaauauagggucaagacccaggguucggaacauuccuagccgcgugaguaucuauuggacaauugucaagccaggagacauccugcuaaucaauucuaccgguaaccucauugcgccgagaggcuacuucaaaauaagguccggaaagagcucgaucaugcggucugaugcacccauugggaaguguaauuccgccugcaucacgccuaacggcucaauaccaaaugacaaacccuuucagaacgugaaucgcauuacuuacggugcuuguccucgauaugugaagcaaaacacacugaaacuugccaccgggaugagaaaugucccagaaaagcagacuaggggaaucuucggcgcaaucgcuggcuuuauugagaacgggugggaaggaaugguugacgguugguacggcuuccggcaccagaauagugaggggcguggacaagccgcggaucugaaaagcacacaggccgcaaucgaccagauuaacggcaaguugaaccgccucauagguaaaaccaucgagaaguuccaucagauugaaaaugaguuuuccgaaguggaggggagaauccaagaucuggaaaaguauguagaggacacgaaaaucgauuuauggucuuacauuggcgagcugcucguggcucuugaaaaccagcacaccauagaccugacagauagcgagaugaauaaguuguucgaaaagacuaagaaacagcuaagggagaacgccgaagacaugggaaauggcugcuuuaagaucuaucauaagugugauaacgcuugcauugggucaauccggaauggaauuuacgaccacgaugucuaucgagacgaggcccugaacaaucgcuuccagaucaaagguguggagcucaagaguggcuacaaagacuggauacuguggaucuccuuugcaauuagcugcuuccuucuguguguugccuugcucggguuuaucaugugggcuugccaaaagggaaacauuagauguaauaucugcauauga

SEQ ID NO: 134500 - RNA, 1701 nt, Artificial Sequence
  derived and/or modified sequence opt3 from hemagglutinin__InfluenzaA__AID70467
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcuagcggccguauuacugugucuaccaagaaaucccagcaggccguaaucccaaauauagggucaagacccaggguucggaacauuccuagccgcgugaguaucuauuggacaauugucaagccaggagacauccugcuaaucaauucuaccgguaaccucauugcgccgagaggcuacuucaaaauaagguccggaaagagcucgaucaugcggucugaugcacccauugggaaguguaauuccgccugcaucacgccuaacggcucaauaccaaaugacaaacccuuucagaacgugaaucgcauuacuuacggugcuuguccucgauaugugaagcaaaacacacugaaacuugccaccgggaugagaaaugucccagaaaagcagacuaggggaaucuucggcgcaaucgcuggcuuuauugagaacgggugggaaggaaugguugacgguugguacggcuuccggcaccagaauugcgaggggcguggacaagccgcggaucugaaaaguacacaggccgcaaucgaccagauuaacggcaaguugaaccgccucauagguaaaaccaucgagaaguuccaucagauugaaaaugaguuuagcgaaguggaggggagaauccaaggccuggaaaaguauguagaggauacgaaaaucgacuuaugguccuacauugcugagcugauaguggcccucgaaaaccagcacaccaucgaucuuacagacucugagaugaauaagcuguucgaaaagacuaagaaacagaugagggagaacgcugaagauaugggaaauggcuguuuuaagauuuaucauaagugcgacaacgccugcaucgggagcauucggaauggaaucuacgaucacgacgucuaucgagaugaggcauugaacaaucgcuuccagauaaaagguguggagcuaaagucaggcuacaaagacuggauccuguggauuaguuuugccaucuccuguuuccuccugugcguugcgcuucugggguuuauuaugugggcuugucaaaagggaaacaucagaugcaauauauguauuuga

SEQ ID NO: 134501 - RNA, 1701 nt, Artificial Sequence
  derived and/or modified sequence opt3 from hemagglutinin__InfluenzaA__AID70468
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaggaucagaucuuuuuguacgcccaagcuagcggccguauuacugugucuaccaagagaucccagcaggccguaaucccaaauauagggucaaggccccggguucgcaacauuccuagcagagugaguaucuauuggacaauugucaaaccaggagacauccugcuaaucaauucuaccgguaaccucauugcgccgaggggcuacuucaagauacgguccgggaaaagcucgaucaugcgcucugaugcacccauuggaaaguguaauuccgccugcaucacgccuaacggcucaauaccaaaugacaagcccuuucagaacgugaaucgaauuacuuacggugcuuguccuagauaugugaaacaaaacacacugaaacuugccaccgggaugaggaaugucccagaaaagcagacucggggaaucuucggcgcaaucgcuggcuuuauugagaacgggugggaaggaaugguugacgguugguacggcuuccgucaccagaauugcgaggggcgcggacaagccgcggaucugaagaguacacaggccgcaaucgaccagauuaacggcaaauugaacagacucauggguaagagcauagagaaauuccaucagaucgaaaaugaguuuuccgaaguggaggggaggauucaaggccuggaaaaguauguagaggauaccaagaucgacuuauggucuuacaacggagagcugaucguggcucucgaaaaucagcacgccauugaucuuacggacagcgagaugaacaaacuguucgaaaagaccaaaaagcagaugcgggagaaugcugaagauaugggcaacggguguuuuaaaauauauuugaagugcgacaaugccugcaucggaucaauucgaaacgguaucuacgaucaugacgucuaucgcgaugaggcacuaaauaacagauuccagauuaagggcguggagcugaaaaguggguacaaggacuggauccucuggauauccuuuacaaucagcuguuuccugcuuugcguugcccuguugggauuuauuaugugggcuaggcaaaaaggcaauauccgguguaacauuugcaucuga

SEQ ID NO: 134502 - RNA, 1701 nt, Artificial Sequence
  derived and/or modified sequence opt3 from hemagglutinin__InfluenzaA__AID70469
augaagaccaucauugcccugagcuacauacucugccuuguguucgcucagaaaguccccggcaacgaaaauuccacagcaacucuguguuuggggcaccaugccguuccuaacggaacgaucgugaagaccauuacaaaugaccaaaucgagguaacuaacgcgaccgaguuagugcagucuucaaguacaggugaaauuugcaauagcccacaccagauccuggauggcgagaacuguacccuaauagacgcucuccugggggauccgcagugcgacggauuucaaaauaaaaagugggaucuuuucgucgaaagauccaaagcccauucuaacuguuaucccuacgacgugccugauuaugcaucgcugaggucauugguugccagcaguggcacucucgaguuuaauaacgaguccuucaauuggacaggugugacccagaacgggacgucuagcgcuugcauccggcgcuccaauaacucauuuuucagucgacugaauuggcugacucaccucaacuuuaaguacccagcauuaaacgucaccaugcccaauaacgaacaguucgacaagcuguauauuuggggagugcaucacccuggcacagauaaagaccagaucuuucuuuacgcccaagcuagcggccguauuacuguaucuaccaagagaucccagcaggccguuaucccaaauauagggucaaggccccgggugcgcaacauuccuagcagagucaguaucuauuggacaauugugaaaccaggagauaucuugcugaucaauucuaccgguaaccuaauugcgccgaggggcuacuucaagauacgguccgggaaaagcucgaucaugcgcucugacgcacccauuggaaaguguaauuccgccugcaucacgccuaacggcucaauaccaaaugauaagcccuuucagaacgugaaucgaauuacuuacggugcuuguccuagauaugucaaacaaaacacacucaagcuggccaccgggaugaggaauguuccagagaaacagacucggggaaucuucggcgcaaucgcuggcuuuauugaaaacgggugggagggaaugguggacgguugguacggcuuccgucaccagaauugcgaggggcgcggacaagccgcggaccuuaagaguacacaggccgcaaucgaucagauuaacggcaaacugaacagauugauagguaagaccaucgaaaaauuccaucagauugagaaggaauuuagcgagguagaagggaggauccaaggccucgagaaguauguggaggacacgaaaaucgaucugugguccuacaaugcugaauuacuggucgcccucgagaaccagcacaccauugaccuuacagauucugaaaugaauaagcuguucgagaaaacuaagaaacagaugcgggaaaacgcugaggacaugggaaauggcuguuuuaagauauaucauaagugcgauaacgccugcaucgggagcauucgaaauggaaucuacgaccacgauguguaucgcgacgaggcauugaacaauagauuccagauuaaagguguugaacuaaagucaggcuacaaagauuggauccuguggauaaguuuuaccaucuccuguuuccuccugugcguggcccuucugggguuuauuaugugggcuugucaaaagggaaacaucaggugcaauauuuguaucuga

SEQ ID NO: 134503 - RNA, 1701 nt, Artificial Sequence
  derived and/or modified sequence opt3 from hemagglutinin__InfluenzaA__AID70470
augaagaccaucauugcccugagcuacauacucugccuuguguucgcucagaaaguccccggcaacgaaaauuccacagcaacucuguguuuggggcaccaugccguuccuaacggaacgaucgugaagaccauuacaaaugaccaaaucgagguaacuaacgcgaccgaguuagugcagucuucaaguacaggugaaauuugcaauagcccacaccagauccuggauggcgagaacuguacccuaauagacgcucuccugggggauccgcagugcgacggauuucaaaauaaaaagugggaucuuuucgucgaaagauccaaagcccauucuaacuguuaucccuacgacgugccugauuaugcaucgcugaggucauugguugccagcaguggcacucucgaguuuaauaacgaguccuucaauuggacaggugugacccagaacgggacgucuagcgcuugcauccggcgcuccaauaacucauuuuucagucgacugaauuggcugacucaccucaacuuuaaguacccagcauuaaacgucaccaugcccaauaacgaacaguucgacaagcuguauauuuggggagugcaucacccuggcacagauaaagaccagaucuuucuuuacgcccaagcuagcggccguauuacuguaucuaccaagagaucccagcaggccguuaucccaaauauagggucaaggccccgggugcgcaacauuccuagcagagucaguaucuauuggacaauugugaaaccaggagauaucuugcugaucaauucuaccgguaaccuaauugcgccgaggggcuacuucaagauacgguccgggaaaagcucgaucaugcgcucugacgcacccauuggaaaguguaauuccgccugcaucacgccuaacggcucaauaccaaaugauaagcccuuucagaacgugaaucgaauuacuuacggugcuuguccuagauaugucaaacaaaacacacucaagcuggccaccgggaugaggaauguuccagagaaacagacucggggaaucuucggcgcaaucgcuggcuuuauugaaaacgggugggagggaaugguggacgguugguacggcuuccgucaccagaauugcgaggggcgcggacaagccgcggaccuuaagaguacacaggccgcaaucgaucagauuaacggcaaacugaacagauugauagguaagaccaucgaaaaauuccaucagauugagaaggaauuuagcgagguagaagggaggauccaaggccucgagaaguauguggaggacacgaaaaucgaucugugguccuacaauggagaauuacuggucgcucucgagaaccaccauaccauugaccuuacagauucugaaaugaauaagcuguucgagaaaacuaagaaacagaugcgggaaaacgccgaggacaugggcaauggguguuuuaagauauaucacaagugcgauaacgcuugcaucggaagcauucgaaaugguaucuacgaccacgauguguaucgcgacgaggccuugaacaauagauuccagauuaaaggcguugaacuaaagucaggguacaaagauuggauccuguggauaaguuuuaccaucuccuguuuccuccugugcguggcacuucugggauuuauuaugugggccugucagaagggcaacaucaggugcaauauuuguaucuga

SEQ ID NO: 134504 - RNA, 1701 nt, Artificial Sequence
  derived and/or modified sequence opt3 from hemagglutinin__InfluenzaA__AID70471
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacagucuucaaguaccggugagauuugcaauagcccacaccagauccuagacggcgaaaacuguacucucauagaugcgcugcuuggggacccgcagugcgauggauuucaaaauaaaaagugggaccuguucguggagagauccaaagcucauucuaacuguuaucccuacgaugucccugacuaugccucguugaggucacucguggcaagcaguggcacacuggaauuuaauaacgaguccuucaauuggaccgguguuacgcagaacgggacuucuagcgccugcauccggcgcuccaauaacucauuuuucagucgacugaauuggcucacccacuuaaacuuuaaguacccagcucugaacgugacaaugcccaauaacgagcaguucgauaaacuuuauauuuggggaguccaucacccuggcacugacaaagaucagaucuuuuuguacgcacaagccagcggccguauuaccgugucuacaaagaaaucccagcaggcuguaaucccaaauauagggucaagacccaggguucggaacauuccuagccgcgugaguaucuauuggaccauugucaagccaggagacauccugcuaaucaauucuacggguaaccucauugccccgagaggcuacuucaaaauaagguccggaaagagcucgaucaugcggucugaugcgcccauugggaaguguaauuccgcaugcaucacuccuaacggcucaauaccaaaugacaaacccuuucagaacgugaaucgcauuacauacggugccuguccucgauaugugaagcaaaacacccugaaacuugcuacugggaugagaaaugucccagaaaagcagacaaggggaaucuucggcgccaucgcaggcuuuauugagaacgggugggaaggaaugguugacgguugguacggcuuccggcaccagaauagugaggggcguggacaagcugccgaucugaaaagcacccaggcggccaucgaccagauuaacggcaaguugaaccgccucauagguaaaacgaucgagaaguuccaucagauugaaaaugaguuuuccgaaguggaggggagaauccaagaucuggaaaaguauguagaggacaccaaaaucgauuuauggucuuacaacgcagagcugauuguggcucucgaaaaucaccauacaauagaccuuacugauagcgagaugaacaagcuguucgaaaagaccaagaaacagaugagggagaaugccgaagacaugggcaacggaugcuuuaagaucuaucacaagugugauaaugcuugcauuggcucaauccggaacgggauuuacgaccacgaugucuaucgagacgaggccuugaauaaccgcuuccagaucaaaggaguggagcuaaagagugguuacaaagacuggauacuguggaucuccuuugcaauuagcugcuuccucaucuguguugcccugcuuggcuuuauuaugugggcuugccagaaggggaaucugagauguaacaucugcauauga

SEQ ID NO: 134505 - RNA, 1701 nt, Artificial Sequence
  derived and/or modified sequence opt3 from hemagglutinin__InfluenzaA__AID70472
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaggaucagaucuuuuuguacgcccaagcuagcggccguauuacugugucuaccaagaaaucccagcaggccguaaucccaaauauagggucaagacccaggguucggaacauuccuagccgcgugaguaucuauuggacaauugucaagccaggagacauccugcuaaucaauucuaccgguaaccucauugcgccgagaggcuacuucaaaauaagguccggaaagagcucgaucaugcggucugaugcacccauugggaaguguaauuccgccugcaucacgccuaacggcucaauaccaaaugacaaacccuuucagaacgugaaucgcauuacuuacggugcuuguccucgauaugugaagcaaaacacacugaaacuugccaccgggaugagaaaugucccagaaaagcagacuaggggaaucuucggcgcaaucgcuggcuuuauugagaacgggugggaaggaaugguugacgguugguacggcuuccggcaccagaauagugaggggcguggacaagccgcggaucugaaaagcacacaggccgcaaucgaccagauuaacggcaaguugaaccgccucauagguaaaaccaucgagaaguuccaucagauugaaaaggaguuuuccgaaguggaggggagaauccaagaucuggaaaaauauguagaggacacgaagaucgauuuauggucuuacaaugcugagcugcucguggcccuugaaaaccaccauaccauugaccugacagauagcgagaugaauaaauuguucgaaaagacuaaaaagcagaugagggagaacgcugaagacaugggcaauggaugcuuuaagauauaucacaaaugugauaacgccugcaucggcucaauucggaaugggaucuacgaccacgaugucuaucgagacgaggcacuaaacaaucgcuuccagauuaagggaguggagcugaaaagugguuacaaggacuggauccucuggauauccuuugccaucagcugcuuccugcuuuguguugcucuguugggcuuuauuaugugggcgugccagaaagggaacaucagauguaauauuugcaucuga

SEQ ID NO: 134506 - RNA, 1701 nt, Artificial Sequence
  derived and/or modified sequence opt3 from hemagglutinin__InfluenzaA__AID70473
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaggaucagaucuuuuuguacgcccaagcuagcggccguauuacugugucuaccaagaaaucccagcaggccguaaucccaaauauagggucaagacccaggguucggaacauuccuagccgcgugaguaucuauuggacaauugucaagccaggagacauccugcuaaucaauucuaccgguaaccucauugcgccgagaggcuacuucaaaauaagguccggaaagagcucgaucaugcggucugaugcacccauugggaaguguaauuccgccugcaucacgccuaacggcucaauaccaaaugacaaacccuuucagaacgugaaucgcauuacuuacggugcuuguccucgauaugugaagcaaaacacacugaaacuugccaccgggaugagaaaugucccagaaaagcagacuaggggaaucuucggcgcaaucgcuggcuuuauugagaacgggugggaaggaaugguugacgguugguacggcuuccggcaccagaauugcgaggggcguggacaagccgcggaucugaaaaguacacaggccgcaaucgaccagauuaacggcaaguugaaccgccucauagguaaaaccaucgagaaguuccaucagauugaaaaggaguuuagcgaaguggaggggagaauccaaggccuggaaaaauauguagaggauacgaagaucgacuuaugguccuacaaugcugagcugcucguggcccuugaaaaccagcacaccauugaucugacagacucugagaugaauaaauuguucgaaaagacuaaaaagcagaugagggagaacgcugaagauaugggaaauggcuguuuuaagauauaucauaaaugcgacaacgccugcaucgggagcauucggaauggaaucuacgaucacgacgucuaucgagaugaggcacuaaacaaucgcuuccagauuaaggguguggagcugaaaucaggcuacaaggacuggauccucuggauaaguuuugccaucuccuguuuccugcuuugcguugcucuguugggguuuauuaugugggcgugucaaaaaggaaacaucagaugcaauauuuguaucuga

SEQ ID NO: 134507 - RNA, 1701 nt, Artificial Sequence
  derived and/or modified sequence opt3 from hemagglutinin__InfluenzaA__AID70474
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcuagcggccguauuacugugucuaccaagaaaucccagcaggccguaaucccaaauauagggucaagacccaggguucggaacauuccuagccgcgugaguaucuauuggacaauugucaagccaggagacauccugcuaaucaauucuaccgguaaccucauugcgccgagaggcuacuucaaaauaagguccggaaagagcucgaucaugcggucugaugcacccauugggaaguguaauuccgccugcaucacgccuaacggcucaauaccaaaugacaaacccuuucagaacgugaaucgcauuacuuacggugcuuguccucgauaugugaagcaaaacacacugaaacuugccaccgggaugagaaaugucccagaaaagcagacuaggggaaucuucggcgcaaucgcuggcuuuauugagaacguuugggaagggaugguggacggaugguucgguuuccggcaccagaucugcgagggccgugggcaagccgcgggacuggagaguacacaggccgcaauugaucagauaaauggcaaaaugaaccgcuugauggguaagaccaucgggaaauuucaucagauuguaaacgaguucagcgaaguggaaggcagaauccaagaccucgagaaguacgucgaagauacgaagaucgaccugugguccuauauuggagaguuacugguggcucucgagaaucaccaugccauagaucuuaccgacucugaaaugaacaaacuguuugagaagacaaagaagcagaugagggaaaaugcugaggauaugggcaacggguguuucaaaaucuaccacaagugcgacaaugccugcauuggaagcauccggaacgguauuuaugaucgagacguuuaccgcgaugaagcauugaauaacagauuucacaucaagggcguggagcuaaaaucaggguauaaggacuggauaaucuggauuaguuccacugagagcuguuuccugcucugcgucgcccugcuuggauuuaucaugugggcuugucagaaaggcaauauuaggucuaacaucugcauauga

SEQ ID NO: 134508 - RNA, 1701 nt, Artificial Sequence
  derived and/or modified sequence opt3 from hemagglutinin__InfluenzaA__AID70475
augaagaccaucauugcccugagcuacaugcucugccuuguguucgcucagaaacugcccggcaacgacaauuccacagcaacuuuguguuuagggcaccaugccgucccuaacggaacgauaguuaagaccaucacaaaugaucaaauugaggugacuaacgcgaccgaacugguacagucuucaaguacaggugagaucugcaauagcccacaccagauucuagacggcgaaaacuguacccucaucgaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauacggcgcuccaauaacucauuuuucagucgacugaauuggcucacucacuuaaacuuuaaguacccagcacugaacgugaccaugcccaauaacgagcaguucgauaaguuguauaucuggggaguccaucacccuggcacagacaaagaucagauuuuucuuuacgcccaagcuagcggccguaucacugugucuaccaagaaaucccagcaggccguaauuccaaauaucgggucaagacccaggguucggaacauaccuagccgcgugaguauuuauuggacaaucgucaagccaggagacauucugcuaaucaauucuaccgguaaccucaucgcgccgagaggcuacuucaaaauuagguccggaaagagcucgauaaugcggucugaugcacccaucgggaaguguaauuccgccugcauuacgccuaacggcucaaucccaaaugacaaacccuuucagaacgugaaucgcauaacuuacggugcuuguccucgauaugugaagcaaaacacacugaaacuugccaccgggaugagaaaugucccagaaaagcagacuaggggaauuuucggcgcaaucgcuggcuuuaucgagaacguuugggaagggaugguggacggaugguacgguuuccggcaccagaauugcgagggccgugggcaagccgcggaucugaaaagugcccaggcagcuauugaccccaucaacggaaaguugaaccgccucaugggcaaaacaauugguaaguuccaucagauagagaaggaauuuagcgagguagaagggagaauccaggaucuggagaaauauguggaagacaccaagauugauuuaugguccuacaauggcgagcugcucgucgcccuugagaaccaacacgcuaucgaccugacggauucugaaaugaauaaaguguucgagaagaccaaaaagcaguugagggaaaacgccgaggacaugggaaauggcuguuuuaagaucuaucauaaaugcgauaacgcaugcauugggagcauacggaauggaaucuacgaccacgauguuuaucgaaacgaagcccuaaauaaccgcuuccagauuaaggguguggagcugaaaucaggcuacaaggacuggauccucuggauuaguuuugcuaucuccuguuuccugcuuagcgucgcgucucugggguuuauaaugugggcauaccagaaaggaaauaucagaugcaacauuuguaucuga

SEQ ID NO: 134509 - RNA, 1701 nt, Artificial Sequence
  derived and/or modified sequence opt3 from hemagglutinin__InfluenzaA__AID70476
augaagaccaucauugcccugagcuacauacucugccuuguguucgcucagaaacugcccggcaacgaaaauuccacagcaacuuugggguuaggacaccaugccgucccuaacgguacgaucguuaagaccauuacaaaugaccaaaucgaagugacuaacgcgaccgagcugguacagucuucaaguacaggcgaaauuuguaauagcccacaccagauccuagauggggagaacugcacccucauagacgcucugcuuggagauccgcagugugacgauuuucaaaauaaaaagugggaccuguucguggaaagauccaaagcccauucuaacugcuaucccuacgaugucccugacuaugcaucguugaggucacucguggccagcaguggcacucuggaguuuaauaacgaguccuucaauuggacagguguuacccagaacgggacgucuagcgcuuguauccggcgcuccaauaacucauuuuucagucgacugaauuggcucacucacuuaaacuuuaaguacccagcacugaacgugaccaugcccaauaacgaacaguucgauaaacuuuauauuuggggaguccaucacccuggcacagacaaagaucagaucuuuuuguacgcccaagcuagcggccguauuacugugucuaccaagaaaucccagcaggccguaaucccaaauauagggucaagacccaggguucggaacauuccuagccgcgugaguaucuauuggacaauugucaagccaggagacauccugcuaaucaauucuaccgguaaccucauugcgccgagaggcuacuucaaaauaagguccggaaagagcucgaucaugcggucugaugcacccauugggaagugcaauuccgccuguaucacgccuaacggcucaauaccaaaugacaaacccuuucagaacgugaaucgcauuacuuacggugcuugcccucgauaugugaagcaaaacaaucugaaacuugccacagggaugagaaacgucccagagaagcagaccaggggaaucuucggcgcaaucgcuggcuuuauugaaaaugggugggagggaaugguugacgguugguacggcuuccggcaccagaacagugaggggcguggacaagccgcggaucugaaaagcacucaggccgcaaucgaccagauuaacggcaaguugaaucgccucauagguaaaacaaucgaaaaguuccaucagauugagaaggaauuuuccgagguggaagggagaauccaaggcagggagaaauauguagaggauaccaagaucgaccuguggucuuacauuggagaguucauaguggcuuuagagaaccagcacacgaucgaucugaccgacagcgaaaugaauaaacucuuugagaagacaaagaagcagaugcgggaaaacgccgaggauaugggcaauggguguuucaagauuuaucauaaaugcgacaacgcuuguaucggaucaauucgaaaugguaucuacgaucacgacgucuaucgcgaugaggcccuuaacaauagauuucagauaaagggcguggaacugaaaaguggguacaaggacuggaucuuguggauuuccuucgcaaucagcugcuuucuacugugcguugcccuccugggauucauuaugugggcuugucaaaaaggcaacaucaggugcaauauauguauuuga

SEQ ID NO: 134510 - RNA, 1701 nt, Artificial Sequence
  derived and/or modified sequence opt3 from hemagglutinin__InfluenzaA__AID70477
augaagaccaucauugcccugagcuacauacucugccuuguguucgcucagaaacugcccggcaacgacuccucuacagggacuuuguguuuaggacaccaugcagucccuaaugguacgaucguuaagaccauuacaaacgaucaaaucgaggugacuaaugccaccgaacugguacagucaaguagcacaggcgagauuugcaacagaccacaccagauccuagacggggaaaauuguacccucauagaugcgcugcuuggagacccgcagugcgauggcuuucaaaacaaaaagugggaccuguucguggagagguccaaagcucauucuaauuguuaucccuacgaugucccugacuaugccucguugcggucacucguggcaagcagugguacucuggaauuuaacaaugaguccuucaacuggacagggguuacccagaauggaacgucuagcgccugcauccgccgauccaacaauucauuuuucaguauucugaacuggcucacucacuuaaauuuuaaguacccagcucugaacgugaccaugcccaacaaugagcaguucgauaaacuuuauaucuggggcguccaucacccuggcacagacaaagaucagaucuuuuuguacgcacaagccagcgggcguauuacugugucuaccaagaaaucccagcaggcuguaauaccaaacauuggaucaagacccaggguucggaauaucccuagccgcgugaguauuuauuggacaaucgucaagccaggugaaauccugcuaauuaacucuaccggcaaucucauagccccgagaggguacuucaaaaucagguccggaaagagcucgauuaugcggucugacgcgcccaucggcaaguguuacuccgcaugcauaacgccuaacgguucaauuccaaaugauaaacccuuucagaacgugaaucgcaucacuuauggggccuguccucgauacgugaagcaacacccacugaaacuugcuacaggaaugagaaacguccccgagaagcagaccaggggcaucuucggcgccauugcaggguuuaucgaaaauggaugggaggguaugguugacggcugguauggguuccggcaucagauuugcgagggacguggccaagcugccgaccugaaaaguacucaggcggccauagaucagaucaacgguaaguugaaucgccucauugggaaaacaaucgaaaaguuccaccagaucgagaaggaauuuagcgagguggaauggaggauucaaggccuggagaaauacguagaggacaccaagguggauuuaugguccuauaacggagaacugauagucgcacucgagaaucaucacacgaucgaccuuaccgauucugaaaugaacaaacuguucgagaagacaaagaagcagaugagagaaaacgcugaggacaugggcaauggguguuuuaagauuuacuugaaaugcgauaacgccugcaucggaagcauucggaaugguaucuaugaccacgauguguaccgagacgaggcucuaaacaaucgcuuccagauaaagggcguugaacugaaaucaggguacaaggauuggauccucuggauuaguuuuacugaguccuguuuccugcuuagcguggcccuguugggauuuaucaugugggcaugccagaaaggcaacauuagauguaauaucugcauauga

SEQ ID NO: 134511 - RNA, 1701 nt, Artificial Sequence
  derived and/or modified sequence opt3 from hemagglutinin__InfluenzaA__AID70478
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaggaucagaucuuuuuguacgcccaagcuagcggccguauuacugugucuaccaagaaaucccagcaggccguaaucccaaauauagggucaagacccaggguucggaacauuccuagccgcgugaguaucuauuggacaauugucaagccaggagacauccugcuaaucaauucuaccgguaaccucauugcgccgagaggcuacuucaaaauaagguccggaaagagcucgaucaugcggucugaugcacccauugggaaguguaauuccgccugcaucacgccuaacggcucaauaccaaaugacaaacccuuucagaacgugaaucgcauuacuuacggugcuuguccucgauaugugaagcaaaacacacugaaacuugccaccgggaugagaaaugucccagaaaagcagacuaggggaaucuucggcgcaaucgcuggcuuuauugagaacgggugggaaggaaugguugacgguugguacggcuuccggcaccagaauugcgaggggcguggacaagccgcggaucuggagaguacacaggccgcaaucgaccagauuaacggcaaaaugaaccgcuugauggguaagaccauagaaaaauuccaucagaucgagaaggaauuuagcgagguggaagggaggauucaaggcagagagaaguauguagaggauacgaaaaucgaccucugguccuacaauggagaacuguuaguggaucuggagaaccagcacaccaucgaccucacagauucugaaaugaauaaggucuucgagaaaacuaagaaacagaugcgggaaaacgcugaggacaugggcaauggguguuuuaagauuuaucauaagugcgauaacgccugcauaggaagcauccgaaaugguauuuacgaccacgauguguaucgcgacgaggcucuuaacaauagauuccagaucaaaggcguugaacugaagucaggguacaaagacuggauucaauggaucaguuuuaccauauccuguuucuugcuaugcgugagccugcucggauuuaucaugugggccugucagaagggcaacauuaggugcaauaucuguauuuga

SEQ ID NO: 134512 - RNA, 1701 nt, Artificial Sequence; identical to SEQ ID NO: 132056
  derived and/or modified sequence opt3 from hemagglutinin__InfluenzaA__AID70632

SEQ ID NO: 134513 - RNA, 1683 nt, Artificial Sequence
  derived and/or modified sequence opt3 from hemagglutinin__InfluenzaA__AID70634
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaacgcacaguggauuugggccaaugcggguuacugggaaccaucacuggcccaccgcagugugaccaguuucuagaguucucugcugaucucauaaucgaacgacgugaggguucagacguuugcuaccccgggaaguuugugaacgaggaagcccugagacagauucuuagggagaguggaggcaucgauaaagaagcaaugggcuucacauauagcgggauucggaccaauggagccacguccgcuugucgcagaucugguucgucauuuuacgcagagaugaaguggcuguugagcaacacugacaaugccgcuuucccucaaaugaccaagaguuauaaaaacacaaggaaguccccagcccucaucgucuggggcauacaccauucugugagcacugcggagcagaccaaacuguacggguccggaaauaagcugguaacaguuggcucaaguaacuaucagcagagcuuugugcccucuccuggugcacggccacaagucaaugggcucuccggacgcauugauuuccacugguuaaugcugaaccccaaugacaccgugacguuuucauucaacggcgccuuuaucgcuccugaucgagccagcuuccuuagaggcaaaaguauggggauucagucuggagugcaggucgacgcaaacugcgaaggugauuguuaccauuccggcgggacuaucaucagcaauuugccauuucagaacauugacucgagggcuguuggaaagugcccgcgguaugugaagcaacguucucugcuacucgccacaggcaugaaaaauguacccgagauaccuaagggucgcgggcuguucggcgcgaucgccggauucauugaaaacggcugggaggggcuuaucgauggaugguacgguuuuagacaccagaaugcacagggcgaagggaccgcugccgacuacaaauccacucaaucagcuauagaccagauuacaggaaagcugaacaggaucaucgagaaaaccaaucagcaguucgaguugauugauaacgaauuuaaugagguggaaaagcaaaucaguaacgucauuaauuggacgcgggacagcauaaccgaggugugguccuauaacgccgaacuccugguugcaauggagaaucagcacacaaucgauuuagccgacucugagauggauaaacuguacgaacgagugaagcgccagcucagagagaacgcugaagaggacggcacugguuguuucgaaauuuuucauaagugcgaugacgauuguauggcgagcaucaggaauaacaccuaugaccacucaaaauaccgggaggaggcaaugcagaaccgcauccaaauugauccagucaaacuuaguuccggguauaaggacgugauacugugguucagcuuuggcgccucuugcuucaucuugcuagcuauuguaaugggacugguuuuuaucugcgugaagaauggcaacaugagauguacaauuugcaucuga

SEQ ID NO: 134514 - RNA, 1701 nt, Artificial Sequence
  derived and/or modified sequence opt3 from hemagglutinin__InfluenzaA__AIF72902
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaagugcuggugagauuugcgacagcccacaccagauccuagauggcgaaaauuguacacucauagacgcccugcuuggggauccgcagugcgacggauuucaaaacaaaaagugggaucuguucguggagagauccagggcauauucuaauuguuaccccuaugacgucccugauuacgccucguugcggucacucguggcuagcaguggcacccuggaauuuaacaaugaguccuucaacuggacugguguuacacagaaugggaccucuagcgcaugcauccgccgauccaacaauucauuuuucagucgucugaacuggcucacgcauuuaaauuuuaaauauccagcccugaacgugacuaugcccaacaaugagcaguucgacaaacuuuacauuuggggaguccaccauccuggcaccgauaaggaccagaucuuuuuguaugcucaagccagcggcagaauuacagugucuacuaaaaggucccagcaggcgguaaucccaaacauagggucacggccccgcguuagaaauauuccuagcaggaucaguauuuacuggaccaucgugaagccaggagauauccugcuaauuaacucuacagguaaucucauagcaccgcggggcuacuucaaaauccgcuccggaaagagcucgauuaugcgaucugacgcccccaucgggaaauguaacuccgaaugcauaaccccuaauggcucaauuccaaacgacaagcccuuucagaaugucaacagaaucacguauggugcuuguccuagguacgugaagcaaaguacucugaaacuugccacagggaugcggaaugugccagagaagcagacccguggaaucuucggcgcaauugcuggcuuuaucgaaaacgggugggagggaauggucgaugguugguauggcuuccgccaccagaauagcgaggggagaggacaagccgcggaccugaaauccacucaggccgcaauugaucagauaaacggcaaguugaauaggcucaucgguaaaacaaacgaaaaguuccaccagauugagaaagaauuuucugagguugaagggcggauccaagaccuggagaaguacguggaggauaccaagaucgacuuauggagcuauaacgcugaacugcucguagcccuugagaaucagcauacgauugaucugaccgacucagaaaugaacaaauuguucgagaagacaaagaagcagcuacgagaaaaugcugaggauaugggcaacggaugcuuuaaaauauaccacaagugugacaaugccugcaucggcaguauucgcaacgggacuuaugaucaugacguguacagagacgaggcacugaauaacagguuccagaucaagggagucgaacucaaauccgguuacaaggauuggauucuguggaucagcuuugccauaucuugcuuccuucuguguguggcuuugcucggcuuuaucaugugggcgugccaaaaagggaauauucgguguaacaucugcauuuga

SEQ ID NO: 134515 - RNA, 1701 nt, Artificial Sequence
  derived and/or modified sequence opt3 from hemagglutinin__InfluenzaA__AIF72903
augaagaccaucauugcccugagcuacauacucugccuuguguucgcucaggagcugcccggcaacgacaauuccacagcaacuuuguguuuagggcaccaugccgucccuaacggaacgaucguuaaaaccauuacaaaugaucaaaucgaagugacuaacgcgaccgagcugguacagucuucaagugcuggugaaauuugcgacagcccacaccagauccuagauggcgagaauuguacacucauagacgcccugcuuggggauccgcagugcgacggauuucaaaacaagaaaugggaucuguucguggaaagauccagggcauauucuaauuguuaccccuaugacgucccugauuacgccucguugcggucacucguggcuagcaguggcacccuggaguuuaacaaugaguccuucaacuggacugguguuacacagaaugggaccucuagcgcaugcauccgccgauccaacaauucauuuuucagucgucugaacuggcucacgcauuuaaauuuuaaguauccagcccugaacgugacuaugcccaacaaugaacaguucgacaaacuuuacauuuggggaguccaccauccuggcaccgauaaggaccagaucuuuuuguaugcucaagccagcggcagaauuacagugucuacuaagaggucccagcaggcgguaaucccaaacauagggucacggccccgcguuagaaauauuccuagcaggaucaguauuuacuggaccaucgugaaaccaggagauauccugcuaauuaacucuacagguaaucucauagcaccgcggggcuacuucaagauccgcuccgggaaaagcucgauuaugcgaucugacgcccccaucggaaaguguaacuccgagugcauaaccccuaauggcucaauuccaaacgacaaacccuuucagaaugucaacagaaucacguauggugcuuguccuagguacgugaagcaaaguacucugaaacuugccacagggaugcggaaugugccagaaaaacagacccguggaaucuucggcgcaauugcuggcuuuaucgagaacgggugggagggaauggucgaugguugguauggcuuccgccaccagaauagcgaagggagaggacaagccgcggaccugaaguccacucaggccgcaauugaucagauaaacggcaaauugaauaggcucaucgguaagacaaacgagaaauuccaccagauugaaaaggaguuuucugaaguugaggggcggauccaagaccuggagaaauacguggaagauaccaagaucgacuuauggagcuauaacgcugagcugcucguagcccuugaaaaucagcauacgauugaucugaccgacucagagaugaacaaguuguucgaaaagacaaagaaacagcuacgagagaaugcugaggauaugggcaacggaugcuuuaagauauaccacaaaugugacaaugccugcaucggcaguauucgcaacgggacuuaugaucaugacguguacagagacgaagcacugaauaacagguuccagaucaagggagucgagcucaaguccgguuacaaagauugggugcuguggauuagcuuugccaucucuugcuuccuucuguguguugcuuugcucggcuuuauaaugugggcgugccaaaaggggaauauccgguguaacauuugcaucuga

SEQ ID NO: 134516 - RNA, 1701 nt, Artificial Sequence
  derived and/or modified sequence opt3 from hemagglutinin__InfluenzaA__AIF72904
augaagaccaucauugcccugagcuacauacucugccuuguguucgcucaggagcugcccggcaacgacaauuccacagcaacuuuguguuuagggcaccaugccgucccuaacggaacgaucguuaaaaccauuacaaaugaucaaaucgaagugacuaacgcgaccgagcugguacagucuucaagugcuggugaaauuugcgacagcccacaccagauccuagauggcgagaauuguacacucauagacgcccugcuuggggauccgcagugcgacggauuucaaaacaagaaaugggaucuguucguggaaagauccagggcauauucuaauuguuaccccuaugacgucccugauuacgccucguugcggucacucguggcuagcaguggcacccuggaguuuaacaaugaguccuucaacuggacugguguuacacagaaugggaccucuagcgcaugcauccgccgauccaacaauucauuuuucagucgucugaacuggcucacgcauuuaaauuuuaaguauccagcccugaacgugacuaugcccaacaaugaacaguucgacaaacuuuacauuuggggaguccaccauccuggcaccgauaaggaccagaucuuuuuguaugcucaagccagcggcagaauuacagugucuacuaagaggucccagcaggcgguaaucccaaacauagggucacggccccgcguuagaaauauuccuagcaggaucaguauuuacuggaccaucgugaaaccaggagauauccugcuaauuaacucuacagguaaucucauagcaccgcggggcuacuucaagauccgcuccgggaaaagcucgauuaugcgaucugacgcccccaucggaaaguguaacuccgagugcauaaccccuaauggcucaauuccaaacgacaaacccuuucagaaugucaacagaaucacguauggugcuuguccuagguacgugaagcaaaguacucugaaacuugccacagggaugcggaaugugccagaaaaacagacccguggaaucuucggcgcaauugcuggcuuuaucgagaacgggugggagggaaugauggaugguugguauggcuuccgccaccagaauagcgaagggagaggacaagccgcggaccugaaguccacucaggccgcaauugaucagauaaacggcaaauugaauaggcucaucgguaagacaaacgagaaauuccaccagauugaaaaggaguuuucugaagucgaggggcggauccaagaccuggagaaauacguugaagauaccaagaucgacuuauggagcuauaacgcugagcugcucguggcccuugaaaaucagcauacgauugaucugaccgacucagagaugaacaaguuguucgaaaagacaaagaaacagcuacgagagaaugcugaggauaugggcaacggaugcuuuaagauauaccacaaaugugacaaugccugcaucggcaguauucgcaacgggacuuaugaucaugacguauacagagacgaagcacugaauaacagguuccagaucaagggaguggagcucaaguccgguuacaaagauuggguccuguggauuagcuuugccaucucuugcuuccuucuguguguggcuuugcucggcuuuauaaugugggcgugccaaaaggggaauauccgguguaacauuugcaucuga

SEQ ID NO: 134517 - RNA, 1701 nt, Artificial Sequence
  derived and/or modified sequence opt3 from hemagglutinin__InfluenzaA__AIF72905
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaagugcuggugagauuugcgacagcccacaccagauccuagauggcgaaaauuguacacucauagacgcccugcuuggggauccgcagugcgacggauuucaaaacaaaaagugggaucuguucguggagagauccagggcauauucuaauuguuaccccuaugacgucccugauuacgccucguugcggucacucguggcuagcaguggcacccuggaauuuaaaaacgaguccuucaauuggacugguguuacacagaacgggaccucuagcgcaugcauccgccgauccaauaacucauuuuucagucgucugaauuggcucacgcauagcaacuuuaaguauccagccuuaaaugugacuaugcccaacaacgagcaguucgacaagcuguacauuuggggaguccaccauccuggcaccgauaaagaccagaucuuucuuuaugcucaagccucuggcagaauuacaguguccacuaagaggucacagcaggcgguaaucccaaauauagggagccggccccgcguuagaaacauuccuaguaggaucucuauuuacuggaccaucgugaaaccaggagauaucuugcugauuaauuccacagguaaccuaauagcaccgcggggcuacuucaagauccgcagcgggaaaucgucuauuaugcgauccgacgcccccaucggaaaguguaauucagaaugcauaaccccuaacggcaguauuccaaaugacaagcccuuucagaacgucaauagaaucacguauggugcuuguccuagguacgugaaacaaagcacucucaagcuggccacagggaugcggaacgugccagagaaacagacccguggaaucuucggcgcaauugcuggcuuuaucgaaaaugggugggagggaaugauggaugguugguauggcuuccgccaccagaacuccgaggggagaggacaagccgcggaccuuaagucuacucaggccgcaauugaucagauaaauggcaaacugaacagguugaucgguaagacaaaugaaaaauuccaccagauugagaaggaauuuagcgaggucgaagggcggauccaagaccucgagaaguacguugaggauaccaaaaucgaccuguggucauauaacgcugaauuacugguggcccucgagaaccagcauacgauugaucuuaccgacagugaaaugaauaagcuguucgagaaaacaaagaaacaguugcgagaaaacgcugaggauaugggcaauggaugcuuuaagauauaccacaagugugacaacgccugcaucggcuccauucgcaaugggacuuaugaucaugacguauacagagacgaggcacuaaacaauagguuccagaucaaaggaguggaacucaagagcgguuacaaagauuggauucuguggaucucuuuugccauaucaugcuuccugcuuugugucgcucuguugggcuuuaucaugugggcgugccaaaaggggaacauucgguguaauaucugcauuuga

SEQ ID NO: 134518 - RNA, 1701 nt, Artificial Sequence; identical to SEQ ID NO: 125427
  derived and/or modified sequence opt3 from hemagglutinin__InfluenzaA__AIF72906

SEQ ID NO: 134519 - RNA, 1701 nt, Artificial Sequence; identical to SEQ ID NO: 125427
  derived and/or modified sequence opt3 from hemagglutinin__InfluenzaA__AIF72907

SEQ ID NO: 134520 - RNA, 1701 nt, Artificial Sequence; identical to SEQ ID NO: 125427
  derived and/or modified sequence opt3 from hemagglutinin__InfluenzaA__AIF72908

SEQ ID NO: 134521 - RNA, 1701 nt, Artificial Sequence
  derived and/or modified sequence opt3 from hemagglutinin__InfluenzaA__AIF72909
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaagugcuggugagauuugcgacggcccacaccagauccuagauggggaaaauuguacacucauagacgcccugcuuggagauccgcagugcgacggcuuucaaaacaaaaagugggaucuguucguggagagaagcagggcauauuccaauuguuaccccuaugacgucccugauuacgccucuuugcggucgcucguggcuucaagcgguacccuggaauuuaacaaugagaguuucaacuggacugggacaacccagaauggaacguccucugcaugcauccgccgaagcaacaauuccuuuuucucacgucugaacuggcucacucauuuaaauuuuaaauauccagcccugaacguuaccaugcccaacaaugagcaguucgacaaacuuuacauuuggggcgugcaccauccuggcacagauaaggaccagaucuuuuuguaugcucaagccagugggagaauuacugucagcaccaagaggucucagcaggcggugaucccaaacauaggaucccggccccgcguaagaaauauuccuucaaggaucagcauuuacuggacaaucguuaagccaggugauauccugcuaauuaacaguaccggcaaucucauagcaccgcggggguacuucaaaauccgcucuggaaaguccagcauuaugcgaucggacgcccccaucggcaaauguaacucugaaugcauaacgccuaaugguuccauuccaaacgacaagcccuuucagaaugugaacagaaucacuuauggggcuuguccuagguacgucaagcaaucaacacugaaacuugccaccggaaugcggaaugugccagagaagcagacucguggcaucuucggcgcaauugcuggguuuaucgaaaacggaugggaggguaugguggauggcugguauggguuccgccaccagaauagugagggaagaggccaagccgcggaccugaaaagcacacaggccgcaauugaucagauaaacgguaaguugaauaggcucaucgggaaaaccaacgaaaaguuccaccagauugagaaagaauuuuccgaggucgaaggccggauccaagaccuggagaaguacguugaggauacgaagaucgacuuauggucuuauaacgcugaacugcucguggcccuugagaaucagcauaccauugaucugacagacagcgaaaugaacaaauuguucgagaagacuaaaaagcagcuacgagaaaaugcugaggauaugggaaacggcugcuuuaaaauauaccacaagugugacaaugccugcaucgggucaauucgcaacggaaccuaugaucaugacguauacagagacgaggcacugaauaacagguuccagaucaaggguguggaacucaaaaguggcuacaaggauuggauucuguggaucuccuuugccauaagcugcuuccuucugugugucgcuuugcucggguuuaucaugugggcgugccaaaaaggaaauauucgguguaacaucugcauuuga

SEQ ID NO: 134522 - RNA, 1701 nt, Artificial Sequence; identical to SEQ ID NO: 125427
  derived and/or modified sequence opt3 from hemagglutinin__InfluenzaA__AIF72910

SEQ ID NO: 134523 - RNA, 1701 nt, Artificial Sequence; identical to SEQ ID NO: 125427
  derived and/or modified sequence opt3 from hemagglutinin__InfluenzaA__AIF72911

SEQ ID NO: 134524 - RNA, 1701 nt, Artificial Sequence; identical to SEQ ID NO: 134514
  derived and/or modified sequence opt3 from hemagglutinin__InfluenzaA__AIF72912

SEQ ID NO: 134525 - RNA, 1701 nt, Artificial Sequence; identical to SEQ ID NO: 125427
  derived and/or modified sequence opt3 from hemagglutinin__InfluenzaA__AIF72913

SEQ ID NO: 134526 - RNA, 1701 nt, Artificial Sequence
  derived and/or modified sequence opt3 from hemagglutinin__InfluenzaA__AIF72914
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaauuuuaaguauccagcacugaacgugaccaugcccaacaaugagcaguucgacaaacuuuacauuuggggaguccaccauccuggcacagauaaagaccagaucuuuuuguaugcccaagcuagcggccguauuacugugucuaccaagagaucccagcaggccguaaucccaaacauagggucaaggccccggguucgcaauauuccuagcagaaucaguauuuacuggacaaucgugaaaccaggagauauccugcuaauuaacucuaccgguaaucucauagcgccgaggggcuacuucaagauccgcgggggaaaauccagcauuaugcggucggacgcacccaucggcaaguguaacucugaaugcauaacgccuaaugguuccauuccaaacgacaagcccuuucagaaugucaaccgaaucacuuauggggccuguccuagauacgugaaacaaaauacacugaaacuugcuaccggaaugaggaacgugccagagaagcagacucggggcaucuucggcgccauugcaggguuuaucgaaaauggaugggaggguauggucgauggcugguauggguuccgucaccagaacucagagggacgcggccaagcugccgaccugaagaguacacaggcggccauugaucagauaaaugguaaauugaacagacucaucgggaagaccaacgaaaaauuccaccagauugagaaggaauuuagcgagguugaaggcaggauccaugaccuggagaaguacguggaggauacguuauucgaccuguggguauauaauuccgaacuccuuguggcacugcaaaaccagcacaccaucgauuugcccgacucugagaugaauaaacuauuugaaaagacaaagaagcagcugcgggagaacgcugaagauaugggaaauggcugcuucaaaauuuaccauaagugugacaacgccugcauagggagcauccgaaauggaacuuaugaucacgacgucuaccgcgacgaggcucucaacaauagauuucagauuaaggguguggagcugaaaucaggcuacaaggauuggauccuuuggauuaguuucgccaucuccugcuuucuguuguguguugcacuccugggguucauaaugugggccugccaaaaaggaaacaucagguguaauauuugcaucuga

SEQ ID NO: 134527 - RNA, 1701 nt, Artificial Sequence
  derived and/or modified sequence opt3 from hemagglutinin__InfluenzaA__AIF72915
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacuacagauccucgauggcgaaaauuguacccugauagacgcuuugcugggggauccgcagugcgacggauuucaaaacaaaaagugggauuuguucguggagagauccaaagccuauucuaauuguuaccccuaugacgucccugauuacgcaucgcucaggucacugguggccagcaguggcacucuggaauuuaacaaugaguccuucaacuggacagguguuacccagaaugggacgucuagcgcuugcauccggcgcuccaacaauucauuuuucagucgacucaacugguuaacucaccugaauuuuaaguauccagcacuuaacgugaccaugcccaacaaugagcaguucgacaaguuguacauuuggggaguccaucacccuggcacagauaaagaccagaucuuucuguaugcccaagcuagcggccguauuacugugucuaccaagagaucccagcaggccguaaucccaaacauagggucaaggccccggguucgcaauauuccuagcagaaucaguauuuacuggacaaucgugaaaccaggagauauccuacucauuaacucuaccgguaaucugauagcgccgaggggcuacuucaagauccgguccgggaaaagcucgauuaugcgcucuaacgcacccaucggaaaguguaauuccgaaugcauaacgccuaacggcucaauuccaaaugacaagcccuuucagaacgucaaucgaaucacuuauggugccuguccuagauacgugaaacaaaacacacuuaagcuggcuaccgggaugaggaaugugccagagaaacagacucggggaaucuucggcgccauugcaggcuuuaucgaaaacgggugggagggaauggucgacgguugguauggcuuccgucaucagaauagugaggggcgcggacaagcugccgaucuuaagagcacacaggcggccauugaccagauaaacggcaaacucaacagacugaucgguaagaccaaugaaaaauuccaccagauugagaaggaauuuuccgagguugaagggaggauccaagauuuagagaaguacguggaggacacgaaaaucgaucuguggucuuauaacgcagaacuccuuguagcucuggagaaucagcacaccauugacuugacagauagcgaaaugaacaagcuauucgagaaaacuaagaaacagcugcgggaaaaugccgaggacaugggcaacggaugcuuuaagauauaccauaagugugauaaugcuugcaucggcucaauucgaaacgggaccuaugaccacgauguguaccgcgacgaggcccucaauaacagauuccagaucaaaggagucgaacugaagagugguuacaaagacuggauucuuuggaucuccuuugcaauaagcugcuuccuguuguguguggcccuccugggcuuuaucaugugggcuugccaaaaggggaauauuagguguaacaucugcauuuga

SEQ ID NO: 134528 - RNA, 1701 nt, Artificial Sequence; identical to SEQ ID NO: 125427
  derived and/or modified sequence opt3 from hemagglutinin__InfluenzaA__AIF72916

SEQ ID NO: 134529 - RNA, 1701 nt, Artificial Sequence
  derived and/or modified sequence opt3 from hemagglutinin__InfluenzaA__AIF72917
augaagaccaucauugcccugagcuacauacucugccuuguguucgcucagaaacugcccagaaacgacaauuccacagcaacuuuguguuuaggccaccaugccgucccuaacgggacgaucguuaagaccauuacaaaugaucaaaucgaggugacuaacgcgaccgaacugguacagucuucaaguacaggagagauuugcgacagcccacaccagauccuagauggugaaaauuguacccucauagacgcucugcuuggcgauccgcagugcgacggguuucaaaacaaaaagugggaucuguucguggagagguccaaagccuauucuaauuguuaccccuaugacgucccugauuacgcaucguugcggucacucguggccagcaguggaacucuggaauuuaagaacgaguccuucaauuggacaggcguuacccagaacgguacgucuagcgcuugcauccgccgauccaauaacucauuuuucagucgucugaauuggcucacucauuuaaacuuuaaguauccagcacugaaugugaccaugcccaacaacgagcaguucgacaaacuuuacauuuggggaguccaccauccugggacagauaaggaccagaucuuuuuguaugcccaagcuagcggcagaauuacugugucuaccaaaaggucccagcaggccguaaucccaaauauaggcucacggccccgcguuagaaacauuccuagcaggaucaguauuuacuggacaaucgugaagccaggggauauccugcuaauuaauucuaccggaaaccucauagcgccgcgggguuacuucaaaauccgcuccggcaagagcucgauuaugcgaucugacgcacccaucgggaaguguaauuccgaaugcauaacgccuaacggaucaauuccaaaugacaaacccuuucagaacgucaauagaaucacuuauggcgccuguccuagguacgugaagcaaaacacacugaaacuugcuaccgguaugcggaaugugccagagaagcagacucgugggaucuucggagccauugcaggcuuuaucgaaaacggcugggaggggauggucgauggaugguaugguuuccgccaccagaauagugagggcagagggcaagcugccgaccugaaaagcacacaggcggccauugaucagauaaacggaaaguugaauaggcucaucggcaaaaccaacgaaaaguuccaccagauugagaaggaauuuuccgagguugaaggucggauccaagaccuggagaaauacguggaggauacgaagaucgacuuauggucuuauaacgcagaacugcucguagcucuugagaaucagcauaccauugaucugacagacagcgaaaugaacaaauuguucgagaagacuaaaaagcagcuacgagaaaaugccgaggauauggggaacggcugcuuuaagauauaccacaaaugugacaaugcuugcaucggaucaauucgcaacggcaccuaugaucaugacguguacagagacgaggcccugaauaacagguuccagaucaagggggucgaacucaaaaguggauacaaggauuggauucuguggaucuccuuugcaauaagcugcuuccuucuguguguggccuugcucgguuuuaucaugugggcuugccaaaaaggcaauauucggugugacaucugcauuuga

SEQ ID NO: 134530 - RNA, 1683 nt, Artificial Sequence
  derived and/or modified sequence opt3 from hemagglutinin__InfluenzaA__AIG44693
auggagaccgccagccugaucacaauucuccuuguggucacuguuuccaacgcugacaagauaugcaucggcuaccagucuacuaauucaaccgaaacaguggauacucugaccgagaacaauguacccgugacacacgcaaaagaauuguuacauaccgagcacaacgggaugcugugugccacgagucuaggacaaccucucauucuggacacaugcaccaucgaaggucuuauuuauggcaauccaagcugugaucuguugcucgggggaagagagugguccuacaucgucgagaggccgucugcggugaacggccugugcuaucccgguaauguugaaaaccuggaggaacuccggucguuauucucaagcgcucgcaguuaccagcgaauacagaucuuuccugacacgauuuggaauguguccuauucugggacuagcaaggccuguuccgauucauucuaccguaguaugagauggcugacccagaaagacaacgcauauccaauccaagaugcccaguacacaaauaaccaggagaagaauauucuuuuuauguggggaaucaaccaucccccuacugacaccgcucagacaaauuuguacaccaggacggauacuacaaccagcgucgcaacugaggaaauaaaccggacauucaaaccacugauuggcccccgcccucuagugcacggccucauggggagaaucaacuauuacuggucuguacugaagccaggacaaacccuuaggauuaaguccaaugguaaccugaucgccccgugguauggccauaucuugucagggaaaagccacggacggauucucaagacggaccugaaacgcggcaauugcaccguucagugucagacagagaaggguggguuaaacacuacccugcccuuucagaaugugaguaaauacgcuuucggaaacugcucuaaguauauaggcaucaagucccucaaacuugccgucggccugcgaaaugugccuagcagaucgucuaggggguuguuuggagcgauugcagguuucaucgaaggcgggugguccggccuaguggccggaugguacgguuuucaacacucaaacgaucagggggucggcauggcugccgaccgggauaguacacagaaggcaauagacaaaauuacuagcaagguuaauaacaucguggacaaaaugaauaagcaauaugagaucauugaucaugaguucuccgaaguagagacccgucugaacaugaucaauaacaaaauugacgaucagauacaggacaucugggcuuacaaugccgaacuccuggugcuucuggagaaccagaagacauuggaugaacacgacgcgaacgucaauaaccucuacaauaaggugaaacgcgcccugggaucuaacgcaguugaggauggcaagggguguuuugaauuauaucauaaaugcgacgaucaauguauggagaccauuagaaauggaacuuacaacaggcggaaguaucaggaggaaagcaaacuggagaagcagaagaucgaaggugugaaacuagagucagaaggcacguacaagauccucacaauuuauaguaccgucgcuuccagccuggugauagccaugggguucgcugccuuucuuuucugggcaaugucuaauggaucaugccgaugcaacaucuguauuuga

SEQ ID NO: 134531 - RNA, 1701 nt, Artificial Sequence; identical to SEQ ID NO: 128998
  derived and/or modified sequence opt3 from hemagglutinin__InfluenzaA__AIJ10728

SEQ ID NO: 134532 - RNA, 1701 nt, Artificial Sequence
  derived and/or modified sequence opt3 from hemagglutinin__InfluenzaA__AIJ10729
augaagaccaucauugcccugagcuacauacucugccuuguguucgcucagaaacugcccggccacgacaacuccacagcaacuuuguguuuagggcaucacgccgucccuaauggaacgaucguuaagaccauuacaaacgaucaaaucgaggugacuaaugcgaccgaacugguacagucuucaaguacaggugagauuugcaacagcccacaucagauccuagacggcgaaaauuguacccucauagaugcucugcuuggggacccgcagugcgauggauuucaaaacaaaaagugggaccuguucguggagagauccaaagcccacucuaauuguuaucccuacgaugucccugacuaugcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaauuuuaaguacccagcacugaacgugaccaugcccaacaaugagcaguucgauaaacuuuauauuuggggaguccaccacccuggcacagacaaggaucagaucuuuuuguacgcccaagcuagcggccguauuacugugucuaccaagagaucccagcaggccguaaucccaaacauagggucaaggccccggguucgcaauauuccuagcagagugaguaucuauuggacaauugucaaaccaggagacauccugcuaaucaacucuaccgguaaucucauugcgccgaggggcuacuucaagauacgguccgggaaaagcucgaucaugcgcucugaugcacccauuggaaaguguaacuccgccugcaucacgccuaauggcucaauaccaaacgacaagcccuuucagaaugugaaccgaauuacuuacggugcuuguccuagauaugugaaacaaaauacacugaaacuugccaccgggaugaggaacgucccagaaaagcagacuaagggaaucuucggcgcaaucgcuggcuuuauugagaaugggugggaaggaaugguugacgguugguacggcuuccggcaucagaacagugaggggcguggacaagccgcggaucugaaaagcacacaggccgcaaucgaccagauuaauggcaaguugaaccgccucauagguaaaaccaacgagaaguuccaccagaucgaaaaggaguuuuccgaaguggaggggaggauucaagaucuggaaaaauauguagaggacacgaagaucgauuuauggucuuacaaugcugagcugcucguggcccuugaaaaccagcauaccaucgaccugacagauagcgagaugaauaaauuguucgaaaagacuaaaaagcagcuaagagagaacgcugaagacaugggcaauggaugcuuuaagauuuaucacaaaugugauaacgccugcauaggcucaauccggaaugggaccuacgaccacgaugucuaucgagacgaggcacugaacaaucgcuuccagauuaagggaguggagcucaaaagugguuacaaggacuggauccuguggauuuccuuugccaucagcugcuuccuucuguguguugcuuugcucggcuuuauaaugugggcgugccaaaaagggaacaucagauguaauauuugcaucuga

SEQ ID NO: 134533 - RNA, 1701 nt, Artificial Sequence; identical to SEQ ID NO: 128998
  derived and/or modified sequence opt3 from hemagglutinin__InfluenzaA__AIJ10730

SEQ ID NO: 134534 - RNA, 1701 nt, Artificial Sequence; identical to SEQ ID NO: 128998
  derived and/or modified sequence opt3 from hemagglutinin__InfluenzaA__AIJ10731

SEQ ID NO: 134535 - RNA, 1701 nt, Artificial Sequence
  derived and/or modified sequence opt3 from hemagglutinin__InfluenzaA__AIJ10732
augaagaccaucauugcccugagcuacauacucugccuuguguucgcucaggagcugcccggcaacgacaauuccacagcaacuuuguguuuagggcaccaugccgucccuaacggaacgaucguuaaaaccauuacaaaugaucaaaucgaagugacuaacgcgaccgagcugguacagucuucaaguacaggugaaauuugcaauagcccacaccagauccuagacggcgagaacuguacccucauagaugcucugcuuggggacccgcagugcgauggauuucaaaauaagaaaugggaccuguucguggaaagauccaaggcccauucuaacuguuaucccuacgaugucccugacuaugcaucguugaggucacucguggccagcaguggcacucuggaguuuaauaacgaguccuucaauuggacagguguuacccagaacgggacgucuagcgcuugcauccggcgcuccaauaacucauuuuucagucgacugaauuggcucacucacuuaaacuuucguuacccagcacugaacgugaccaugcccaauaacgaacaguucgauaaacuuuauauuuggggaguccaucacccuggcacagacaaggaucagaucuuuuuguacgcccaagcuagcggcagaauuacugugucuaccaagaggucccagcaggccguaaucccaaauauagggucacggccccgcguuagaaacauuccuagcagggugaguaucuauuggacaauugucaaaccaggagacauccugcuaaucaauucuaccgguaaccucauugcgccgcggggcuacuucaagauacgcuccgggaaaagcucgaucaugcgaucugaugcacccauuggaaaguguaauuccgccugcaucacgccuaacggcucaauaccaaaugacaaacccuuucagaacgugaauagaauuacuuacggugcuuguccuagguaugugaagcaaaacacacugaagcuggccaccgggaugcggaaugucccagagaaacagacucguggaaucuucggcgcaaucgcuggcuuuauugaaaacgggugggagggaaugguugacgguugguacggcuuccgccaccagaauagugaggggagaggacaagccgcggaucuuaagagcacacaggccgcaaucgaccagauuaacggcaaauugaacaggcucauagguaagaccaaugaaaaauuccaucagaucgagaaggaauuuuccgagguggaagggcggauucaagaucuggagaaauauguagaggacacgaagaucgauuuauggucuuacaacgcugaacugcucguggcccuugagaaucagcacaccaucgaccugacagauagcgaaaugaacaaguuguucgagaaaacuaagaaacagcuacgagaaaaugcugaggacaugggcaacggaugcuuuaagauuuaucauaaaugugauaaugccugcauaggcucaauccgcaacgggaccuacgaccacgaugucuauagagacgaggcacugaauaacagguuccagauuaagggaguggaacucaagagugguuacaaagacuggauccuguggauuuccuuugccaucagcugcuuccuucuguguguugcuuugcucggcuuuauaaugugggcgugccaaaaggggaauauccgguguaacauuugcaucuga

SEQ ID NO: 134536 - RNA, 1701 nt, Artificial Sequence
  derived and/or modified sequence opt3 from hemagglutinin__InfluenzaA__AIJ10733
augaagaccaucauugcccugagcuacauacucugccuuguguucgcucaggagcugcccggcaacgacaauuccacagcaacuuuguguuuagggcaccaugccgucccuaacggaacgaucguuaaaaccauuacaaaugaucaaaucgaagugacuaacgcgaccgagcugguacagucuucaaguacaggugaaauuugcaauagcccacaccagauccuagacggcgagaacuguacccucauagaugcucugcuuggggacccgcagugcgauggauuucaaaauaagaaaugggaccuguucguggaaagauccaaggcccauucuaacuguuaucccuacgaugucccugacuaugcaucguugaggucacucguggccagcaguggcacucuggaguuuaauaacgaguccuucaauuggacagguguuacccagaacgggacgucuagcgcuugcauccggcgcuccaauaacucauuuuucagucgacugaauuggcucacucacuuaaacuuucguuacccagcacugaacgugaccaugcccaauaacgaacaguucgauaaacuuuauauuuggggaguccaucacccuggcacagacaaggaucagaucuuuuuguacgcccaagcuagcggcagaauuacugugucuaccaagaggucccagcaggccguaaucccaaauauagggucacggccccgcguuagaaacauuccuagcagggugaguaucuauuggacaauugucaaaccaggagacauccugcuaaucaauucuaccgguaaccucauugcgccgcggggcuacuucaagauacgcuccgggaaaagcucgaucaugcgaucugaugcacccauuggaaaguguaaauccgccugcaucacgccuaauggcucaauaccaaacgacaagcccuuucagaaugugaacagaauuacuuacggugcuuguccuagguaugugaagcaaaauacacugaaacuugccaccgggaugcggaacgucccagagaagcagacucguggaaucuucggcgcaaucgcuggcuuuauugaaaaugggugggagggaaugguugacgguugguacggcuuccgccaccagaacagugaggggagaggacaagccgcggaucugaaaagcacacaggccgcaaucgaccagauuaauggcaaguugaacaggcucauagguaaaaccaacgaaaaguuccaucagaucgagaaagaauuuuccgagguggaagggcggauucaagaucuggagaaguauguagaggacacgaagaucgauuuauggucuuacaaugcugaacugcucguggcccuugagaaccagcacaccaucgaccugacagauagcgaaaugaauaaauuguucgagaagacuaaaaagcagcuacgagaaaacgcugaggacaugggcaauggaugcuuuaaaauuuaucauaagugugauaacgccugcauaggcucaauccgcaaugggaccuacgaccacgaugucuauagagacgaggcacugaacaauagguuccagauuaagggaguggaacucaaaagugguuacaaggacuggauccuguggauuuccuuugccaucagcugcuuccuucuguguguugcuuugcucggcuuuauaaugugggcgugccaaaaagggaacauccgguguaauauuugcaucuga

SEQ ID NO: 134537 - RNA, 1701 nt, Artificial Sequence
  derived and/or modified sequence opt3 from hemagglutinin__InfluenzaA__AIJ10734
augaagaccaucauugcccugagcuacauacucugccuuguguucgcucagaaacugcccgagaacgacaauuccacagcaacuuuguguuuaggccaccaugccgucccuaacgggacgaucguuaagaccauuacaaaugaucaaaucgaagugacuaacgcgaccgagcugguacagucuucaaguacaggagaaauuugcaauagcccacaccagauccuagacggugagaacuguacccucauagaugcucugcuuggcgacccgcagugcgauggguuucaaaauaaaaagugggaccuguucguggaaagauccaaagcccauucuaacuguuaucccuacgaugucccugacuaugcaucguugaggucacucguggccagcaguggaacucuggaguuuaauaacgaguccuucaauuggacaggcguuacccagaacgguacgucuagcgcuugcauccggcgcuccaauaacucauuuuucagucgacugaauuggcucacucacuuaaacuuuaaguacccagcacugaacgugaccaugcccaauaacgaacaguucgauaagcuguauauuuggggaguccaucacccugggacagacaaagaucagaucuuuuuguacgcccaagcuagcggccguauuacugugucuaccaagagaucccagcaggccguaaucccaaauauaggcucaaggccccggguucgcaacauuccuagcagaaucaguauuuauuggacaaucgugaaaccaggggacauccugcuaauuaauucuaccggaaaccucauagcgccgagggguuacuucaagauccgguccggcaaaagcucgauuaugcgcucugaugcacccaucgggaaguguaauuccacgugcauaacuccuaacggaucaauuccaaaugacaagcccuuucagaacgucaaucgaaucacauacggcgccuguccuagauaugugaaacaaaacacccugaaacuugcuacugguaugaggaaugugccagagaagcagacacgggggaucuucggagccauugcaggcuuuaucgaaaacggcugggaggggauggucgacggaugguacgguuuccgucaccagaauagugagggccgcgggcaagcugccgaucuuaagagcacccaggcggccauugaccagauaaacggaaaauugaacagacucaucggcaagacgaaugaaaaauuccaucagauugagaaggaauuuuccgagguugaagguaggauccaagaucuggagaaguauguggaggacaccaaaaucgauuuauggucuuacaacgcagaacugcucguagcucuugagaaucagcacacaauugaccugacugauagcgaaaugaacaaguuguucgagaaaaccaagaaacagcuacgggaaaaugccgaggacauggggaacggcugcuuuaagauauaucauaagugugauaaugcuugcaucggaucaauucgaaacggcacauacgaccacgauguguaucgcgacgaggcccugaauaacagauuccagaucaaaggggucgaacucaagaguggauacaaagacuggauucuguggaucuccuuugcaauaagcugcuuccuucuguguguggccuugcucgguuuuaucaugugggcuugccaaaagggcaauauuagguguaacaucugcauuuga

SEQ ID NO: 134538 - RNA, 1701 nt, Artificial Sequence
  derived and/or modified sequence opt3 from hemagglutinin__InfluenzaA__AIJ10735
augaagaccaucauugcccugagcuacauacucugccuuaucuucgcucagaaacugcccgagaacgacaauuccacagcaacuuuguguuuaggccaccaugccgugccuaacgggacgauugucaagaccaucacaaaugaucaaauugaaguuacuaacgcgaccgagcuggugcagucuucaaguacaggagaaaucugcaauagcccacaccagauacuagacggugagaacuguacccucaucgaugcucugcuuggcgacccgcagugcgauggguuucaaaauaaaaagugggaccuguucguagaaagauccaaagcccauucuaacuguuaucccuacgaugugccugacuaugcaucguugaggucacucgucgccagcaguggaacucuggaguuuaauaacgaguccuucaauuggacaggcgugacccagaacgguacgucuagcgcuugcauucggcgcuccaauaacucauuuuucagucgacugaauuggcucacucacuuaaacuuuaaguacccagcacugaacguuaccaugcccaauaacgaacaguucgauaaguuguauaucuggggagugcaucacccugggacagacaaagaucagauuuuucuuuacgcccaagcuagcggccguaucacugucucuaccaagagaucccagcaggccgugauaccaaauauuggcucaaggccccggguacgcaacaucccuagcagaguuaguauuuauuggacaaucgugaaaccaggggacauccugcuaauuaauucuaccggaaaccucauagcgccgagggguuacuucaagauccgguccggcaaaagcucgauuaugcgcucugaugcacccaucgggaaguguaauuccacgugcauaacuccuaacggaucaauuccaaaugacaagcccuuucagaacgucaaucgaaucacauacggcgccuguccuagauaugugaaacaaaacacccugaaacuugcuacugguaugaggaaugugccagagaagcagacacgggggaucuucggagccauugcaggcuuuaucgaaaacggcugggaggggauggucgacggaugguacgguuuccgucaccagaauagugagggcaaggggcaagcugccgaucugaaaagcacccaggcggccauugaccagauaaacggaaaguugaaccgccucaucggcaaaacgaaugaaaaguuccaucagauugagaaggaauuuuccgagguugaagguagaauccaagaucuggagaaauauguggaggacaccaagaucgauuuauggucuuacaacgcagaacugcucguagcucuugagaaucagcacacaauugaccugacugauagcgaaaugaacaaauuguucgagaagaccaaaaagcagcuaagggaaaaugccgaggacauggggaacggcugcuuuaagauauaucauaaaugugauaaugcuugcaucggaucaauucggaacggcacauacgaccacgauguguaucgagacgaggcccugaauaaccgcuuccagaucaagggggucgaacucaaaaguggauacaaggacuggauucuguggaucuccuuugcaauaagcugcuuccuucuguguguggccuugcucgguuuuaucaugugggcuugccaaaaaggcaauauuagauguaacaucugcauuuga

SEQ ID NO: 134539 - RNA, 1701 nt, Artificial Sequence
  derived and/or modified sequence opt3 from hemagglutinin__InfluenzaA__AIJ10736
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuacaauuggugagaucugcgacucaccacaccagauacuagauggcgaaaacuguacccucaucgacgcucugcuuggggauccgcagugcgacggauuucagaauaaaaagugggaucuguucguggagaggaguaaagccuauagcaacuguuaccccuaugacgucccugauuacgcauccuugcggucucucguggccucgucaggcacucuggaauuuaauaacgagagcuucaauuggacagguguuacccaaaacgggacgaguuccgcuugcauucgccgaucuaauaacagcuuuuucucccgucugaauuggcucacucauuuaaacuuuaaguauccagcacugaacgugaccaugcccaauaacgagcaguucgacaaguuguacaucuggggaguccaccauccuggcacagauaaagaccagauuuuucuuuaugcccagucaaguggcagaaucacugugagcaccaagaggucucaacaggcuguaauaccaaauauugggucccggccccgcaucagaaacauuccuucaaggaucagcaucuacuggacaauuguuaaaccaggagauauacugcuaaucaauaguaccgguaaccucauugccccgcggggcuacuucaagauccgcucugggaaauccagcauaaugcgaucggacgcgcccauuggaaaguguaagucugaaugcaucacgccuaauggcuccaucccaaacgacaaacccuuucagaaugugaacagaauuacuuauggugcauguccuagguacgucaagcagucaacacugaaacuugccaccgggaugcggaaugugccagagaagcaaacucguggaaucuucggcgcuauugccggcuuuauagaaaacgggugggagggaaugguggaugguugguauggcuuccgccaccagaauagugaggggagaggacaggcagcugaccugaaaagcacacaagccgcgaucgaucagauuaacggcaaguugaauaggcucaucgguaaaaccaacgaaaaguuccaccagaucgagaaggaauuuuccgaggucgaagggcggauucaggaccuggagaaauacguugaggauacgaagauagacuuauggucuuauaacgccgaacugcucguggcacuugagaaucaacauaccaucgaucugacagacagcgaaaugaacaaauuguucgagaagacuaaaaagcagcuacgagaaaaugcugaggauaugggcaacggaugcuuuaagauuuaccacaaaugugacaaugccugcaucggcucaauucgcaacgggaccuaugaucaugacguauacagagacgaggcucugaauaacagguuccagaucaagggaguggaacucaaaagugguuacaaggauuggauacuguggaucuccuuugccauuagcugcuuccuucugugugucgcauugcucggcuuuaucaugugggccugccagaaagggaauauucgguguaacaucugcauauga

SEQ ID NO: 134540 - RNA, 1701 nt, Artificial Sequence
  derived and/or modified sequence opt3 from hemagglutinin__InfluenzaA__AIJ10737
augaagaccaucauugcccugagcuacauacucugccuuguggucgcucagaaacugcccggcaacgacaauuccacagcaacuuuguguuuagggcaccaugccguuccuaacggaacgaucgugaagaccauuacaaaugauagaaucgagguaacuaacgcgaccgaacuggugcaaaauucuucaauuggugagaucugcgacaguccacaccagauacuagauggcgaaaacuguacacucaucgacgcucugcuuggggauccgcagugcgacggauuccagaauaaaaagugggaucuguuugucgagaggagcaaagccuauuccaacuguuaccccuaugacgugccugauuacgcaucuuugcggucgcucguugccucaagcggcacccuggaguucaauaacgaaaguuuuaauuggacuggugugacacaaaacgggaccuccucugcuugcauucgccgaagcaauaacuccuucuuuucacgucugaauuggcucacgcauuuaaacuucaaguauccagcacugaacgucacuaugcccaauaacgagcaguuugacaaacuuuacaucuggggagugcaccauccuggcaccgauaaagaccagauuuucuuguaugcccagaguagcggcagaaucacaguaucuacuaagaggucccaacaggcuguuauaccaaauauugggucacggccccgcaucagaaacauuccuagcaggaucaguaucuacuggaccauugugaaaccaggagauauacugcuaaucaauucuacagguaaccucauugccccgcggggcuacuuuaagauccgcuccgggaaaagcucgauaaugcgaucugacgcgcccauuggaaaguguaaguccgaaugcaucaccccuaauggcucaaucccaaacgacaaacccuuccagaaugucaacagaauuacguauggugcauguccuagguacgugaagcagaguacucugaaacuugccacagggaugcggaaugugccagagaagcaaacccguggaaucuuuggcgcuauugccggcuucauagaaaacgggugggagggaauggucgaugguugguauggcuuucgccaccagaauagcgaggggagaggacaggcagcugaccugaaauccacucaagccgcgaucgaucagauuaacggcaaguugaauaggcucaucgguaaaacaaacgaaaaguuccaccagaucgagaaggaguucucugaaguugaagggcggauucaggaccuggagaaauacguggaggauaccaagauagacuuauggagcuauaacgccgaacugcucguagcacuugagaaucaacauacgaucgaucugaccgacucagaaaugaacaaauuguuugagaagacaaagaagcagcuacgagaaaaugcugaggauaugggcaacggaugcuucaagauuuaccacaaaugugacaaugccugcaucggcaguauucgcaacgggacuuaugaucaugacguguacagagacgaggcucugaauaacagguuucagaucaagggagucgaacucaaauccgguuacaaggauuggauacuguggaucagcuucgccauuucuugcuuucuucuguguguggcauugcucggcuucaucaugugggccugccagaaagggaauauucgguguaacaucugcauauga

SEQ ID NO: 134541 - RNA, 1701 nt, Artificial Sequence
  derived and/or modified sequence opt3 from hemagglutinin__InfluenzaA__AIJ10738
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauaacuccuuuuucucacgucugaauuggcucacgcauuuaaacuuuaaguauccagcacugaacgugacuaugcccaauaacgagcacuucgacaaacuuuacaucuggggaguccaucacccuggcaccgauaaagaccagaucuuuuuguaugcccagaguagcggcagaauuacagugucuacuaagaggucccagcaagcuguaauaccaaauauugggucacggccccgcaucagaaacauuccuagcaggaucaguaucuacuggaccauuguuaaaccaggagauauacugcuaaucaauucuacagguaaccucauugccccgcggggcuacuucaagauccgcuccgggaaaagcucgauaaugcgaucugacgcgcccauuggaaaguguaaguccgaaugcaucaccccuaauggcucaaucccaaacgacaaacccuuucagaaugugaacagaauuacguauggugcauguccuagguacgucaagcagaguacucugaaacuugccacagggaugcggaaugugccagagaagcagacccguggaaucuucggcgcuauugccggcuuuauagaaaacgggugggagggaaugguggaugguugguauggcuuccgccaccaaaauagcgaggggagaggacaggcagcugaccugaaauccacucaggccgcgaucgaucaaauuaacggcaaguugaauaggcucaucgguaaaacaaacgaaaaguuccaucagaucgagaaggaauuuucugaggucgaagggcggauucaggaccuggagaaauacguugaggauaccaagauagacuuauggagcuauaacgccgaacugcucguggcacuugagaaucagcacacgaucgaucugaccgacucagaaaugaacaaauuguucgagaagacaaagaagcaacuacgagaaaaugcugaggauaugggcaacggaugcuuuaagauuuaccauaaaugugacaaugccugcaucggcaguauucgcaacgggacuuaugaucacgacguauacagagacgaggcucugaauaacagguuccagaucaagggaguggaacucaaauccgguuacaaggauuggauacuguggaucagcuuugccauuucuugcuuccuucugugugucgcauugcucggcuuuaucaugugggccugccagaaagggaauauucgguguaacaucugcauauga

SEQ ID NO: 134542 - RNA, 1701 nt, Artificial Sequence; identical to SEQ ID NO: 131469
  derived and/or modified sequence opt3 from hemagglutinin__InfluenzaA__AIJ10740

SEQ ID NO: 134543 - RNA, 1701 nt, Artificial Sequence; identical to SEQ ID NO: 131469
  derived and/or modified sequence opt3 from hemagglutinin__InfluenzaA__AIJ10741

SEQ ID NO: 134544 - RNA, 1701 nt, Artificial Sequence
  derived and/or modified sequence opt3 from hemagglutinin__InfluenzaA__AIJ10742
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauaacuccuuuuucucacgucugaauuggcucacgcauuuaaacuuuaaguauccagcacugaacgugacuaugcccaauaacgagcaguucgacaaacuuuacaucuggggaguccaccauccuggcaccgauaaagaccagaucuuuuuguaugcccagaguagcggcagaauuacaguggcuacuaagaggucucaacaggccguaauaccaaauauugggucccggccccgcaucagaaacauuccuucaaggaucagcaucuacuggaccauuguuaaaccaggagauauacugcuaaucaauaguacagguaaccucauugcgccgcggggcuacuucaagauccgcucugggaaauccagcauaaugcgaucggacgcacccauuggaaaguguaagucugaaugcaucaccccuaauggcuccaucccaaacgacaaacccuuucagaaugugaacagaauuacguauggugccuguccuagguacgucaagcagucaacucugaaacuugcuacagggaugcggaaugugccagagaagcaaacccguggaaucuucggcgccauugcaggcuuuauagaaaacgggugggagggaaugguggaugguugguauggcuuccgccaccagaauagugaggggagaggacaggcugccgaccugaaaagcacucaagcggccaucgaucagauuaacggcaaguugaauaggcucaucgguaaaacaaacgaaaaguuccaccagaucgagaaggaauuuuccgaggucgaagggcggauucaggaccuggagaaauacguugaggauaccaagauagacuuauggucuuauaacgcagaacugcucguggcucuugagaaucaacauacgaucgaucugaccgacagcgaaaugaacaaauuguucgagaagacaaagaagcagcuacgagaaaaugccgaggauaugggcaacggaugcuuuaagauuuaccacaaaugugacaaugcuugcaucggcucaauucgcaacgggacuuaugaucaugacguauacagagacgaggcccugaauaacagguuccagaucaagggaguggaacucaaaagugguuacaaggauuggauacuguggaucuccuuugcaauuagcugcuuccuucugugugucgccuugcucggcuuuaucaugugggcuugccagaaagggaauauucgguguaacaucugcauauga

SEQ ID NO: 134545 - RNA, 1701 nt, Artificial Sequence
  derived and/or modified sequence opt3 from hemagglutinin__InfluenzaA__AIJ10743
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauaacuccuuuuucucacgucugaauuggcucacgcauuuaaacuuuaaguauccagcacugaacgugacuaugcccaauaacgagcaguucgacaaguuguacaucuggggaguccaccauccuggcaccgauaaagaccagauuuuucuuuaugcccagaguagcggcagaaucacagugucuacuaagaggucccaacaggcuguaauaccaaauauugggucacggccccgcaucagaaacauuccuagcaggaucaguaucuacuggaccauuguuaaaccaggagauauacugcuaaucaauucuacagguaaccucauugccccgcggggcuacuucaagauccgcuccgggaaaagcucgauaaugcgaucugacgcgcccauuggaaaguguaaguccgaaugcaucaccccuaauggcucaaucccaaacgacaaacccuuucagaaugugaacagaauuacguauggugcauguccuagguacgucaagcagaguacucugaaacuugccacagggaugcggaaugugccagagaagcaaacccguggaaucuucggcgcuauugccggcuuuauagaaaacgggugggagggaaugguggaugguugguauggcuuccgccaccagaauagcgaggggagaggacaggcagcugaccugaaauccacucaagccgcgaucgaucagauuaacggcaaguugaauaggcucaucgguaaaacaaacgaaaaguuccaccagaucgagaaggaauuuucugaggucgaagggcggauucaggaccuggagaaauacguugaggauauaaagaucgacuuauggagcuauaacgccgaacugcucguggcacuugagaaucaacauaccauugaucugacggacucagaaaugaacaaauuguucgagaagaccaaaaagcagcuacgagaaaaugcugaggauaugggcaacggaugcuuuaagaucuaccacaaaugugacaaugccugcauuggcaguauccgcaacgggacauaugaucaugacguauacagagacgaggcucugaauaacagguuccagauaaagggaguggaacucaaauccgguuacaaggauuggauccuguggauuagcuuugccaucucuugcuuccuucugugugucgcauugcucggcuuuauuaugugggccugccagaaagggaauauccgguguaacauaugcauuuga

SEQ ID NO: 134546 - RNA, 1701 nt, Artificial Sequence
  derived and/or modified sequence opt3 from hemagglutinin__InfluenzaA__AIJ10744
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauaacuccuuuuucucacgucugaauuggcucacgcauuuaaacuuuaaguauccagcacugaacgugacuaugcccaauaacgagcaguucgacaaacuuuacaucuggggaguccaccauccuggcaccgauaaagaccagaucuuuuuguaugcccagaguagcggcagaauuacagugucuacuaagaggucccaacaggcuguaauaccaaauauugggucacggccccgcaucagaaacauuccuagcaggaucaguaucuacuggaccauuguuaaaccaggagauauacugcuaaucaauucuacagguaaccucauugccccgcggggcuacuucaagauccgcuccgggaaaagcucgauaaugcgaucugacgcgcccauuggaaaguguaaguccgaaugcaucaccccuaauggcucaaucccaaacgacaaacccuuucagaaugugaacagaauuacguauggugcauguccuagguacgucaagcagcggacucugaaacuugccacagggaugcguaaugugccagagaagcaaacccgcggaaucuucggcgcuauugccggcuuuauagaaaacgggugggagggaaugguggaugguugguauggcuucagacaccagaauagugaggggaggggacaggcagcugaccugaaaagcacucaagccgcgaucgaucagauuaacggcaaguugaaucggcucaucgguaaaacaaacgaaaaguuccaccagaucgagaaggaauuuuccgaggucgaagggcgcauucaggaccuggagaaauacguugaggauaccaagauagacuuauggucuuauaacgccgaacugcucguggcacuugagaaucaacauacgaucgaucugaccgacagcgaaaugaacaaauuguucgagaagacaaagaagcagcuacgagaaaaugcugaggauaugggcaacggaugcuuuaagauuuaccacaaaugugacaaugccugcaucggcucaauuagaaacgggacuuaugaucaugacguauacagggacgaggcucugaauaaccgguuccagaucaagggaguggaacucaaaagugguuacaaggauuggauacuguggaucuccuuugccauuagcugcuuccuucugugugucgcauugcucggcuuuaucaugugggccugccagaaagggaauauucgcuguaacaucugcauauga

SEQ ID NO: 134547 - RNA, 1701 nt, Artificial Sequence; identical to SEQ ID NO: 132010
  derived and/or modified sequence opt3 from hemagglutinin__InfluenzaA__AIJ10745

SEQ ID NO: 134548 - RNA, 1701 nt, Artificial Sequence
  derived and/or modified sequence opt3 from hemagglutinin__InfluenzaA__AIJ10747
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacgauuuucagaauaaaaagugggaccuguucguggagaggagcaaagccuauuccaacuguuaccccuaugaugucccugacuacgcaucuuugcggucgcucguggccucaagcggaacccuggaauuuaauaacgagaauuucaacuggacuggcguuacacaaaaugguaccaguuccgcuugcauucgccgaucuaacaauagcuuuuucucccgucugaacuggcucacgcauuuaaacuuuaaguauccagcacugaaugugacuaugcccaacaaugagcaguucgauaaacuuuacaucuggggaguccaccauccugggaccgacaaagaucagaucuuuuuguaugcccagucaaguggcagaauuacagugagcacuaagaggucucaacaggcuguaauaccaaacauuggcucccggccccgcaucagaaauauuccuucaaggaucagcaucuacuggaccauuguuaaaccaggggacauacugcuaaucaacaguacaggaaaucucauugccccgcgggguuacuucaagauccgcucuggcaaauccagcauaaugcgaucggacgcgcccauugggaaguguaagucugaaugcaucaccccuaacggauccaucccaaaugauaaacccuuucagaacgugaauagaauuacguauggcgcauguccuagguacgucaagcagucaacucugaaacuugccacagguaugcggaacgugccagagaagcaaacccgugggaucuucggagcuauugccggcuuuauagaaaauggcugggaggggaugguggacggaugguaugguuuccgccaccagaacagugagggcagagggcaggcagcugaucugaaaagcacucaagccgcgaucgaccagauuaauggaaaguugaacaggcucaucggcaaaacaaacgaaaaguuccaccagaucgagaaggaauuuuccgaggucgaaggucggauucaggaucuggagaaauacguugaggacaccaagauagauuuauggucuuauaaugccgaacugcucguggcacuugagaaccaacauacgaucgaccugaccgauagcgaaaugaauaaauuguucgagaagacaaagaagcagcuacgagaaaacgcugaggacauggggaauggcugcuuuaagauuuaccacaaaugugauaacgccugcaucggaucaauucgcaauggcacuuaugaccaugacguauacagagaugaggcucugaacaauagguuccagaucaaggggguggaacucaaaaguggauacaaggacuggauacuguggaucuccuuugccauuagcugcuuccuucugugugucgcauugcucgguuuuaucaugugggccugccagaaaggcaacauucgguguaauaucugcauauga

SEQ ID NO: 134549 - RNA, 1701 nt, Artificial Sequence; identical to SEQ ID NO: 134548
  derived and/or modified sequence opt3 from hemagglutinin__InfluenzaA__AIJ10748

SEQ ID NO: 134550 - RNA, 1701 nt, Artificial Sequence
  derived and/or modified sequence opt3 from hemagglutinin__InfluenzaA__AIJ10750
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaauucgauccgacgcgcccaucggaaaguguaagucagaaugcaucaccccuaacggcaguauuccaaaugacaaacccuuucagaacgugaauagaaucacguauggugcauguccuagguacgucaagcagagcacucugaaacuugccacagggaugcggaacgugccagagaagcaaacccguggaauuuucggcgcuauagccggcuuuaucgaaaaugggugggagggaaugguggaugguugguauggcuuccgccaccagaacuccgaggggagaggacaggcagcugaccugaaaucuacucaagccgcgauugaucagaucaauggcaaguugaacaggcucaucgguaaaacaaaugaaaaguuccaccagauugagaaggaauuuagcgaggucgaagggcggauacaggaccuggagaaauacguugaggauaccaagaucgacuuauggucauauaacgccgaacugcucguggcacuugagaaccaacauacgauugaucugaccgacagugaaaugaauaaauuguucgagaagacaaagaagcagcuacgagaaaacgcugaggauaugggcaauggaugcuuuaagaucuaccacaaaugugacaacgccugcauuggcuccauccgcaaugggacuuaugaucauaacguauacagagacgaggcucugaauaacagguuccagauaaagggaguggaacucaaaagcgguuacaaggacuggauccuguggauuucuuuugccaucucaugcuuccuucugugugucgcauugcucggcuuuauuaugugggccugccagaaagggaauauccgguguaacauaugcauuuga

SEQ ID NO: 134551 - RNA, 1701 nt, Artificial Sequence
  derived and/or modified sequence opt3 from hemagglutinin__InfluenzaA__AIJ10752
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgaggucgaagggcggauucaggaccuggagaaauacguugaggauaccaagauagacuuauggucauauaacgccgaacugcucguggcacuugagaaccaacauacgaucgaucugaccgacagugaaaugaauaaauuguucgagaagacaaagaagcagcuacgagaaaacgcugaggauaugggcaauggaugcuuuaagauuuaccacaaaugugacaacgccugcaucggcuccauucgcaaugggacuuaugaucaugacguauacagagacgaggcucugaacaauagguuccagaucaagggaguggaacucaaaagcgguuacaaggauuggauacuguggaucucuuuugccaugucaugcuuccuucugugugucgcauugcucggcuuuauuaugugggccugccagaaagggaacauccgguguaauauuugcaucuga

SEQ ID NO: 134552 - RNA, 1701 nt, Artificial Sequence
  derived and/or modified sequence opt3 from hemagglutinin__InfluenzaA__AIJ10753
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucuagcugcauucgcggauccaauaacucauuuuucagucgacugaauuggcucacccauuuaaacuuuaaguauccagcacugaacgugacgaugcccaauaacgagcaguucgacaaguuguacaucuggggcguccaccauccuggcacugauaaagaccagauuuuucuuuaugcccagagcucugggcguaucaccguguccacaaagagaucacaacaggcuguaauaccaaauauuggaagcaggccccggauccgcaacauuccuaguagaaucucuaucuacuggacuauuguuaaaccaggugauauacugcuaaucaauuccaccggcaaccucauugccccgaggggguacuucaagauccggagcggaaaaucgucuauaaugcgcuccgacgcgcccauuggcaaguguaagucagaaugcaucacaccuaaugguaguaucccaaacgacaaacccuuucagaaugugaaccgaauuaccuauggggcauguccuagauacgucaagcagagcacgcugaaacuugccacuggaaugaggaaugugccagagaagcaaacacggggcaucuucggcgcuauugccggguuuauagaaaacggaugggaggguaugauggauggcugguauggguuccgucaccaaaauuccgagggacgcggccaggcagcugaccugaaaucuacccaggccgcgaucgaucagauuaacgguaaguugaauagacucaucgggaaaacuaacgaaaaguuccaccagaucgagaaggaauuuagcgagguggaaggcaggauucaggaccuggagaaauacgucgaggauacaaagauagacuuauggucauauaacgccgaacugcucguugcacuugagaaucaacauaccaucgaucugacggacagugaaaugaacaaauuguucgagaagaccaaaaagcagcuacgggaaaaugcugaggauaugggaaacggcugcuuuaagauuuaccacaaaugugacaaugccugcaucggguccauucgaaacggaacauaugaucaugacguguaccgcgacgaggcucugaauaacagauuccagaucaaggguguagaacucaaaagcggcuacaaggauuggauacuguggaucucuuuugccauuucaugcuuccuucuguguguggcauugcucggguuuaucaugugggccugccagaaaggaaauauuagguguaacaucugcauauga

SEQ ID NO: 134553 - RNA, 1701 nt, Artificial Sequence; identical to SEQ ID NO: 132010
  derived and/or modified sequence opt3 from hemagglutinin__InfluenzaA__AIJ10754

SEQ ID NO: 134554 - RNA, 1701 nt, Artificial Sequence
  derived and/or modified sequence opt3 from hemagglutinin__InfluenzaA__AIJ10755
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaaagcgcgaucgaucagauuaaugguaaguugaacagacucaucgggaaaacuaaugaaaaguuccaccagaucgagaaggaauuuucagaggucgaaggcaggauucaggaccuggagaaauacguugaggauacaaagauagacuuauggaguuauaacgccgaacugcucguggcacuugagaaccaacauaccaucgaucugacggacuccgaaaugaauaaauuguucgagaagaccaaaaagcagcuacgggaaaacgcugaggauaugggaaauggcugcuuuaagauuuaccacaaaugugacaacgccugcaucgggagcauucgaaauggaacauaugaucaugacguauaccgcgacgaggcucugaacaauagauuccagaucaaggguguggaacucaaaucuggcuacaaggauuggauacuguggaucucauuugccauuaguugcuuccuucugugugucgcauugcucggguuuaucaugugggccugccagaaaggaaacauuagguguaauaucugcauauga

SEQ ID NO: 134555 - RNA, 1701 nt, Artificial Sequence; identical to SEQ ID NO: 132010
  derived and/or modified sequence opt3 from hemagglutinin__InfluenzaA__AIJ10756

SEQ ID NO: 134556 - RNA, 1701 nt, Artificial Sequence
  derived and/or modified sequence opt3 from hemagglutinin__InfluenzaA__AIJ10757
augaagaccaucauugcccugagcuacauacucugccuugugaucgcucagaaacugcccggcaacgacaauuccacagcaacuuuguguuuagggcaccaugccgucccuaacggaacgauuguuaagaccaucacaaaugauagaauugaggugacuaacgcgaccgaacugguacaaaauucuucaaucggugagauaugcgacaguccacaccagauccuagauggcgaaaacuguacacucauugacgcucugcuuggggauccgcagugcgacggauuccagaauaaaaagugggaucuguuuguggagaggagcaaagccuauuccaacuguuaccccuaugacgucccugauuacgcaucuuugcggucgcucguggccucaagcggcacccuggaguucaauaacgaaaguuuuaauugggcugguguuacucaaaacgggacauccucugcaugcauccgcggaagcaauuccucauucuuuagucgacugaacuggcucacccauuuaaauuucaaguauccagcccugaacgugacgaugcccaacaaugagcaguuugacaaacuuuacauuuggggcguccaccauccuggcacugauaaggaccagaucuucuuguaugcucagagcucugggcguauaaccguguccacaaagagaucacaacaggccguaauuccaaacaucggaagcaggccccggauucgcaauaucccuaguagaaucucuauuuacuggacuauaguuaaaccaggugauauccugcuaauuaacuccaccggcaaucucaucgcgccgaggggguacuuuaagauacggagcggaaaaucgucuauuaugcgcuccgacgcacccaucggcaaguguaagucagaaugcaucacaccuaacgguaguauuccaaaugacaaacccuuccagaacgugaaucgaaucaccuauggggccuguccuagauacgucaagcagagcacgcugaaacuugcuacuggaaugaggaacgugccagagaagcaaacacggggcauuuuuggcgccauagcaggguucaucgaaaauggaugggaggguaugguggauggcugguauggguuucgucaccagaacuccgagggacgcggccaggcugccgaccugaaaucuacccaagcggccauugaucagaucaaugguaaguugaacagacucaucgggaaaacuaaugaaaaguuccaccagauugagaaggaguucagcgaagucgaaggcaggauacaggaccuggagaaauacguugaggauacaaagaucgacuuauggucauauaacgcagaacugcucguggcucuugagaaccaacauaccauugaucugacggacagugaaaugaauaaauuguuugagaagaccaaaaagcagcuacgggaaaacgccgaggauaugggaaauggcugcuucaagaucuaccacaaaugugacaacgcuugcauuggguccauccgaaauggaacauaugaucaugacguauaccgcgacgaggcccugaacaauagauuucagauaaaggguguggaacucaaaagcggcuacaaggauuggauccuguggauuucuuucgcaaucucaugcuuucuucugugugucguguugcucggguucauuaugugggccugccagaaaggaaacaucagguguaauauaugcauuuga

SEQ ID NO: 134557 - RNA, 1701 nt, Artificial Sequence
  derived and/or modified sequence opt3 from hemagglutinin__InfluenzaA__AIJ10758
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauagcaauuuuaaguauccagccuuaaacgugacgaugcccaacaaugagcaguucgacaagcuguacaucuggggcguccaccauccuggcacugauaaagaccagauuuuucuuuaugcucagucuuccgggcguaucaccgugucaacaaagagaagccaacaggccguaauaccaaacauuggaaguaggccccggauccgcaauauuccuucuagaaucuccaucuacuggacuauuguuaaaccaggugauauauugcugaucaacagcaccggcaaucuaauugcgccgaggggguacuucaagauccggucgggaaaaucuuccauaaugcgcucagacgcacccauuggcaaguguaagagugaaugcaucacaccuaacgguagcaucccaaaugacaaacccuuucagaacgugaaucgaauuaccuauggggccuguccuagauacgucaagcaguccacgcucaaacuggcuacuggaaugaggaacgugccagagaagcaaacacggggcaucuucggcgccauugcaggguuuauagaaaauggaugggaggguaugauggauggcugguauggguuccgucaccagaacucugagggacgcggccaggcugccgaccuuaaaagcacccaagcggccaucgaucagauuaaugguaagcugaacagauugaucgggaaaacuaaugaaaaguuccaccagaucgagaaggaauuuucagagguggaaggcaggauucaggaccucgagaaauacgucgaggauacaaagauagaccuguggaguuauaacgcagaauuacugguugcucucgagaaccaacauaccaucgaucuuacggacuccgaaaugaauaaacuguucgagaagaccaaaaagcaguugcgggaaaacgccgaggauaugggaaauggcugcuuuaagauuuaccacaaaugugacaacgcuugcaucgggagcauucgaaauggaacauaugaucaugacguguaccgcgacgaggcccuaaacaauagauuccagaucaaggguguagaacugaaaucuggcuacaaggauuggauacucuggaucucauuugcaauuaguugcuuccugcuuuguguggcccuguugggguuuaucaugugggcuugccagaaaggaaacauuagguguaauaucugcauauga

SEQ ID NO: 134558 - RNA, 1701 nt, Artificial Sequence; identical to SEQ ID NO: 132010
  derived and/or modified sequence opt3 from hemagglutinin__InfluenzaA__AIJ10759

SEQ ID NO: 134559 - RNA, 1701 nt, Artificial Sequence
  derived and/or modified sequence opt3 from hemagglutinin__InfluenzaA__AIJ10760
augaagaccaucauugcccugagcuacauacucugccuugugaucgcucagaaacugcccggcaacgacaauuccacagcaacuuuguguuuagggcaccaugccgucccuaacggaacgauuguuaagaccaucacaaaugauagaauugaggugacuaacgcgaccgaacugguacaaaauucuucaaucggugagauaugcgacaguccacaccagauccuagauggcgaaaacuguacacucauugacgcucugcuuggggauccgcagugcgacggauuccagaauaaaaagugggaucuguuuguggagaggagcaaagccuauuccaacuguuaccccuaugacgucccugauuacgcaucuuugcggucgcucguggccucaagcggcacccuggaguucaauaacgaaaguuuuaauugggcugguguuacucaaaacgggacauccucugcaugcauccgcggaagcaauuccucauucuuuagucgacugaacuggcucacccauuuaaauuucaaguauccagcccugaacgugacgaugcccaacaaugagcaguuugacaaacuuuacauuuggggcguccaccauccuggcacugauaaggaccagaucuucuuguaugcucagagcucugggcguauaaccguguccacaaagagaucacaacaggccguaauuccaaacaucggaagcaggccccggauucgcaauaucccuaguagaaucucuauuuacuggacuauaguuaaaccaggugauauccugcuaauuaacuccaccggcaaucucaucgcgccgaggggguacuuuaagauacggagcggaaaaucgucuauuaugcgcuccgacgcacccaucggcaaguguaagucagaaugcaucacaccuaacgguaguauuccaaaugacaaacccuuccagaacgugaaucgaaucaccuauggggccuguccuagauacgucaagcagagcacgcugaaacuugcuacuggaaugaggaacgugccagagaagcaaacacggggcauuuuuggcgccauagcaggguucaucgaaaauggaugggaggguaugguggauggcugguauggguuucgucaccagaacuccgagggacgcggccaggcugccgaccugaaaucuacccaagcggccauugaucagaucaaugguaaguugaacagacucaucgggaaaacuaaugaaaaguuccaccagauugagaaggaguucagcgaagucgaaggcaggauacaggaccuggagaaauacguugaggauacaaagaucgacuuauggucauauaacgcagaacugcucguggcucuugagaaccaacauaccauugaucugacggacagugaaaugaauaaauuguuugagaagaccaaaaagcagcuacgggaaaacgccgaggauaugggaaauggcugcuucaagaucuaccacaaaugugacaacgcuugcauuggguccauccgaaauggaacauaugaucaugacguauaccgcgacgaggcccugaacaauagauuucagauaaaggguguggaacucaaaagcggcuacaaggauuggauccuguggauuucuuucgcaaucucaugcuuucuucugugugucgccuugcucggguucauuaugugggcuugccagaaaggaaacaucagguguaauauaugcauuuga

SEQ ID NO: 134560 - RNA, 1701 nt, Artificial Sequence
  derived and/or modified sequence opt3 from hemagglutinin__InfluenzaA__AIJ10761
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggauucaggaccuggagaaauacguugaggauacaaagauagacuuauggucauauaacgcagaacugcucguggcucuugagaaccaacauaccaucgaucugacggacagugaaaugaauaaauuguucgagaagaccaaaaagcagcuacgggaaaacgccgaggauaugggaaauggcugcuuuaagauuuaccacaaaugugacaacgcuugcaucggguccauucgaaauggaacauaugaucaugacguauaccgcaacgaggcccugaauaagagauuccagaucaaagguguggaacucaagagcggcuacaaagacuggauacuguggaucucuuuugcaauuucaugcuuccuucugugugucguguugcucggguuuaucaugugggccugccagaagggaaacauuagguguaauaucugcauauga

SEQ ID NO: 134561 - RNA, 1701 nt, Artificial Sequence; identical to SEQ ID NO: 133908
  derived and/or modified sequence opt3 from hemagglutinin__InfluenzaA__AIJ10762

SEQ ID NO: 134562 - RNA, 1701 nt, Artificial Sequence; identical to SEQ ID NO: 133908
  derived and/or modified sequence opt3 from hemagglutinin__InfluenzaA__AIJ10763

SEQ ID NO: 134563 - RNA, 1701 nt, Artificial Sequence; identical to SEQ ID NO: 133908
  derived and/or modified sequence opt3 from hemagglutinin__InfluenzaA__AIJ10764

SEQ ID NO: 134564 - RNA, 1701 nt, Artificial Sequence; identical to SEQ ID NO: 133908
  derived and/or modified sequence opt3 from hemagglutinin__InfluenzaA__AIJ10765

SEQ ID NO: 134565 - RNA, 1701 nt, Artificial Sequence; identical to SEQ ID NO: 133908
  derived and/or modified sequence opt3 from hemagglutinin__InfluenzaA__AIJ10766

SEQ ID NO: 134566 - RNA, 1701 nt, Artificial Sequence; identical to SEQ ID NO: 133908
  derived and/or modified sequence opt3 from hemagglutinin__InfluenzaA__AIJ10767

SEQ ID NO: 134567 - RNA, 1701 nt, Artificial Sequence
  derived and/or modified sequence opt3 from hemagglutinin__InfluenzaA__AIJ10768
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacaucccagagaagcaaacacggggcauuuucggcgccauagcaggguuuaucgaaaauggaugggaggguaugguggauggcugguauggguuccgucaccagaacuccgagggacgcggccaggcugccgaccugaaaucuacccaagcggccauugaucagaucaaugguaaguugaacagacucaucgggaaaacuaaugaaaaguuccaccagauugagaaggaauuuagcgagguggaaggcaggauacaggaccuggagaaauacgucgaggauacaaagaucgacuuauggucauauaacgcagaacugcucguugcucuugagaaccaacauaccauugaucugacggacagugaaaugaauaaauuguucgagaagaccaaaaagcagcuacgggaaaacgccgaggauaugggaaauggcugcuuuaagaucuaccacaaaugugacaacgcuugcauuggguccauccgaaauggaacauaugaucaugacguguaccgcgacgaggcccugaacaauagauuccagauaaaggguguagaacucaaaagcggcuacaaggauuggauccuguggauuucuuuugcaaucucaugcuuccuucuguguguggucuugcucggguuuauuaugugggccugccagaaaggaaacaucagguguaauauaugcauuuga

SEQ ID NO: 134568 - RNA, 1701 nt, Artificial Sequence
  derived and/or modified sequence opt3 from hemagglutinin__InfluenzaA__AIJ10769
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccagagcggaaaaucgucuauaaugcgguccgacgcacccauuggcaaguguaagucagaaugcaucacaccuaacgguaguaucccaaaugacaaacccuuucagaacgugaaucgcauuaccuauggggccuguccucgauacgucaagcaaagcacgcugaaacuugcuacuggaaugagaaacgugccagagaagcagacaaggggcaucuucggcgccauugcaggguuuauagaaaauggaugggaggguaugguggauggcugguauggguuccggcaccagaacuccgagggacguggccaagcugccgaccugaaaucuacccaggcggccaucgaucagauuaaugguaaguugaaccgccucaucgggaaaacuaaugaaaaguuccaccagaucgagaaggaauuuagcgaggucgaaggcaggauucaagaccuggagaaauacguugaggauacaaagauagacuuauggucauauaacgcagaacugcucguggcucuugagaaccagcauaccaucgaucugacggacagugaaaugaauaaauuguucgagaagaccaaaaagcagcuaagagaaaacgccgaggauaugggaaauggcugcuuuaagauuuaccacaaaugugacaacgcuugcaucggguccauucggaauggaacauaugaucaugacguauaccgagacgaggcccugaacaaucgcuuccagaucaaggguguggaacucaaaagcggcuacaaggauuggauacuguggaucucuuuugcaauuucaugcuuccuucugugugucguguugcucggguuuaucaugugggccugccaaaaaggaaacauuagauguaauaucugcauauga

SEQ ID NO: 134569 - RNA, 1701 nt, Artificial Sequence; identical to SEQ ID NO: 133908
  derived and/or modified sequence opt3 from hemagglutinin__InfluenzaA__AIJ10770

SEQ ID NO: 134570 - RNA, 1701 nt, Artificial Sequence; identical to SEQ ID NO: 133908
  derived and/or modified sequence opt3 from hemagglutinin__InfluenzaA__AIJ10771

SEQ ID NO: 134571 - RNA, 1701 nt, Artificial Sequence; identical to SEQ ID NO: 133908
  derived and/or modified sequence opt3 from hemagglutinin__InfluenzaA__AIJ10772

SEQ ID NO: 134572 - RNA, 1701 nt, Artificial Sequence; identical to SEQ ID NO: 133908
  derived and/or modified sequence opt3 from hemagglutinin__InfluenzaA__AIJ10773

SEQ ID NO: 134573 - RNA, 1701 nt, Artificial Sequence
  derived and/or modified sequence opt3 from hemagglutinin__InfluenzaA__AIJ10774
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcaacaguccacaccagauacuagacggcgaaaauuguacacucaucgaugcucugcuuggggacccgcagugcgauggauuucagaacaaaaagugggaccuguucguggagaggagcaaagccuauuccaauuguuaccccuaugaugucccugacuacgcaucuuugcggucgcucguggccucaagcggcacccuggaauuuaacaaugagaguuucaacugggcugguguuacucaaaaugggacauccucugcaugcauucgcggaagcaacuccucauuuuucagucgacugaauuggcucacccauuuaaacuuuaaguauccagcccugaacgugacgaugcccaauaacgagcaguucgauaaguuguacaucuggggcguccaccauccuggcacugacaaagaucagauuuuucuuuaugcucagagcucugggcguaucaccguguccacaaagagaucacaacaggccguaauaccaaauauuggaagcaggccccggauccgcaacauuccuaguagaaucucuaucuacuggacuauuguuaaaccaggugacauacugcuaaucaauuccaccggcaaccucauugcgccgaggggguacuucaagauccggagcggaaaaucgucuauaaugcgcuccgaugcacccauuggcaaguguaagucagaaugcaucacaccuaaugguaguaucccaaacgacaaacccuuucagaaugugaaccgaauuaccuauggggccuguccuagauacgucaagcagagcacgcugaaacuugcuacuggaaugaggaaugugccagagaagcaaacacggggcaucuucggcgccauugcaggguuuauagaaaacggaugggaggguaugauggacggcugguauggguuccgucaccaaaauuccgagggacgcggccaggcugccgaucugaaaucuacccagagcgcgaucgaccagauuaacgguaaguugaauagacucaucgggaaaacuaacgaaaaguuccaccagaucgagaaggaauuuucagagguggaaggcaggauucaggaucuggagaaauacgucgaggacacaaagauagauuuauggaguuauaacgccgaacugcucguugcacuugagaaucaacauaccaucgaccugacggauuccgaaaugaacaaauuguucgagaagaccaaaaagcagcuacgggaaaaugcugaggacaugggaaacggcugcuuuaagauuuaccacaaaugugauaaugccugcaucgggagcauucgaaacggaacauaugaccaugauguguaccgcgacgaggcucugaauaacagauuccagaucaaggguguagaacucaaaucuggcuacaaggacuggauacuguggaucucauuugccauuaguugcuuccuucuguguguggucuugcucggguuuaucaugugggcaugccagaaaggaaauauuagguguaacaucugcauauga

SEQ ID NO: 134574 - RNA, 1701 nt, Artificial Sequence
  derived and/or modified sequence opt3 from hemagglutinin__InfluenzaA__AIJ10776
augaagaccaucauugcccugagcugcauacucugucuuguguucgcucagaaacugcccggcaacgacaauuccacagcaacuuugugcuuagggcaccaugccgucccuaacggaacgaucguuaagaccauuacaaaugauagaaucgaggugacuaacgcgaccgaacugguacaaaauucuucaauuggugagaucugugacaguccacaccagauacuagauggcgaaaacugcacacucaucgacgcucugcuuggggauccgcagugugacggauuucagaauaaaaagugggaucuguucguggagaggagcaaagccuacuccaacugcuaucccuacgacgucccugauuaugcaucuuugcggucgcucguggccucaagcggcacccuggaauuuaauaacgagaguuucaauugggcugguguuacucaaaacgggacauccucugcauguauucgcggaagcaauuccucauuuuucagucgacugaacuggcucacccauuuaaauuuuaaguacccagcccugaacgugacgaugcccaacaaugagcaguucgacaaguuguauaucuggggcguccaccauccuggcacugauaaagaccagauuuuucuuuacgcucagagcucugggcguaucaccguguccacaaagagaucacaacaggccguaauaccaaacauuggaagcaggccccggauccgcaauauuccuaguagaaucucuaucuauuggacuauuguuaaaccaggugauauacugcuaaucaacuccaccggcaaucucauugcgccgaggggguacuucaagauccggagcggaaaaucgucuauaaugcgcuccgacgcacccauuggcaagugcaagucagaauguaucacaccuaacgguaguaucccaaaugacaaacccuuucagaacgugaaucgaauuaccuacggggccugcccuagauaugucaagcagagcacgcugaaacuugcuacuggaaugaggaacgugccagagaagcaaacacggggcaucuucggcgccauugcaggguuuauagaaaauggaugggaggguaugguggauggcugguacggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggauucaggaccuggagaaauauguugaggauacaaagauagacuuauggucauacaacgcagaacugcucguggcucuugagaaccaacauaccaucgaucugacggacagugaaauguccaaauuguucgagaagaccaaaaagcagcuacgggaaaaugccgaggauaugggaaacggcuguuuuaagauuuaucacaaaugcgacaaugcuugcaucgggagcauucgaaacggaacauacgaucaugacguauaucgcgacgaggcccugaauaacagauuccagaucaaggguguggaacucaaaucuggcuacaaggauuggauacuguggaucucauuugcaauuaguuguuuccuucugugcgucguguugcucggguuuaucaugugggccugucagaaaggaaauauuaggugcaacaucuguauauga

SEQ ID NO: 134575 - RNA, 1701 nt, Artificial Sequence; identical to SEQ ID NO: 133908
  derived and/or modified sequence opt3 from hemagglutinin__InfluenzaA__AIJ10777

SEQ ID NO: 134576 - RNA, 1701 nt, Artificial Sequence; identical to SEQ ID NO: 133908
  derived and/or modified sequence opt3 from hemagglutinin__InfluenzaA__AIJ10778

SEQ ID NO: 134577 - RNA, 1701 nt, Artificial Sequence
  derived and/or modified sequence opt3 from hemagglutinin__InfluenzaA__AIJ10780
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacagcuuucagaauaaaaagugggaucuguucguggagagguccaaagccuauucuaacuguuaccccuaugacgucccugauuacgcaucguugcggucacucguggccagcaguggaacccuggaauuuaauaacgaguccuucaauugggcuggcguuacucaaaacgguacaucuagcgcaugcauucgcggguccaauucaaguuucuuuagccgacugaacuggcucacccauucuaauuuuaaguauccagccuuaaacgugacgaugcccaacaaugagcaguucgacaagcuguacaucuggggaguccaccauccuggcacugauaaagaccagauuuuucuuuaugcucaguccucaggccguaucaccgugagcacaaagagaagucaacaggccguaauaccaaacauugggucuaggccccggauccgcaauauuccuuccagaaucagcaucuacuggacuauuguuaaaccaggagauauauugcugaucaacucgaccgguaaucuaauugcgccgaggggcuacuucaagauccggucugggaaauccucaauaaugcgcagugacgcacccauuggaaaguguaagagcgaaugcaucacaccuaacggcuccaucccaaaugacaaacccuuucagaacgugaaucgaauuaccuauggugccuguccuagauacgucaagcagucuacgcucaaacuggcuacugggaugaggaacgugccagagaagcaaacacggggaaucuucggcgccauugcaggcuuuauagaaaaugggugggagggaaugauggaugguugguauggcuuccgucaccagaacagcgaggggcgcggacaggcugccgaccuuaaaucaacccaagcggccaucgaucagauuaauggcaagcugaacagauugaucgguaaaacuaaugaaaaguuccaccagaucgagaaggaauuuagugagguggaagggaggauucaggacauagagaaauacgucgaggauacaaagaucgaccucugguccuauaacgcagaacuguuaguugcucuggagaaccaacauaccauugaucucacggacagcgaaaugaauaaacuuuucgagaagaccaaaaagcagcugcgggaaaacgccgaggauaugggcaauggaugcuuuaagaucuaccacaaaugugacaacgcuugcauuggcucuauccgaaaugggacauaugaucaugacguguaccgcgacgaggccuugaacaauagauuccagauaaagggaguagaacuaaaaucagguuacaaggauuggauccuguggauuaguuuugcaaucagcugcuuccuccuguguguggcccuucugggcuuuauuaugugggcuugccagaaagggaacaucagguguaauauaugcauuuga

SEQ ID NO: 134578 - RNA, 1701 nt, Artificial Sequence; identical to SEQ ID NO: 133908
  derived and/or modified sequence opt3 from hemagglutinin__InfluenzaA__AIJ10781

SEQ ID NO: 134579 - RNA, 1701 nt, Artificial Sequence; identical to SEQ ID NO: 133908
  derived and/or modified sequence opt3 from hemagglutinin__InfluenzaA__AIJ10782

SEQ ID NO: 134580 - RNA, 1701 nt, Artificial Sequence
  derived and/or modified sequence opt3 from hemagglutinin__InfluenzaA__AIJ10783
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggguuggugugacucaaaacgggacauccucugcuugcauucgcggaagcaauuccucauuuuucagucgacugaacuggcucacccauuuaaauuuuaaguauccagcacugaacgucacgaugcccaacaaugagcaguucgacaaguuguacaucuggggcgugcaccauccuggcacugauaaagaccagauuuuucuuuaugcccagagcucugggcguaucaccguauccacaaagagaucacaacaggcuguuauaccaaacauuggaagcaggccccggauccgcaauauuccuaguagaaucucuaucuacuggacuauugugaaaccaggugauauacugcuaaucaacuccaccggcaaucucauugccccgaggggguacuucaagauccggagcggaaaaucgucuauaaugcgcuccgacgcgcccauuggcaaguguaagucagaaugcaucacaccuaacgguaguaucccaaaugacaaacccuuucagaacgucaaucgaauuaccuauggggcauguccuagauacgugaagcagagcacgcugaaacuugccacuggaaugaggaacgugccagagaagcaaacacggggcaucuucggcgcuauugccggguuuauagaaaauggaugggaggguaugaaagauggcugguauggguuccgucaccagaacuccgagggacgcggccaggcagcugaccugaagucuacccaagccgcgaucgaucagauuaaugguaaauugaacagacucaucgggaagacuaaugaaaaguuccaccagaucgagaaagaauuuagcgaggucgaaggcaggauucaggaccuggagaaguacguugaggauacaaaaauagacuuauggucauauaacgccgaacugcucguggcacuugagaaccaacauaccaucgaucugacggacagugaaaugaauaaguuguucgagaaaaccaagaagcagcuacgggaaaacgcugaggauaugggaaauggcugcuuuaaaauuuaccacaagugugacaacgccugcaucggguccauucgaaauggaacauaugaucaugacguauaccgcgacgaggcucugaacaauagauuccagaucaaagguguggaacucaagagcggcuacaaagauuggauacuguggaucucuuuugccauuucaugcuuccuucugugugucgcauugcucggguuuaucaugugggccugccagaagggaaacauuagguguaauaucugcauauga

SEQ ID NO: 134581 - RNA, 1701 nt, Artificial Sequence; identical to SEQ ID NO: 134580
  derived and/or modified sequence opt3 from hemagglutinin__InfluenzaA__AIJ10784

SEQ ID NO: 134582 - RNA, 1701 nt, Artificial Sequence
  derived and/or modified sequence opt3 from hemagglutinin__InfluenzaA__AIJ10785
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcaacaguccacaccagauacuagacggcgaaaauuguacacucaucgaugcucugcuuggggacccgcagugcgauggauuucagaacaaaaagugggaccuguucguggagaggagcaaagccuauuccaauuguuaccccuaugaugucccugacuacgcaucuuugcggucgcucguggccucaagcggcacccuggaauuuaacaaugagaguuucaacugggcugguguuacucaaaaugggacauccucugcaugcauucgcggaagcaacuccucauuuuucagucgacugaauuggcucacccauuuaaacuuuaaguauccagcccugaacgugacgaugcccaauaacgagcaguucgauaaguuguacaucuggggcguccaccauccuggcacugacaaagaucagauuuuucuuuaugcucagagcucugggcguaucaccguguccacaaagagaucacaacaggccguaauaccaaauauuggaagcaggccccggauccgcaacauuccuaguagaaucucuaucuacuggacuauuguuaaaccaggugacauacugcuaaucaauuccaccggcaaccucauugcgccgaggggguacuucaagauccggagcggaaaaucgucuauaaugcgcuccgaugcacccauuggcaaguguaagucagaaugcaucacaccuaaugguaguaucccaaacgacaaacccuuucagaaugugaaccgaauuaccuauggggccuguccuagauacgucaagcagagcacgcugaaacuugcuacuggaaugaggaaugugccagagaagcaaacacggggcaucuucggcgccauugcaggguuuauagaaaacggaugggaggguaugauggacggcugguauggguuccgucaccaaaauuccgagggacgcggccaggcugccgaucugaaaucuacccagagcgcgaucgaccagauuaacgguaaguugaauagacucaucgggaaaacuaacgaaaaguuccaccagaucgagaaggaauuuucagagguggaaggcaggauucaggaucuggagaaauacgucgaggacacaaagauagauuuauggaguuauaacgccgaacugcucguugcacuugagaaucaacauaccaucgaccugacggauuccgaaaugaacaaauuguucgagaagaccaaaaagcagcuacgggaaaaugcugaggacaugggaaacggcugcuuuaagauuuaccacaaaugugauaaugccugcaucgggagcauucgaaacggaacauaugaccaugauguguaccgcgacgaggcucugaauaacagauuccagaucaaggguguagaacucaaaucuggcuacaaggacuggauacuguggaucucauuugccauuaguugcuuccuucuguguguggcauugcucggguuuaucaugugggccugccagaaaggaaauauuagguguaacaucugcauauga

SEQ ID NO: 134583 - RNA, 1701 nt, Artificial Sequence; identical to SEQ ID NO: 134580
  derived and/or modified sequence opt3 from hemagglutinin__InfluenzaA__AIJ10786

SEQ ID NO: 134584 - RNA, 1701 nt, Artificial Sequence
  derived and/or modified sequence opt3 from hemagglutinin__InfluenzaA__AIJ10787
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggguuggugugacucaaaacgggacauccucugcuugcauucgcggaagcaauuccucauuuuucagucgacugaacuggcucacccauuuaaauuuuaaguauccagcacugaacgucacgaugcccaacaaugagcaguucgacaaguuguacaucuggggcgugcaccauccuggcacugauaaagaccagauuuuucuuuaugcccagagcucugggcguaucaccguauccacaaagagaucacaacaggcuguuauaccaaacauuggaagcaggccccggauccgcaauauuccuaguagaaucucuaucuacuggacuauugugaaaccaggugauauacugcuaaucaacuccaccggcaaucucauugccccgaggggguacuucaagauccggagcggaaaaucgucuauaaugcgcuccgacgcgcccauuggcaaguguaagucagaaugcaucacaccuaacgguaguaucccaaaugacaaacccuuucagaacgucaaucgaauuaccuauggggcauguccuagauacgugaagcagagcacgcugaaacuugccacuggaaugaggaacgugccagagaagcaaacacggggcaucuucggcgcuauugccggguuuauagaaaauggaugggaggguaugaaagauggcugguauggguuccgucaccagaacuccgagggacgcggccaggcagcugaccugaagucuacccaagccgcgaucgaucagauuaaugguaaauugaacagacucaucgggaagacuaaugaaaaguuccaccagaucgagaaagaauuuagcgaggucgaaggcaggauucaggaccuggagaaguacguugaggauacaaaaauagacuuauggucauauaacgccgaacugcucguggcacuugagaaccaacauaccaucgaucugacggacagugaaaugaauaaguuguucgagaaaaccaagaagcagcuacgggaaaacgcugaggauaugggaaauggcugcuuuaaaauuuaccacaagugugacaacgccugcaucggguccauucgaaauggaacauaugaucaugacguauaccgcgacgaggcucugaacaauagauucaggaucaaagguguggaacucaagagcggcuacaaagauuggauacuguggaucucuuuugccauuucaugcuuccuucugugugucgcauugcucggguuuaucaugugggccugccagaagggaaacauucgguguaauaucugcauauga

SEQ ID NO: 134585 - RNA, 1701 nt, Artificial Sequence; identical to SEQ ID NO: 134582
  derived and/or modified sequence opt3 from hemagglutinin__InfluenzaA__AIJ10788

SEQ ID NO: 134586 - RNA, 1701 nt, Artificial Sequence; identical to SEQ ID NO: 134582
  derived and/or modified sequence opt3 from hemagglutinin__InfluenzaA__AIJ10789

SEQ ID NO: 134587 - RNA, 1701 nt, Artificial Sequence; identical to SEQ ID NO: 134580
  derived and/or modified sequence opt3 from hemagglutinin__InfluenzaA__AIJ10790

SEQ ID NO: 134588 - RNA, 1701 nt, Artificial Sequence; identical to SEQ ID NO: 133908
  derived and/or modified sequence opt3 from hemagglutinin__InfluenzaA__AIJ10791

SEQ ID NO: 134589 - RNA, 1701 nt, Artificial Sequence
  derived and/or modified sequence opt3 from hemagglutinin__InfluenzaA__AIJ10792
augaagaccaucauugcccugagcuacauacucugccuuguguucgcucagaaacugcccggcgacgauaacuccacagcaacuuuguguuuagggcaccaugccgucccuaauggaacgaucguuaagaccauuacaaacgacagaaucgaggugacuaaugcgaccgaacugguacaaaacucuucaauuggugagaucugcgauaguccacaccagauacuagacggcgaaaauuguacacucaucgaugcucugcuuggggacccgcagugcgauggauuucagaacaaaaagugggaccuguucguggagaggagcaaagccuauuccaauuguuaccccuaugaugucccugacuacgcaucuuugcggucgcucguggccucaagcggcacccuggaauuuaacaaugagaguuucaacugggcugguguuacucaaaaugggacauccucugcaugcauucgcggaagcaacuccucauuuuucagucgacugaauuggcucacccauuuaaacuuuaaguauccagcccugaaugugacgaugcccaacaacgagcaguucgauaaguuguacaucuggggcguccaccauccuggcacugacaaagaucagauuuuucuuuaugcucagagcucugggcguaucaccguguccacaaagagaucacaacaggccguaauaccaaauauuggaagcaggccccggauccgcaacauuccuaguagaaucucuaucuacuggacuauuguuaaaccaggugacauacugcuaaucaauuccaccggcaaccucauugcgccgaggggguacuucaagauccggagcggaaaaucgucuauaaugcgcuccgacgcacccauuggcaaguguaagucagaaugcaucacaccuaaugguaguaucccaaacgauaaacccuuucagaaugugaaccgaauuaccuauggggccuguccuagauacgucaagcagagcacgcugaaacuugcuacuggaaugaggaaugugccagagaagcaaacacggggcaucuucggcgccauugcaggguuuauagaaaacggaugggaggguaugguggacggcugguauggguuccgucaccaaaauuccgagggacgcggccaggcugccgaucugaaaucuacccaggcggccaucgaccagauuaacgguaaguugaauagacucaucgggaaaacuaacgaaaaguuccaccagaucgagaaggaauuuagcgaggucgaaggcaggauucaggaucuggagaaauacguugaggacacaaagauagauuuauggucauauaaugcagaacugcucguggcucuugagaaccaacauaccaucgaccugacggauagugaaaugaacaaauuguucgagaagaccaaaaagcagcuacgggaaaaugccgaggacaugggaaacggcugcuuuaagauuuaccacaaaugugauaaugcuugcaucggguccauucgaaacggaacauaugaccaugacguauaccgcgaugaggcccugaauaacagauuccagaucaaggguguggaacucaaaagcggcuacaaggacuggauacuguggaucucuuuugcaauuucaugcuuccuucugugugucguguugcucggguuuaucaugugggccugccagaaaggaaauauuagguguaacaucugcauauga

SEQ ID NO: 134590 - RNA, 1701 nt, Artificial Sequence; identical to SEQ ID NO: 131899
  derived and/or modified sequence opt3 from hemagglutinin__InfluenzaA__AIJ29347

SEQ ID NO: 134591 - RNA, 1701 nt, Artificial Sequence
  derived and/or modified sequence opt3 from hemagglutinin__InfluenzaA__AIJ29349
augaagaccaucauugcccugagcuacauacucugccuuguguucgcucagaaauuucccggcaacgacaauuccacagcaacucuguguuuggggcaccaugccgucccuaacggaacgaucguuaagaccauuacaaaugauagaaucgaggugacuaacgcgaccgaauuaguacaaaauucuucaauuggugagaucugcgacaguccacaccagauacuggauggcgaaaacuguacacuaaucgacgcucuccugggggauccgcagugcgacggauuccagaauaaaaagugggaucuuuuuguggagaggagcaaagccuauuccaacuguuaccccuaugacgucccugauuacgcaucucugcggucguugguggccucaagcggcacccucgaguucaauaacgaaaguuuuaauuggacugguguuacacaaaacgggaccuccucugcuugcauucgccgaagcaauuccucauucuuuagucgucugaacuggcugacgcaucucaauuucaaguauccagcauuaaacgugacuaugcccaacaaugagcaguuugacaagcuguacaucuggggaguccaccauccuggcaccgauaaagaccagauuuuccuuuaugcccagagcucuggcagaaucacaguguccacuaagaggucacaacaggcuguaauaccaaacauugggagccggccccgcaucagaaauauuccuaguaggaucucuaucuacuggaccauuguuaaaccaggagauauauugcugaucaacuccacagguaaucuaauugccccgcggggcuacuuuaagauccgcagcgggaaaucgucuauaaugcgauccgacgcgcccauuggaaaguguaagucagaaugcaucaccccuaacggcaguaucccaaaugacaaacccuuccagaacgugaauagaauuacguauggugcauguccuagguacgucaagcagagcacucucaaacuggccacagggaugcggaacgugccagagaagcaaacccguggaaucuuuggcgcuauugccggcuucauagaaaaugggugggagggaaugguggaugguugguauggcuuccgccaccagaacuccgaggggagaggacaggcagcugaccuuaaaucuacucaagccgcgaucgaucagauuaauggcaagcugaacagguugaucgguaaaacaaaugaaaaguuucaccagaucgagaaggaguucagcgaagucgaagggcggauucaggaccucgagaaauacguugaggauaccaagauagaccuguggucauauaacgccgaauuacugguggcacucgagaaccaacauacgaucgaucuuaccgacagugaaaugaauaaacuguuugagaagacuaaaaagcaguugcgagaaaacgcugaggauaugggcaauggaugcuucaagauuuaccacaaaugugacaacgccugcaucggcuccauucgcaaugggacauaugaucaugacguauacagagacgaggcucuaaacaauagguuucagaucaagggaguggaacugaaaagcgguuacaaggauuggauacucuggaucucuuucgccauuucaugcuuucugcuuugugucgcacuguugggcuucaucaugugggccugccagaaagggaacauucgguguaauaucugcauauga

SEQ ID NO: 134592 - RNA, 1701 nt, Artificial Sequence
  derived and/or modified sequence opt3 from hemagglutinin__InfluenzaA__AIJ29351
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgaggucgaagggcggauucaggaccuggagaaauacguugaggauaccaagauagacuuauggucauauaacgccgaacugcucguggcacuugagaaccaacauacgaucgaucugaccgacagugaaaugaauaaauuguucgagaagacaaagaagcagcuacgagaaaacgcugaggauaugggcaauggaugcuuuaagauuuaccacaaaugugacaacgccugcaucggcuccauucgcaaugggacuuaugaucaugacguauacagagacgaggcucugaacaauagguuccagaucaagggaguggaacucaaaagcgguuacaaggauuggauacuguggaucucuuuugccauuucaugccuucuguugugugucgcacuccugggcuucaucaugugggccugccagaaagggaacauucgguguaauaucugcauauga

SEQ ID NO: 134593 - RNA, 1701 nt, Artificial Sequence; identical to SEQ ID NO: 131496
  derived and/or modified sequence opt3 from hemagglutinin__InfluenzaA__AIJ29353

SEQ ID NO: 134594 - RNA, 1701 nt, Artificial Sequence
  derived and/or modified sequence opt3 from hemagglutinin__InfluenzaA__AIJ29355
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacucaaguuucuuuagccgacugaauuggcucacucauuuaaacuuuaaguauccagcacugaaugugaccaugcccaacaacgagcaguucgacaaacuuuacauuuggggaguccaccauccuggcacagauaaggaccagaucuuuuuguaugcccaaucuuccggccguauuacugugucaaccaagagaagccagcaggcuguaaucccaaauauagggaguaggucucggauucgcaacauccccuccagaauuagcaucuacuggacaaucguuaaaccuggagauauucugcuaauaaauucgaccgguaaccucaucgccccaaggggcuacuucaagauucggucugggaaauccucaaucaugcgcagugacgcgccgauaggaaaguguaauagcgaaugcauuacgcccaacggcuccaucccuaaugacaagccauuucagaacgugaaucgaaucacuuauggugcaugucccagauacgucaaacaaucuacacugaaacuugccaccgggaugaggaacgugccugagaagcagacucggggaauuuucggcgcuaucgccggcuuuauugaaaaugggugggagggaaugguggaugguugguauggcuuccgucaccagaacagcgaggggcgcggacaagcagcugaccugaagucaacacaggccgcgauagaucagaucaauggcaaauugaacagacucauugguaagaccaaugaaaaauuccaccagaucgagaaggaauuuagugaggucgaagggaggauccaagaccuggagaaguacguugaggauacgaaaauugacuuaugguccuauaacgccgaacugcucguggcacuugagaaccagcauaccauagaucugacagacagcgaaaugaauaaguuguucgagaaaacuaagaaacagcuacgggaaaacgcugaggauaugggcaauggaugcuuuaagaucuaccacaagugugacaacgccugcauuggcucuauccgaaaugggaccuauaaccaugauguauaccgcgacgaggcucugaauaacagauuccagauuaaaggaguggaacucaagucagguuacaaagacuggauccuguggauaaguuuugccaucagcugcuuccuucugugugucgcauugcucggcuuuauuaugugggccugccaaaaggggaauaucagguguaacauuugcaucuga

SEQ ID NO: 134595 - RNA, 1701 nt, Artificial Sequence; identical to SEQ ID NO: 131090
  derived and/or modified sequence opt3 from hemagglutinin__InfluenzaA__AIJ29357

SEQ ID NO: 134596 - RNA, 1701 nt, Artificial Sequence
  derived and/or modified sequence opt3 from hemagglutinin__InfluenzaA__AIJ29359
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauaacuccuuuuucucacgucugaauuggcucacgcauuuaaacuuuaaguauccagcacugaacgugacuaugcccaauaacgagcaguucgacaaacuuuacaucuggggaguccaccauccuggcaccgauaaagaccagaucuuuuuguaugcccagaguagcggcagaauuacagugucuacuaagaggucccaacaggcuguaauaccaaauauugggucacggccccgcaucagaaacauuccuagcaggaucaguaucuacuggaccauuguuaaaccaggagauauacugcuaaucaauucuacagguaaccucauugccccgcggggcuacuucaagauccgcuccgggaaaagcucgauaaugcgaucugacgcgcccauuggaaaguguaaguccgaaugcaucaccccuaauggcucaaucccaaacgacaaacccuuucagaaugugaacagaauuacguauggugcauguccuagguacgucaagcagaguacucugaaacuugccacagggaugcggaaugugccagagaagcaaacccguggaaucuucggcgcuauugccggcuuuauagaaaacgggugggagggaaugguggaugguugguauggcuuccgccaccagaauagcgaggggagaggacaggcagcugaccugaaauccacucaagccgcgaucgaucagauuaacggcaaguugaauaggcucaucgguaaaacaaacgaaaaguuccaccagaucgagaaggaauuuucugaggucgaagggcggauucaggaccuggagaaauacguugaggauaccaagauagacuuauggagcuauaacgccgaacugcucguggcacuugagaaucaacauacgaucgaucugaccgacucagaaaugaacaaauuguucgagaagacaaagaagcagcuacgagaaaaugcugaggauaugggcaacggaugcuuuaagauuuaccacaaaugugacaaugccugcaucggcaguauucgcaacgggacuuaugaucaugacguauacagagacgaggcuaucaauaacagguuccagauaaagggaguggaacugaaauccgguuacaaggauuggauccucuggauuagcuuugccaucucuugcuuccugcuuugugucgcacuguugggcuuuauuaugugggccugccagaaagggaauauccgguguaacauaugcauuuga

SEQ ID NO: 134597 - RNA, 1701 nt, Artificial Sequence
  derived and/or modified sequence opt3 from hemagglutinin__InfluenzaA__AIJ29361
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgugucuuugcggucgcucguugcaucaagcggcacccuggaauuuaauaacgagaguuucaauuggacuggugugacacaaaacgggaccuccucugccugcauucgccgaagcaauaacuccuuuuucucacgucugaauuggcucacgcauuuaaacuuuaaguauccagcucugaacgucacuaugcccaauaacgagcaguucgacaaacuuuacaucuggggagugcaccauccuggcaccgauaaagaccagaucuuuuuguaugcacagaguagcggcagaauuacaguaucuacuaagaggucccaacaggccguuauaccaaauauugggucacggccccgcaucagaaacauuccuagcaggaucaguaucuacuggaccauugugaaaccaggagauauacugcuaaucaauucuacagguaaccucauugcuccgcggggcuacuucaagauccgcuccgggaaaagcucgauaaugcgaucugacgcccccauuggaaaguguaaguccgaaugcaucaccccuaauggcucaaucccaaacgacaaacccuuucagaaugucaacagaauuacguauggugcguguccuagguacgugaagcagaguacucugaaacuugcaacagggaugcggaaugugccagagaagcaaacccguggaaucuucggcgccauugcuggcuuuauagaaaacgggugggagggaauggucgaugguugguauggcuuccgccaccagaauagcgaggggagaggacaggccgcagaccugaaauccacucaagcugccaucgaucagauuaacggcaaguugaauaggcucaucgguaaaacaaacgaaaaguuccaccagaucgagaaggaauuuucugagguugaagggcggauucaggaccuggagaaauacguggaggauaccaagauagacuuauggagcuauaacgcggaacugcucguagcccuugagaaucaacauacgaucgaucugaccgacucagaaaugaacaaauuguucgagaagacaaagaagcagcuacgagaaaaugcagaggauaugggcaacggaugcuuuaagauuuaccacaaaugugacaaugcuugcaucggcaguauucgcaacgggacuuaugaucaugacguguacagagacgaggcccugaauaacagguuccagaucaagggagucgaacucaaauccgguuacaaggauuggauacuguggaucagcuuugcuauuucuugcuuccuucuguguguggccuugcucggcuuuaucaugugggcaugccagaaagggaauauucgguguaacaucugcauauga

SEQ ID NO: 134598 - RNA, 1701 nt, Artificial Sequence; identical to SEQ ID NO: 132056
  derived and/or modified sequence opt3 from hemagglutinin__InfluenzaA__AIL93623

SEQ ID NO: 134599 - RNA, 1701 nt, Artificial Sequence
  derived and/or modified sequence opt3 from hemagglutinin__InfluenzaA__AIL93634
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccucaaaagcacccagaaugcuauugauaagaucacaaacaaaguuaauuccgugauagagaagaugaacacucaguuuaccgccguggguaaagaguucaaucaccuggagaagcggauugaaaacuuaaauaagaaagucgacgauggguuccuggacaucuggacauacaacgcugagcuccuugugcuguuggaaaaugagcgcacucuagauuaucaugacucuaacguaaagaaccuguacgagaaaguucgaaaucaacucaagaacaaugccaaagaaaucggcaacggauguuuugaguucuaucacaagugcaauaacaccuguauggaaagcgugaagaauggcacauacgauuauccuaaauacucagaggaagcaaagcugaacagagagaaaauugacggggucaaacuugagaguaccaggaucuaucagauucuggccauauacuccacuguggcuagcucuuugguccucgugguuucacugggagcgaucaguuuuuggaugugcagcaaugguuccuuacagugccggauuuguaucuga

SEQ ID NO: 134600 - RNA, 1701 nt, Artificial Sequence
  derived and/or modified sequence opt3 from hemagglutinin__InfluenzaA__AIL93645
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuucguuauccagcccugaacgugacgaugcccaacaaugagcaguucgacaaguuguacaucuggggcguccaccauccuggcacugauaaggaccagauuuuucuuuaugcucagagcucugggagaaucaccguguccacaaaaaggucacaacaggccguaauaccaaacauuggaagccggccccgcaucagaaauauuccuaguaggaucucuaucuacuggacuauuguuaagccaggugauauacugcuaaucaacuccaccggcaaucucauugcgccgcggggguacuucaaaauccgcagcggaaagucgucuauaaugcgauccgacgcacccauuggcaaauguaagucagaaugcaucacaccuaacgguaguaucccaaaugacaagcccuuucagaacgugaauagaauuaccuauggggccuguccuagguacgucaaacagagcacgcugaaacuugcuacuggaaugcggaacgugccagagaagcaaacacguggcaucuucggcgccauugcaggguuuauagaaaauggaugggaggguaugguggauggcugguauggguuccgccaccagaacuccgagggaagaggccaggcugccgaccugaagucuacccaagcggccaucgaucagauuaaugguaaauugaacaggcucaucgggaagacuaaugaaaaauuccaccagaucgagaaggaauuuagcgaggucgaaggccggauucaggaccuggagaaguacguugaggauacaaaaauagacuuauggucauauaacgcagaacugcucguggcucuugagaaccaacauaccaucgaucugacggacagugaaaugaauaaguuguucgagaaaaccaagaaacagcuacgagaaaacgccgaggauaugggaaauggcugcuuuaagauuuaccacaagugugacaacgcuugcaucggguccauucgcaauggaacauaugaucaugacguauacagagacgaggcccugaacaauagguuccagaucaaagguguggaacucaagagcggcuacaaagauuggauacuguggaucucuuuugcaauuucaugcuuccuucugugugucgccuugcucggguuuaucaugugggcuugccagaagggaaacauucgguguaauaucugcauauga

SEQ ID NO: 134601 - RNA, 1701 nt, Artificial Sequence; identical to SEQ ID NO: 132010
  derived and/or modified sequence opt3 from hemagglutinin__InfluenzaA__AIL93657

SEQ ID NO: 134602 - RNA, 1701 nt, Artificial Sequence; identical to SEQ ID NO: 132010
  derived and/or modified sequence opt3 from hemagglutinin__InfluenzaA__AIL93669

SEQ ID NO: 134603 - RNA, 1701 nt, Artificial Sequence
  derived and/or modified sequence opt3 from hemagglutinin__InfluenzaA__AIL93681
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacgguccgccgggagcggaaucauaauuucggacaccccagugcaugauugcaauacgacuugucagacaccggagggcgcaaucaacaccucucuccccuuccagaauauucacccuaucacuaucgguaagugcccaaaauauguaaaguccacaaagcugcgccuugcuaccgggcugagaaacgugcccucaauucagaguaggggauuguuuggcgccauagcgggcuucaucgaagggggauggacggguauggucgacggcugguacggguaucaucaccaaaaugagcagggaagcggcuacgccgcagaccucaaauccacccagaacgcuauugauaagaucacaaauaaagugaacucuguuauagagaagaugaauacucaguuuaccgccguggguaaagaguucaaccaccuggagaagcggauugaaaauuuaaacaagaaagucgacgauggguuccuggacaucuggacauacaaugcugagcuccuugugcuguuggaaaacgagcgcacucuagauuaucaugacagcaauguaaagaaccuguacgagaaaguucgaaaccaacucaagaauaacgccaaagaaaucggcaauggauguuuugaguucuaucacaagugcgauaacaccuguauggaaucagugaagaauggcacauacgacuauccuaaauacagugaggaagcaaagcugaacagagagaaaauugauggggucaaacuugaguccaccaggaucuaucagauucuggccauauacagcacuguggcuucuucauugguccucgugguuagucugggagcgaucagcuuuuggaugugcuccaaugguucuuuacagugccggauuuguaucuga

SEQ ID NO: 134604 - RNA, 1701 nt, Artificial Sequence; identical to SEQ ID NO: 134600
  derived and/or modified sequence opt3 from hemagglutinin__InfluenzaA__AIL93692

SEQ ID NO: 134605 - RNA, 1701 nt, Artificial Sequence; identical to SEQ ID NO: 134600
  derived and/or modified sequence opt3 from hemagglutinin__InfluenzaA__AIL93716

SEQ ID NO: 134606 - RNA, 1701 nt, Artificial Sequence; identical to SEQ ID NO: 132010
  derived and/or modified sequence opt3 from hemagglutinin__InfluenzaA__AIL93728

SEQ ID NO: 134607 - RNA, 1701 nt, Artificial Sequence; identical to SEQ ID NO: 132010
  derived and/or modified sequence opt3 from hemagglutinin__InfluenzaA__AIL93740

SEQ ID NO: 134608 - RNA, 1701 nt, Artificial Sequence
  derived and/or modified sequence opt3 from hemagglutinin__InfluenzaA__AIL93752
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaggccacaccagauacuagauggcgaaaacuguacacucaucgacgcucugcuuggggauccgcagugcgacggauuucagaauaaaaagugggaucuguucguggagcggaguaaagccuauagcaacuguuaccccuaugacgucccugauuacgcauccuugcgcucucucguggccucgucaggcacccuggaauuuaauaacgagagcuucaauugggcugguguuacucaaaacgggacaaguuccgcaugcauucgaggaucuaauagcuccuuuuucucacgucugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagaguagcgggagaaucaccgugucuacaaagaaaucccaacaggccguaauaccaaacauuggaucaaggccccggauccgcaauauuccuagcagaaucaguaucuacuggacuauuguuaagccaggugauauacugcuaaucaacucuaccggcaaucucauugcgccgaggggguacuucaaaauccgguccggaaagagcucgauaaugcgcucugacgcacccauuggcaaguguaaauccgaaugcaucacaccuaacgguucaaucccaaaugacaagcccuuucagaacgugaaucgaauuaccuauggggccuguccuagauacgucaaacagaguacgcugaaacuugcuacuggaaugaggaacgugccagagaagcaaacacggggcaucuucggcgccauugcaggguuuauagaaaauggaugggaggguaugguggauggcugguauggguuccgucaccagaacagcgagggacgcggccaggcugccgaccugaaguccacccaagcggccaucgaucagauuaaugguaaauugaacagacucaucgggaagacuaaugaaaaguuccaccagaucgagaaagaauuuucugaggucgaaggcaggauucaggaccuggagaaguacguugaggauacaaaaauagacuuauggagcuauaacgcagaacugcucguggcucuugagaaccaacauaccaucgaucugacggacucagaaaugaauaaguuguucgagaaaaccaagaagcagcuacgggaaaacgccgaggauaugggaaauggcugcuuuaaaauuuaccacaagugugacaacgcuugcaucgggaguauucgaaauggaacauaugaucaugacguauaccgcgacgaggcccugaacaauagauuccagaucaaagguguggaacucaaguccggcuacaaagauuggauacuguggaucagcuuugcaauuucuugcuuccuucugugugucgccuugcucggguuuaucaugugggcuugccagaagggaaacauuagguguaauaucugcauauga

SEQ ID NO: 134609 - RNA, 1701 nt, Artificial Sequence
  derived and/or modified sequence opt3 from hemagglutinin__InfluenzaA__AIL93764
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugauagaaucgaggugaccaacgccacagaacugguacaaaauucuucaauuggugagaucugcgacaguccacaccagauacuagauggcgaaaacuguacccucaucgacgcgcugcuuggggauccgcagugcgacggauuucagaauaaaaagugggaucuguucguggagaggagcaaggcuuauuccaacuguuaccccuaugacgucccugauuacgccucuuugcggucgcucguggcaucaagcggcacucuggaauuuaauaacgagaguuucaauugggccgguguuacacaaaacgggaccuccucugcuugcauucgcggaagcaauuccucauuuuucagucgacugaacuggcucacgcauuuaaauuuuaaguauccagcacugaacgugacuaugcccaacaaugagcaguucgacaaacuuuacaucuggggcguccaccauccuggcaccgauaaagaccagaucuuuuuguaugcccagagcucugggcguauuacaguguccacuaagagaucacaacaggcuguaauaccaaacauuggaagcaggccccggauccgcaauauuccuaguagaaucucuaucuacuggaccauuguuaaaccaggugauauacugcuaaucaacuccacaggcaaucucauugccccgaggggguacuucaagauccggagcggaaaaucgucuauaaugcgcuccgacgcgcccauuggcaaguguaagucagaaugcaucaccccuaacgguaguaucccaaaugacaaacccuuucagaacgugaaucgaauuacguauggggcauguccuagauacgucaagcagagcacucugaaacuugccacaggaaugaggaacgugccagagaagcaaacccggggcaucuucggcgcuauugccggguuuauagaaaauggaugggaggguaugguggauggcugguauggguuccgucaccagaacuccgagggacgcggccaggcagcugaccugaaaucuacucaagccgcgaucgaucagauuaaugguaaguugaacagacucaucgggaaaacaaaugaaaaguuccaccagaucgagaaggaauuuagcgaggucgaaggcaggauucaggaccuggagaaauacguugaggauaccaagauagacuuauggucauauaacgccgaacugcucguggcacuugagaaccaacauacgaucgaucugaccgacagugaaaugaauaaauuguucgagaagacuaaaaagcagcuacgggaaaacgcugaggauaugggaaauggcugcuuuaagauuuaccacaaaugugacaacgccugcaucggguccauucgaaaugagacauaugaucaugacguauaccgcgacgaagcucugaacaauagauuccagaucaagggaguggagcucaaaagcgguuacaaggauuggauacuguggaucucuuuugccauuucaugcuuccuucugugugucgcauugcucggcuuuaucaugugggccugccagaaagggaacauuagguguaauaucugcauauga

SEQ ID NO: 134610 - RNA, 1701 nt, Artificial Sequence; identical to SEQ ID NO: 132010
  derived and/or modified sequence opt3 from hemagglutinin__InfluenzaA__AIL93776

SEQ ID NO: 134611 - RNA, 1701 nt, Artificial Sequence; identical to SEQ ID NO: 132010
  derived and/or modified sequence opt3 from hemagglutinin__InfluenzaA__AIL93788

SEQ ID NO: 134612 - RNA, 1701 nt, Artificial Sequence; identical to SEQ ID NO: 132010
  derived and/or modified sequence opt3 from hemagglutinin__InfluenzaA__AIL93812

SEQ ID NO: 134613 - RNA, 1701 nt, Artificial Sequence; identical to SEQ ID NO: 132010
  derived and/or modified sequence opt3 from hemagglutinin__InfluenzaA__AIL93824

SEQ ID NO: 134614 - RNA, 1701 nt, Artificial Sequence; identical to SEQ ID NO: 134603
  derived and/or modified sequence opt3 from hemagglutinin__InfluenzaA__AIL93836

SEQ ID NO: 134615 - RNA, 1701 nt, Artificial Sequence
  derived and/or modified sequence opt3 from hemagglutinin__InfluenzaA__AIL93847
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacgguccgccgggagcggaaucauaauuucggacaccccagugcaugauugcaauacgacuugucagacaccggagggcgcaaucaacaccucucuccccuuccagaauauucacccuaucacuaucgguaagugcccaaaauauguaaaguccacaaagcugcgccuugcuaccgggcugagaaacgugcccucaauucagaguaggggauuguuuggcgccauagcgggcuucaucgaagggggauggacggguauggucgacggcugguacggguaucaucaccaaaaugagcagggaagcggcuacgccgcagaccucaaauccacccagaacgcuauugauaagaucacaaauaaagugaacucuguuauagagaagaugaauacucaguuuaccgccguggguaaagaguucaaccaccuggagaagcggauugaaaauuuaaacaagaaagucgacgauggguuccuggacaucuggacauacaaugcugagcuccuugugcuguuggaaaacgagcgcacucuagauuaucaugacagcaauguaaagaaccuguacgagaaaguucgaaaccaacucaagaauaacgccaaagaaaucggcaauggauguuuugaguucuaucacaagugcgauaacaccuguauggaaucagugaagaauggcacauacgacuauccuaaauacagugaggaagcaaagcugaacagagagaaaauugauggggucaaacuugaguccaccaggaucuaucagauucuggccauauacagcacuguggcuucuucauugguccucgugguuagucugggagcgaucugcuuuuggaugugcagcaaugguuccuuacagugucggauuugcaucuga

SEQ ID NO: 134616 - RNA, 1701 nt, Artificial Sequence; identical to SEQ ID NO: 134600
  derived and/or modified sequence opt3 from hemagglutinin__InfluenzaA__AIL93858

SEQ ID NO: 134617 - RNA, 1701 nt, Artificial Sequence; identical to SEQ ID NO: 132010
  derived and/or modified sequence opt3 from hemagglutinin__InfluenzaA__AIL93870

SEQ ID NO: 134618 - RNA, 1701 nt, Artificial Sequence
  derived and/or modified sequence opt3 from hemagglutinin__InfluenzaA__AIL93882
augaagaccaucauugcccugagcuacauacucugccuuguguucgcucagaaacccccuggcaacgacaauuccacagcaacucuguguuuggggcaccaugccgucccaaacggaacgaucguuaagaccauuacaaaugauagaaucgaggugacuaacgcgaccgaauuaguacaaaauucuucaauuggugagaucugcgacaguccgcaccagauacuggauggcgaaaacuguacacuaaucgacgcucuccugggggauccccagugcgacggauuucagaauaaaaagugggaucuuuucguggagaggagcaaagccuauuccaacuguuacccuuaugacgucccagauuacgcaucucugcggucguugguggccucaagcggcacccucgaauuuaauaacgagaguuucaauugggcugguguuacucaaaacgggacauccucugcaugcauucgcggaagcaauuccucauuuuucagucgacugaacuggcugacccaucucaauuuuaaguaucccgccuuaaacgugacgaugccuaacaaugagcaguucgacaagcuguacaucuggggcguccaccauccaggcacugauaaagaccagauuuuucuuuaugcucagagcucugggcguaucaccguguccacaaagagaucacaacaggccguaauacccaacauuggaagcaggccucggauccgcaauauuccaaguagaaucucuaucuacuggacuauuguuaaaccgggugauauauugcugaucaacuccaccggcaaucuaauugcgcccaggggguacuucaagauccggagcggaaaaucgucuauaaugcgcuccgacgcaccuauuggcaaguguaagucagaaugcaucacaccaaacgguaguauccccaaugacaaaccuuuucagaacgugaaucgaauuaccuauggggccuguccaagauacgucaagcagagcacgcucaaacuggcuacuggaaugaggaacgugcccgagaagcaaacacggggcaucuucggcgccauugcaggguuuauagaaaauggaugggaggguaugguggauggcugguauggguuccgucaccagaacuccgagggacgcggccaggcugccgaccuuaaaucuacccaagcggccaucgaucagauuaaugguaagcugaacagauugaucgggaaaacuaaugaaaaguuccaccagaucgagaaggaauuuagcgaggucgaaggcaggauucaggaccucgagaaauacguugaggauacaaagauagaccuguggucauauaacgcagaauuacugguggcucucgagaaccaacauaccaucgaucuuacggacagugaaaugaauaaacuguucgagaagaccaaaaagcaguugcgggaaaacgccgaggauaugggaaauggcugcuuuaagauuuaccacaaaugugacaacgcuugcaucggguccauucgaaauggaacauaugaucaugacguauaccgcgacgaggcccuaaacaauagauuccagaucaaggguguggaacugaaaagcggcuacaaggauuggauacucuggaucucuuuugcaauuucaugcuuccugcuuugugucgcccuguugggguuuaucaugugggcuugccagaaaggaaacauuagguguaauaucugcauauga

SEQ ID NO: 134619 - RNA, 1701 nt, Artificial Sequence; identical to SEQ ID NO: 132010
  derived and/or modified sequence opt3 from hemagglutinin__InfluenzaA__AIL93894

SEQ ID NO: 134620 - RNA, 1701 nt, Artificial Sequence
  derived and/or modified sequence opt3 from hemagglutinin__InfluenzaA__AIL93906
augaaggccauccuggugguccuccuuuacaccuucgcuacagcaaacgccgacacucugugcauuggcuaucacgcgaauaacagcacggauaccguugacacaguguuggagaagaauguaacugugacccauuccauaaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauuaauuacgaagaacucagggagcagcugagcaguguuuccucuuucgaacgguuugagauguucccgaagacaagcuccuggcccaaccacgacucaaauaagggugugaccgccgcuuguccucaugcaggggccaaaaguuuuuauaagaaccugaucuggcucgucaaaaagggaaauagcuacccaaaauuaucuaaguccuauauaaacgauaagggcaaagaagugcugguacuuuggggcauccaccaccccucaacgacugcugaccaacagagcuuguaccagaaugccgaugcguacguuuucguggggaccaguaaguauucuaaaaaguuuaaaccugagauugcaauccgcccaaagguccgagaccaggagggacguaugaacuacuauuggacacugauugaacccggugauaaaaucacuuucgaggccaccggcaaccuaguggugccuagauacgcuuuugccauggaaaggaaugcaggguccggaauaauuaucagcgacacaccaguccaugauugcaacaccacgugucaaacuccggagggcgcuauuaauacaucgcuccccuuccagaacauccacccuaucaccauugguaagugcccaaaguauguuaaaucuacuaagcugcggcuugccacagggcugcgcaaugugcccuccauacagucaagaggauuguuuggcgcgaucgccggcuucauugaagggggauggaccgguaugguagacggcugguacggguaucaucaccagaacgagcaaggaaguggcuacgcagcugaccucaaaagcacgcagaaugccaucgauaagauaaccaacaaagucaauuccgugauugagaagaugaacacacaguuuacugcuguggguaaggaguucaaucaccuggagaaaaggaucgaaaacuuaaauaagaaaguugacgauggguuccuggacaucuggaccuacaacgccgagcuccuugugcuguuggaaaaugagcggacacuagauuaucaugacucuaacgucaagaaccuguacgagaaagugcgcaaucagcucaagaacaaugcaaaggaaauuggcaacggauguuuugaguucuaucacaaaugcgauaauacuuguauggaaagcguaaagaacggcaccuacgacuauccuaaauacucagaggaagccaagcugaaucgagagaaaaucgaugggguuaaacuugagaguacaagaauuuaucaaauacuggcuaucuacuccaccguggcgagcucuuugguccucguggucucacugggagcaauuaguuuuuggaugugcagcaacgguuccuuacagugcaggaucuguaucuga

SEQ ID NO: 134621 - RNA, 1701 nt, Artificial Sequence
  derived and/or modified sequence opt3 from hemagglutinin__InfluenzaA__AIL93917
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaggccacaccagauacuagauggcgaaaacuguacacucaucgacgcucugcuuggggauccgcagugcgacggauuucagaauaaaaagugggaucuguucguggagcggaguaaagccuauagcaacuguuaccccuaugacgucccugauuacgcauccuugcgcucucucguggccucgucaggcacccuggaauuuaauaacgagagcuucaauugggcugguguuacucaaaacgggacaaguuccgcaugcauucgaggaucuaauagcuccuuuuucucacgucugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagaguagcgggagaaucaccgugucuacaaagaggucccaacaggccguaauaccaaacauuggaucacggccccgcaucagaaauauuccuagcaggaucaguaucuacuggacuauuguuaaaccaggugauauacugcuaaucaacucuaccggcaaucucauugcgccgcggggguacuucaagauccgcuccggaaaaagcucgauaaugcgaucugacgcacccauuggcaaguguaaguccgaaugcaucacaccuaacgguucaaucccaaaugacaaacccuuucagaacgugaauagaauuaccuauggggccuguccuagguacgucaagcagaguacgcugaaacuugcuacuggaaugcggaacgugccagagaagcaaacacguggcaucuucggcgccauugcaggguuuauagaaaauggaugggaggguaugguggauggcugguauggguuccgccaccagaacagcgagggaagaggccaggcugccgaccugaaauccacccaagcggccaucgaucagauuaaugguaaguugaacaggcucaucgggaaaacuaaugaaaaguuccaccagaucgagaaggaauuuucugaggucgaaggccggauucaggaccuggagaaauacguugaggauacaaagauagacuuauggagcuauaacgcagaacugcucguggcucuugagaaccaacauaccaucgaucugacggacucagaaaugaauaaauuguucgagaagaccaaaaagcagaugcgagaaaacgccgaggauaugggaaauggcugcuuuaagauuuaccacaaaugugacaacgcuugcaucgggaguauucgcaauggaacauaugaucaugacguauacagagacgaggcccuaaacaauagguuccagaucaaggguguggaacugaaauccggcuacaaggauuggauacucuggaucagcuuugcaauuucuugcuuccugcuuugugucgcccuguugggguuuaucaugugggcuugccagaaaggaaacauucgguguaauaucugcauauga

SEQ ID NO: 134622 - RNA, 1701 nt, Artificial Sequence; identical to SEQ ID NO: 132056
  derived and/or modified sequence opt3 from hemagglutinin__InfluenzaA__AIL93929

SEQ ID NO: 134623 - RNA, 1701 nt, Artificial Sequence
  derived and/or modified sequence opt3 from hemagglutinin__InfluenzaA__AIL93940
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggagugucuccccugcaucuugguaaaugcaacauagcuggcuggauccuggggaauccugagugugaaucauugaguacagccagcuccuggucuuacauuguugagaccucgucaagcgacaacggaacuugcuauccaggcgauuuuaucaauuacgaagaacucagggagcagcugaguuccgugucuagcuucgaacgguuugagauuuucccgaagacauccucauggcccaaccacgacaguaauaagggugucaccgcagccuguccucaugcuggggcaaagagcuuuuauaagaaccugaucuggcucgugaaaaagggaaauucuuacccaaaauuaucccaaucauauauaaacgauaagggcaaggaaguacugguucuuuggggcauccaccaccccagcacgacugccgaccagcagaguuuguaccagaaugcugaugccuacguguucgucgggaccucucgcuauuccaaaaaguuuaaaccugagauugcgauccgaccaaaggugcgugaccaagagggaagaaugaacuacuauuggacacugguggaacccggugauaaaauuacuuucgaggcaaccggcaaccuagucguuccuagguacgccuuuacaauggaacggaaugcugggagcggaaucauaauuucggacaccccagugcaugauugcaacacgacuugucagacaccggagggcgccaucaauaccucucuccccuuccagaacauucacccuaucacuaucgguaagugcccaaaauauguaaaguccacaaagcugcgccuugcaaccgggcugagaaaugugcccucaauucagaguaggggauuguuuggcgcuauagccggcuucaucgaagggggauggacggguauggucgacggcugguacggguaucaucaccaaaacgagcagggaagcggcuacgcggccgaccucaaauccacccagaaugcaauugauaagaucacaaacaaaguuaauucugugauagagaagaugaacacucaguuuaccgcuguggguaaagaguucaaucaccuggagaagcggauugaaaacuuaaauaagaaagucgacgauggguuccuggacaucuggacauacaacgccgagcuccuugugcuguuggaaaaugagcgcacucuagauuaucaugacagcaacguaaagaaccuguacgagaaaguucgaaaucaacucaagaacaaugcuaaagaaaucggcaacggauguuuugaguucuaucacaagugcgauaauaccuguauggaaucagugaagaacggcacauacgacuauccuaaauacagugaggaagccaagcugaauagagagaaaauugauggggucaaacuugaguccaccaggaucuaucagauucuggcaauauacagcacuguggccucuucauugguccucgugguuagucugggagcuaucagcuuuuggaugugcuccaacgguucuuuacagugccggauuuguaucuga

SEQ ID NO: 134624 - RNA, 1701 nt, Artificial Sequence; identical to SEQ ID NO: 132010
  derived and/or modified sequence opt3 from hemagglutinin__InfluenzaA__AIL93951

SEQ ID NO: 134625 - RNA, 1701 nt, Artificial Sequence; identical to SEQ ID NO: 132010
  derived and/or modified sequence opt3 from hemagglutinin__InfluenzaA__AIL93963

SEQ ID NO: 134626 - RNA, 1701 nt, Artificial Sequence; identical to SEQ ID NO: 131874
  derived and/or modified sequence opt3 from hemagglutinin__InfluenzaA__AIL93975

SEQ ID NO: 134627 - RNA, 1701 nt, Artificial Sequence; identical to SEQ ID NO: 134603
  derived and/or modified sequence opt3 from hemagglutinin__InfluenzaA__AIL93987

SEQ ID NO: 134628 - RNA, 1701 nt, Artificial Sequence; identical to SEQ ID NO: 132010
  derived and/or modified sequence opt3 from hemagglutinin__InfluenzaA__AIL93998

SEQ ID NO: 134629 - RNA, 1701 nt, Artificial Sequence; identical to SEQ ID NO: 134600
  derived and/or modified sequence opt3 from hemagglutinin__InfluenzaA__AIL94010

SEQ ID NO: 134630 - RNA, 1701 nt, Artificial Sequence; identical to SEQ ID NO: 134600
  derived and/or modified sequence opt3 from hemagglutinin__InfluenzaA__AIL94022

SEQ ID NO: 134631 - RNA, 1701 nt, Artificial Sequence
  derived and/or modified sequence opt3 from hemagglutinin__InfluenzaA__AIL94046
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaggccacaccagauacuagauggcgaaaacuguacacucaucgacgcucugcuuggggauccgcagugcgacggauuucagaauaaaaagugggaucuguucguggagcggaguaaagccuauagcaacuguuaccccuaugacgucccugauuacgcauccuugcgcucucucguggccucgucaggcacccuggaauuuaauaacgagagcuucaauugggcugguguuacucaaaacgggacaaguuccgcaugcauucgaggaucuaauagcuccuuuuucucacgucugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagaguagcgggagaaucaccgugucuacaaagaggucccaacaggccguaauaccaaacauuggaucacggccccgcaucagaaauauuccuagcaggaucaguaucuacuggacuauuguuaaaccaggugauauacugcuaaucaacucuaccggcaaucucauugcgccgcggggguacuucaagauccgcuccggaaaaagcucgauaaugcgaucugacgcacccauuggcaaguguaaguccgaaugcaucacaccuaacgguucaaucccaaaugacaaacccuuucagaacgugaauagaauuaccuauggggccuguccuagguacgucaagcagaguacgcugaaacuugcuacuggaaugcggaacgugccagagaagcaaacacguggcaucuucggcgccauugcaggguuuauagaaaauggaugggaggguaugguggauggcugguauggguuccgccaccagaacagcgagggaagaggccaggcugccgaccugaaauccacccaagcggccaucgaucagauuaaugguaaguugaacaggcucaucgggaaaacuaaugaaaaguuccaccagaucgagaaggaauuuucugaggucgaaggccggauucaggaccuggagaaauacguugaggauacaaagauagacuuauggagcuauaacgcagaacugcucguggcucuugagaaccaacauaccaucgaucugacggacucagaaaugaauaaauuguucgagaagaccaaaaagcagcuacgagaaaacgccgaggauaugggaaauggcugcuuuaagauuuaccacaaaugugacaacgcuugcaucgggaguauucgcaauggaacauaugaucaugacguauacagagacgaggcccugaacaauagguuccagaucaaggguguggaacucaaauccggcuacaaggauuggauacuguggaucagcuuugcaauuucuugcuuccuucugugugucgccuugcucggguuuaucaugugggcuugccagaaaggaaacauucgguguaauaucugcauauga

SEQ ID NO: 134632 - RNA, 1701 nt, Artificial Sequence
  derived and/or modified sequence opt3 from hemagglutinin__InfluenzaA__AIL94058
augaaggccauccuggugguccuccuuuacaccuucgcucccgcaaacgccgacacacugugcauuggcuaucacgcgaauaacagcacugauacgguugacaccguguuggagaagaauguaacagugacucauuccgucaacuuacuggaagauaagcacaaugggaaacuauguaagcucagaggaguggcuccucugcaucuugguaaaugcaacauagccggcuggauccuggggaauccagagugugaaucuuugucaaccgcaaguagcugguccuacauuguugagacaucuucgucagacaacggaaccugcuauccgggcgauuuuaucaauuacgaagaacucagggagcagcugagcaguguguccucuuucgaacgguuugagauuuuccccaagacuagcuccuggccuaaccacgacucaaauaagggugucacagccgcuuguccacaugcaggggccaaaaguuuuuauaagaaccugaucuggcucgugaaaaagggaaauagcuaccccaaauuaucucaauccuauauaaacgauaagggcaaggaaguacugguucuuuggggcauccaccacccuucaaccacggcugaccagcagagcuuguaccagaaugccgaugcguacguguucgucgggaccagucgcuauucuaaaaaguuuaaaccagagauugcaauccgacccaaggugcgugaccaagagggaagaaugaacuacuauuggacucugguggaaccuggugauaaaauuacauucgaggccacuggcaaccuagucguuccaagguacgcuuuuaccaucgaacgguccgccgggagcggaauaauuaucucggacacaccggugcaugauugcaauaccacgugucagacucccgagggcgcaauuaacacaucucucccuuuccagaauauccacccaaucaccauugguaagugccccaaauauguaaaguccacuaagcugcgccuugcuacagggcugagaaacgugccuucaauacagaguaggggauuguuuggcgccaucgcgggcuucauugaagggggauggaccgguauggucgacggcugguacggguaucaucaccaaaaugagcagggaagcggcuacgccgcagaccucaaauccacgcagaacgcuaucgauaagauaaccaauaaagugaacucuguuauugagaagaugaauacacaguuuacugccguggguaaagaguucaaccaccuggagaagcggaucgaaaauuuaaacaagaaagucgacgauggguuccuggacaucuggaccuacaaugcugagcuccuugugcuguuggaaaacgagcgcacacuagauuaucaugacagcaauguaaagaaccuguacgagaaaguucgaaaccaacucaagaauaacgccaaagaaauuggcaauggauguuuugaguucuaucacaagugcgauaacacuuguauggaaucagugaagaauggcaccuacgacuauccaaaauacagugaggaagcaaagcugaacagagagaaaaucgauggggucaaacuugaguccacaaggauuuaucagauacuggccaucuacagcaccguggcuucuucauugguccucgugguuagucugggagcgauuagcuuuuggaugugcuccaaugguucuuuacagugccggaucuguaucuga

SEQ ID NO: 134633 - RNA, 1701 nt, Artificial Sequence; identical to SEQ ID NO: 134603
  derived and/or modified sequence opt3 from hemagglutinin__InfluenzaA__AIL94069

SEQ ID NO: 134634 - RNA, 1701 nt, Artificial Sequence; identical to SEQ ID NO: 132056
  derived and/or modified sequence opt3 from hemagglutinin__InfluenzaA__AIL94080

SEQ ID NO: 134635 - RNA, 1701 nt, Artificial Sequence; identical to SEQ ID NO: 134600
  derived and/or modified sequence opt3 from hemagglutinin__InfluenzaA__AIL94235

SEQ ID NO: 134636 - RNA, 1701 nt, Artificial Sequence; identical to SEQ ID NO: 132056
  derived and/or modified sequence opt3 from hemagglutinin__InfluenzaA__AIL94247

SEQ ID NO: 134637 - RNA, 1701 nt, Artificial Sequence
  derived and/or modified sequence opt3 from hemagglutinin__InfluenzaA__AIL94258
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugauagaaucgaggugaccaacgccacagaacugguacaaaauucuucaauuggugagaucugcgacaguccacaccagauacuagauggcgaaaacuguacccucaucgacgcgcugcuuggggauccgcagugcgacggauuucagaauaaaaagugggaucuguucguggagaggagcaaggcuuauuccaacuguuaccccuaugacgucccugauuacgccucuuugcggucgcucguggcaucaagcggcacucuggaauuuaauaacgagaguuucaauugggccgguguuacacaaaacgggaccuccucugcuugcauucgcggaagcaauuccucauuuuucagucgacugaacuggcucacgcauuuaaauuuuaaguauccagcacugaacgugacuaugcccaacaaugagcaguucgacaaacuuuacaucuggggcguccaccauccuggcaccgauaaagaccagaucuuuuuguaugcccagagcucugggcguauuacaguguccacuaagagaucacaacaggcuguaauaccaaacauuggaagcaggccccggauccgcaauauuccuaguagaaucucuaucuacuggaccauuguuaaaccaggugauauacugcuaaucaacuccacaggcaaucucauugccccgaggggguacuucaagauccggagcggaaaaucgucuauaaugcgcuccgacgcgcccauuggcaaguguaagucagaaugcaucaccccuaacgguaguaucccaaaugacaaacccuuucagaacgugaaucgaauuacguauggggcauguccuagauacgucaagcagagcacucugaaacuugccacaggaaugaggaacgugccagagaagcaaacccggggcaucuucggcgcuauugccggguuuauagaaaauggaugggaggguaugguggauggcugguauggguuccgucaccagaacuccgagggacgcggccaggcagcugaccugaaaucuacucaagccgcgaucgaucagauuaaugguaaguugaacagacucaucgggaaaacaaaugaaaaguuccaccagaucgagaaggaauuuagcgaggucgaaggcaggauucaggaccuggagaaauacguugaggauaccaagauagacuuauggucauauaacgccgaacugcucguggcacuugagaaccaacauacgaucgaucugaccgacagugaaaugaauaaauuguucgagaagacuaaaaagcagcuacgggaaaacgcugaggauaugggaaauggcugcuuuaagauuuaccacaaaugugacaacgccugcaucggguccauucgaaauggaacauaugaucaugacguauaccgcgacgaggcucugaacaauagauuccagaucaaggguguggaacucaaaagcggcuacaaggauuggauacuguggaucucuuuugccauuucaugcuuccuucugugugucgcauugcucggguuuaucaugugggccugccagaaaggaaacauuagguguaauaucugcauauga

SEQ ID NO: 134638 - RNA, 1701 nt, Artificial Sequence
  derived and/or modified sequence opt3 from hemagglutinin__InfluenzaA__AIL94270
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaacucagaaugcaucacaccuaaugguaguaucccaaacgacaagcccuuucagaaugugaaccgaauuaccuauggggccuguccuagauacgucaaacagagcacgcugaaacuugcuacuggaaugaggaaugugccagagaagcaaacacggggcaucuucggcgccauugcaggguuuauagaaaacggaugggaggguaugguggauggcugguauggguuccgucaccaaaauuccgagggacgcggccaggcugccgaccugaagucuacccaggcggccaucgaucagauuaacgguaaauugaauagacucaucgggaagacuaacgaaaaauuccaccagaucgagaaggaauuuagcgaggucgaaggcaggauucaggaccuggagaaguacguugaggauacaaaaauagacuuauggucauauaacgcagaacugcucguggcucuugagaaucaacauaccaucgaucugacggacagugaaaugaacaaguuguucgagaaaaccaagaaacagcuacgggaaaaugccgaggauaugggaaacggcugcuuuaagauuuaccacaagugugacaaugcuugcaucggguccauucgaaacggaacauaugaucaugacguauaccgcgacgaggcccugaauaacagauuccagaucaaagguguggaacucaagagcggcuacaaagauuggauacuguggaucucuuuugcaauuucaugcuuccuucugugugucgccuugcucggguuuaucaugugggcuugccagaagggaaauauuagguguaacaucugcauauga

SEQ ID NO: 134639 - RNA, 1701 nt, Artificial Sequence; identical to SEQ ID NO: 132010
  derived and/or modified sequence opt3 from hemagglutinin__InfluenzaA__AIL94282

SEQ ID NO: 134640 - RNA, 1701 nt, Artificial Sequence; identical to SEQ ID NO: 132010
  derived and/or modified sequence opt3 from hemagglutinin__InfluenzaA__AIL94294

SEQ ID NO: 134641 - RNA, 1701 nt, Artificial Sequence
  derived and/or modified sequence opt3 from hemagglutinin__InfluenzaA__AIL94306
augaagaccaucacagcccugagcuacauucucugccuugcuuucgcacagaaacccccuggcaacgacaauuccacugccacgcuguguuuggggcaccaugcggugccaaacggaaccauagucaagacaaucacuaaugauagaauugagguuaccaacgcuacagaauuagugcaaaauucuucaaucggugagauuugcgacaguccgcaccagauccuggauggcgaaaacuguacccuaauagacgcccuccugggggauccccagugcgacggauuucagaauaaaaagugggaucuuuucguagagaggagcaaagcauauuccaacuguuacccuuaugacgugccagauuacgccucucugcggucguuggucgcuucaagcggcacucucgaauuuaauaacgagaguuucaauugggccggugugacacaaaacgggaccuccucugcaugcauccgcggaagcaauuccucauuuuucagucgacugaacuggcugacgcaucucaauuuuaaguaucccgcuuuaaacguuacuaugccuaacaaugagcaguucgacaagcuguacauuuggggcgugcaccauccaggcaccgauaaagaccagaucuuucuuuaugcccagagcucugggcguauuacagucuccacuaagagaucacaacaggcggugauccccaacauaggaagcaggccucggauucgcaauaucccaaguagaauuucuaucuacuggaccaucguaaaaccgggugauauuuugcugauaaacuccacaggcaaucuaaucgcacccaggggguacuucaagauucggagcggaaaaucgucuaucaugcgcuccgacgccccuauaggcaaguguaagucagaaugcauuaccccaaacgguaguauccccaaugacaaaccuuuucagaacguuaaucgaaucacguauggggcuuguccaagauacgugaagcagagcacucucaaacuggccacaggaaugaggaacguccccgagaagcaaacccggggcauuuucggcgcaaucgcuggguuuauugaaaauggaugggaggguaugguggauggcugguauggguuccgucaccagaacuccgagggacgcggccaggccgcggaccuuaaaucuacucaagccgcaauagaucagaucaaugguaagcugaacagauugauugggaaaacaaaugaaaaguuccaccagaucgagaaggaauuuagcgagguggaaggcaggauccaggaccucgagaaauacgucgaggauaccaagauugaccuguggucauauaacgcugaauuacugguugcccucgagaaccaacauacgauagaucuuaccgacagugaaaugaauaaacuguucgagaagacuaaaaagcaguugcgggaaaacgcugaggauaugggaaauggcugcuuuaagaucuaccacaaaugugacaacgccugcauuggguccauccgaaauggaacauaugaucaugacguguaccgcgacgaggcacuaaacaauagauuccagauuaaggguguagaacugaaaagcggcuacaaggauuggauccucuggauaucuuuugccaucucaugcuuccugcuuuguguggcucuguugggguuuauuaugugggcgugccagaaaggaaacaucagguguaauauuugcaucuga

SEQ ID NO: 134642 - RNA, 1701 nt, Artificial Sequence
  derived and/or modified sequence opt3 from hemagglutinin__InfluenzaA__AIL94318
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccugaacuccgaggggagaggacaggcagcugacuugaaaucuacucaggccgcgaucgaucaaauuaauggcaagcucaacaggcugaucgguaaaacaaaugaaaaguuccaccagaucgagaaggaauuuagcgaggucgaagggcggauucaggacuuagagaaauacguugaggauaccaagauagaccuguggucauauaacgccgaacuccuuguggcacuggagaaccagcauacgaucgauuugaccgacagugaaaugaauaaacuauucgagaagacaaagaagcaacugcgagaaaacgcugaggauaugggcaauggaugcuuuaagauuuaccacaaaugugacaacgccugcaucggcuccauucgcaaugggacuuaugaucauaacguauacagagacgaggcucucaauaacagguuccagaucaagggaguggaacugaaaagcgguuacaaggacuggauacuuuggaucucuuuugccauuucaugcuuccuguugugugucgcacuccugggcuuuaucaugugggccugccagaaagggaauauucgguguaacaucugcauauga

SEQ ID NO: 134643 - RNA, 1701 nt, Artificial Sequence; identical to SEQ ID NO: 131874
  derived and/or modified sequence opt3 from hemagglutinin__InfluenzaA__AIL94330

SEQ ID NO: 134644 - RNA, 1701 nt, Artificial Sequence; identical to SEQ ID NO: 132056
  derived and/or modified sequence opt3 from hemagglutinin__InfluenzaA__AIL94354

SEQ ID NO: 134645 - RNA, 1701 nt, Artificial Sequence; identical to SEQ ID NO: 132010
  derived and/or modified sequence opt3 from hemagglutinin__InfluenzaA__AIL94365

SEQ ID NO: 134646 - RNA, 1701 nt, Artificial Sequence
  derived and/or modified sequence opt3 from hemagglutinin__InfluenzaA__AIL94377
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcauugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucagaacgggacauccucugcaugcauucgcggaagcaauuccucauuuuucagucgacugaacuggcucacccacuuaaauuuuaaguauccagcccugaacgugacgaugcccaacaaugagcaauucgacaaguuguacaucuggggcguccaucacccuggcacugauaaagaccagauuuuucuuuaugcucagagcucugggcguaucaccguguccacaaagagaucacagcaagccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcagacacggggcaucuucggcgccauugcaggguuuauagaaaauggaugggaggguaugguggauggcugguauggguuccgucaccaaaacuccgagggacgcggccaggcugccgaccugaaaucuacccaggcggccaucgaucaaauuaaugguaaguugaacagacucaucgggaaaacuaaugaaaaguuccaucagaucgagaaggaauuuagcgaggucgaaggcaggauucaggaccuggagaaauacguugaggauacaaagauagacuuauggucauauaacgcagaacugcucguggcucuugagaaccagcacaccaucgaucugacggacagugaaaugaauaaauuguucgagaagaccaaaaagcaacuacgggaaaacgccgaggauaugggaaauggcugcuuuaagauuuaccauaaaugugacaacgcuugcaucggguccauucgaaauggaacauaugaucacgacguauaccgcgacgaggcccugaacaauagauuccagaucaaggguguggaacucaaaagcggcuacaaggauuggauacuguggaucucuuuugcaauuucaugcuuccuucugugugucgccuugcucggguuuaucaugugggcuugccagaaaggaaacauuagguguaauaucugcauauga

SEQ ID NO: 134647 - RNA, 1701 nt, Artificial Sequence
  derived and/or modified sequence opt3 from hemagglutinin__InfluenzaA__AIL94389
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccucaaaagcacccagaaugcuauugauaagaucacaaacaaaguuaauuccgugauagagaagaugaacacucaguuuaccgccguggguaaagaguucaaucaccuggagaagcggauugaaaacuuaaauaagaaagucgacgauggguuccuggacaucuggacauacaacgcugagcuccuuauccuguuggaaaaugagcgcacucuagauuaucaugacucuaacgugaagaaccuguacgagaaaguacgaaaucaacucaagaacaaugccaaagaaauuggcaacggauguuuugaguucuaucacaagugcgauaauaccuguauggaaagcguuaagaacggcacauacgacuauccuaaauacucagaggaagcaaagcugaauagagagaaaaucgauggggugaaacuugagaguaccaggauuuaucagauacuggccaucuacuccacugucgcuagcucuuuggugcucgucgugucacugggagcgauuaguuuuuggaugugcagcaacgguuccuuacagugccggaucuguaucuga

SEQ ID NO: 134648 - RNA, 1701 nt, Artificial Sequence; identical to SEQ ID NO: 132010
  derived and/or modified sequence opt3 from hemagglutinin__InfluenzaA__AIL94411

SEQ ID NO: 134649 - RNA, 1701 nt, Artificial Sequence; identical to SEQ ID NO: 132010
  derived and/or modified sequence opt3 from hemagglutinin__InfluenzaA__AIL94423

SEQ ID NO: 134650 - RNA, 1701 nt, Artificial Sequence; identical to SEQ ID NO: 134603
  derived and/or modified sequence opt3 from hemagglutinin__InfluenzaA__AIL94435

SEQ ID NO: 134651 - RNA, 1701 nt, Artificial Sequence; identical to SEQ ID NO: 132010
  derived and/or modified sequence opt3 from hemagglutinin__InfluenzaA__AIL94446

SEQ ID NO: 134652 - RNA, 1701 nt, Artificial Sequence; identical to SEQ ID NO: 132010
  derived and/or modified sequence opt3 from hemagglutinin__InfluenzaA__AIL94458

SEQ ID NO: 134653 - RNA, 1701 nt, Artificial Sequence
  derived and/or modified sequence opt3 from hemagglutinin__InfluenzaA__AIL94470
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagcacaugauugcaacacgacuugucagacaccggagggcgcuaucaauaccucgcuccccuuccagaacauucacccuaucacuaucgguaagugcccaaaauaugugaagucuacaaagcugcgccuugccaccgggcugagaaauguacccuccauucagucaaggggauuguuuggcgcgauagccggcuucaucgaagggggauggacggguaugguggacggcugguacggguaucaucaccaaaacgagcagggaaguggcuacgcagcugaccucaaaagcacccagaaugccauugauaagaucacaaacaaagucaauuccgugauagagaagaugaacacucaguuuaccgcuguugguaaagaguucaaucaccuggagaagcggauugaaaacuuaaauaagaaaguggacgauggguuccuggacaucuggacauacaacgccgagcuccuuguccuguuggaaaaugagcgcacucuagauuaucaugacucuaacgugaagaaccuguacgagaaaguacgaaaucaacucaagaacaaugcaaaagaaaucggcaacggauguuuugaguucuaucacaagugcgauaauaccuguauggaaagcguuaagaacggcacauacgacuauccuaaauacucagaggaagccaagcugaauagagagaaaauugauggggugaaacuugagaguaccaggaucuaucagauucuggcuauauacuccacugucgcgagcucuuuggugcucgucgugucacugggagcaaucaguuuuuggaugugcagcaacgguuccuuacagugccggauuuguaucuga

SEQ ID NO: 134654 - RNA, 1701 nt, Artificial Sequence
  derived and/or modified sequence opt3 from hemagglutinin__InfluenzaA__AIL94481
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggauucaggaccuggagaaauacguugaggauacaaagauagacuuauggucauauaacgcagaacugcucguggcucuugagaaccaacauaccaucgaucugacggacagugaaaugaauaaauuguucgagaagaccaaaaagcagcuacgggaaaacgccgaggauaugggaaauggcugcuuuaagauuuaccacaaaugugacaacgcuugcaucggguccauucgaaauggaacauaugaucaugacguauaccgcgacgaggcccugaacaauagauuccagaucaaggguguggaacucaaaagcggcuacaaggauuggauaaucuggauuucuuuugcaaucucaugcuuccugcuuugugucgcccuguugggguuuauuaugugggcuugccagaaaggaaacaucagguguaauauaugcauuuga

SEQ ID NO: 134655 - RNA, 1701 nt, Artificial Sequence
  derived and/or modified sequence opt3 from hemagglutinin__InfluenzaA__AIL94493
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaaaagaaugccggguccggaaucauaauuagcgacaccccagugcaugauugcaacacgacuugucagacaccggagggcgcaaucaauaccucguuccccuuucagaacauucacccuaucacuaucgguaaaugcccaaaguauguaaagucuacaaaacuccggcuggcuaccgggcuucgcaaugugcccuccauucagucaagaggacuguucggcgccauagcgggcuuuaucgaagggggauggacggguauggucgacggcugguacggguaucaucaccaaaacgagcagggaaguggcuacgccgcagaccucaagagcacccagaaugcuauugauaaaaucacaaacaagguaaauuccguuauagagaaaaugaacacucaguucaccgccguggguaaggaguucaaucacuuggagaagaggauugaaaaccugaauaaaaaggucgacgauggguuuuuagacaucuggacauacaacgcugagcugcucgugcuucuggaaaaugagcggacuuuggauuaucaugacucuaacgugaaaaaccuauacgagaagguucgcaaucaacugaaaaacaaugccaaggaaaucggcaacggauguuucgaguuuuaucacaagugcgauaauaccuguauggaaagcgugaaaaacggcacauacgacuauccuaaguacucagaggaagcaaaacucaaucgagagaagauugauggggucaaacuggagaguaccagaaucuaucagauucuugccauauacuccacuguggcuagcucucuggucuuggugguuucacucggagcgaucaguuucuggaugugcagcaacgguucccugcagugcaggauuuguaucuga

SEQ ID NO: 134656 - RNA, 1701 nt, Artificial Sequence; identical to SEQ ID NO: 134603
  derived and/or modified sequence opt3 from hemagglutinin__InfluenzaA__AIL94504

SEQ ID NO: 134657 - RNA, 1701 nt, Artificial Sequence; identical to SEQ ID NO: 132010
  derived and/or modified sequence opt3 from hemagglutinin__InfluenzaA__AIL94515

SEQ ID NO: 134658 - RNA, 1701 nt, Artificial Sequence; identical to SEQ ID NO: 132010
  derived and/or modified sequence opt3 from hemagglutinin__InfluenzaA__AIL94527

SEQ ID NO: 134659 - RNA, 1701 nt, Artificial Sequence
  derived and/or modified sequence opt3 from hemagglutinin__InfluenzaA__AIL94539
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagcacaugauugcaacacgacuugucagacaccggagggcgcuaucaauaccucgcuccccuuccagaacauucacccuaucacuaucgguaagugcccaaaauaugugaagucuacaaagcugcgccuugccaccgggcugagaaauguacccuccauucagucaaggggauuguuuggcgcgauagccggcuucaucgaagggggauggacggguaugguggacggcugguacggguaucaucaccaaaacgagcagggaaguggcuacgcagcugaccucaaaagcacccagaaugccauugauaagaucacaaacaaagucaauuccgugauagagaagaugaacacucaguuuaccgcuguugguaaagaguucaaucaccuggagaagcggauugaaaacuuaaauaagaaaguggacgauggguuccuggacaucuggacauacaacgccgagcuccuuguccuguuggaaaaugagcgcacucuagauuaucaugacucuaacgugaagaaccuguacgagaaaguacgaaaucaacucaagaacaaugcaaaagaaguuggcaacggauguuuugaguucuaucacaagugcgauaauaccuguauggaaagcgugaagaacggcacauacgacuauccuaaauacucagaggaagccaagcugaauagagagaaaaucgauggggucaaacuugagaguaccaggauuuaucagauccuggcuauuuacuccacuguggcgagcucuuugguccucgugguuucacugggagcaauaaguuuuuggaugugcagcaacgguuccuuacagugccggaucuguauuuga

SEQ ID NO: 134660 - RNA, 1701 nt, Artificial Sequence; identical to SEQ ID NO: 134603
  derived and/or modified sequence opt3 from hemagglutinin__InfluenzaA__AIL94550

SEQ ID NO: 134661 - RNA, 1701 nt, Artificial Sequence
  derived and/or modified sequence opt3 from hemagglutinin__InfluenzaA__AIL94561
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggauucaggaccuggagaaauacguugaggauacaaagauagacuuauggucauauaacgcagaacugcucguggcucuugagaaccaacauaccaucgaucugacggacagugaaaugaauaaauuguucgagaagaccaaaaagcagcuacgggaaaacgccgaggauaugggaaauggcugcuuuaagauuuaccacaaaugugacaacgcuugcaucggguccauucgaaauggaacauaugaucaugacguauaccgcgacgaggcccugaacaauagauuccagaucaaggguguggaacucaaaagcggcuacaaggauuggauacuguggaucucuuuugcaauuucaugcuuccuucugugugucgccuugcucggguuuaucaugugggcuugccagaggggaaacauucgguguaauaucugcauauga

SEQ ID NO: 134662 - RNA, 1701 nt, Artificial Sequence
  derived and/or modified sequence opt3 from hemagglutinin__InfluenzaA__AIL94573
augaaggccauccuggugguccuccuuuacaccuucgcuacagcaaacgccgacacucugugcauuggcuaucacgcgaauaacagcacggauaccguugacacaguguuggagaagaauguaauagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauuaauuacgaagaacucagggagcagcugagcaguguguccucuuucgaacgguuugagaucuucccgaagacuagcuccuggcccaaccacgacucaaauaagggugucacagccgcuuguccucaugcaggggccaaaaguuuuuauaagaaccugauauggcucgugaaaaagggaaauagcuacccaaaauuaucucaauccuauaucaacgauaagggcaaggaaguacugguucuuuggggcauucaccaccccucaaccacggcugaccagcagagcuuguaccagaaugccgaugcguacguguucgucgggacuucccgcuauucuaaaaaguuuaaaccugagaucgcaauucgaccaaaggugcgugaccaagagggaagaaugaacuacuauuggacccugguggaacccggugauaaaaucacauucgaggccacuggcaaccuagucguuccuagguacgcuuuuaccauggaacggaaugccggguccggaauaauuaucagcgacacaccagugcaugauugcaacaccacgugucagacuccggagggcgcaauuaauacaucgcuccccuuccagaacauccacccuaucaccauugguaagugcccaaaauauguaaagucuacuaagcugcgccuugcuacagggcugagaaaugugcccuccauacagucaaggggauuguuuggcgccaucgcgggcuucauugaagggggauggaccgguauggucgacggcugguacggguaucaucaccaaaacgagcagggaaguggcuacgccgcagaccucaaaagcacgcagaaugcuaucgauaagauaaccaacaaagugaauaguguuauugagaagaugaacacacaguuuacugccguggguaaagaguucaaucaccuggagaagcggaucgaaaacuuaaauaagaaagucgacgauggguuccuggacaucuggaccuacaacgcugagcuccuugugcuguuggaaaaugagcgcacacuagauuaucaugacucuaacguaaagaaccuguacgagaaaguucgaaaucaacucaagaacaaugccaaagaaauuggcaacggauguuuugaguucuaucacaagugcgauaauacuuguauggaaagcgugaagaacggcaccuacgacuauccuaaauacucagaggaagcaaagcugaauagagagaaaaucgauggggucaaacuugagaguacaaggguguaucagauucuggccauauacuccaccgucgcuagcucuuuggugcucguugugucacugggagcgaucaguuuuuggaugugcagcaacgguuccuuacagugccggauuuguaucuga

SEQ ID NO: 134663 - RNA, 1701 nt, Artificial Sequence
  derived and/or modified sequence opt3 from hemagglutinin__InfluenzaA__AIL94584
augaaggccauccuggugguccuccuuuacaccuucgcuacagcaaacgccgacacucugugcauuggcuaucacgcgaauaacagcacggauaccguugacacaguguuggagaaaaauauaacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauuaauuacgaagaacucagggagcagcugagcaguguuuccucuuucgaacgguuugagaucuucccgaagacaagcuccuggcccaaccacgacucaaauaagggugugaccgccgcuuguccucaugcaggggccaaaaguuuuuauaagaaccugauauggcucgucaaaaagggaaauagcuacccaaaauuaucucaauccuauaucaacgauaagggcaaggaagugcugguacuuuggggcauucaccaccccucaacgacugcugaccagcagagcuuguaccagaaugccgaugcguacguuuucguggggaccagucgcuauucuaaaaaguuuaaaccugagaucgcaauucgaccaaagguccgugaccaagagggaagaaugaacuacuauuggacacugguggaacccggugauaaaaucacuuucgaggccaccggcaaccuaguggucccuagguacgcuuuuacaauggaacggaaugccggguccggaauaauuaucagcgacaccccaguucaugauugcaacacgacuugucagacaccggagggcgcaauuaauaccucgcuccccuuccagaacauccacccuaucacuauuggucgcugcccaaaguaugugaaaucuacaaagcugagacuugcuaccgggcugaggaauguacccuccauacagucacggggauuguuuggcgccaucgcgggcuucauugaagggggauggacggguaugguggacggcugguacggguaucaucaccaaaacgagcagggaaguggcuacgccgcagaccucaagagcacccagaaugcuaucgauaaaauaacaaacaaggucaauuccgugauugagaaaaugaacacucaguuuaccgccguugguaaggaguucaaucaccuggagaaacgcaucgaaaacuuaaauaagaagguggacgauggguuccuggacaucuggacauacaacgcugagcuccuuguccuguuggaaaaugagcgaacucuagauuaucaugacucuaacgugaaaaaccuguacgagaagguaagaaaucaacucaaaaacaaugccaaggaaauuggcaacggauguuuugaguucuaucacaaaugcgauaauaccuguauggaaagcguuaagaacggcacauacgacuauccuaaguacucagaggaagcaaaacugaauagggagaagaucgauggggugaaacuugagaguacccggauuuaucagauacuggccaucuacuccacugucgcuagcucuuuggugcucgucgugucacugggagcgauuaguuuuuggaugugcagcaacgguuccuuacagugccguaucuguaucuga

SEQ ID NO: 134664 - RNA, 1701 nt, Artificial Sequence; identical to SEQ ID NO: 134071
  derived and/or modified sequence opt3 from hemagglutinin__InfluenzaA__AIL94595

SEQ ID NO: 134665 - RNA, 1701 nt, Artificial Sequence; identical to SEQ ID NO: 132010
  derived and/or modified sequence opt3 from hemagglutinin__InfluenzaA__AIL94606

SEQ ID NO: 134666 - RNA, 1701 nt, Artificial Sequence; identical to SEQ ID NO: 132056
  derived and/or modified sequence opt3 from hemagglutinin__InfluenzaA__AIL94618

SEQ ID NO: 134667 - RNA, 1701 nt, Artificial Sequence; identical to SEQ ID NO: 134603
  derived and/or modified sequence opt3 from hemagglutinin__InfluenzaA__AIL94629

SEQ ID NO: 134668 - RNA, 1701 nt, Artificial Sequence; identical to SEQ ID NO: 132010
  derived and/or modified sequence opt3 from hemagglutinin__InfluenzaA__AIL94640

SEQ ID NO: 134669 - RNA, 1701 nt, Artificial Sequence
  derived and/or modified sequence opt3 from hemagglutinin__InfluenzaA__AIL94652
augaaggccauccuggugguccuccuuuacaccuucgcuacagcaaacgccgacacucugugcauuggcuaucacgcgaauaacagcacggauaccguugacacaguguuggagaagaauguaacugugacccauuccauaaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauuaauuacgaagaacucagggagcagcugagcaguguuuccucuuucgaacgguuugagauguucccgaagacaagcuccuggcccaaccacgacucaaauaagggugugaccgccgcuuguccucaugcaggggccaaaaguuuuuauaagaaccugaucuggcucgucaaaaagggaaauagcuacccaaaauuaucuaaguccuauauaaacgauaagggcaaagaagugcugguacuuuggggcauccaccaccccucaacgacugcugaccaacagagcuuguaccagaaugccgaugcguacguuuucguggggaccaguaaguauucuaaaaaguuuaaaccugagauugcaauccgcccaaagguccgagaccaggagggacguaugaacuacuauuggacacugauugaacccggugauaaaaucacuuucgaggccaccggcaaccuaguggugccuagauacgcuuuugccauggaaaggaaugcaggguccggaauaauuaucagcgacacaccaguccaugauugcaacaccacgugucaaacuccggagggcgcuauuaauacaucgcuccccuuccagaacauccacccuaucaccauugguaagugcccaaaguauguuaaaucuacuaagcugcggcuugccacagggcugcgcaaugugcccuccauacagucaagaggauuguuuggcgcgaucgccggcuucauugaagggggauggaccgguaugguagacggcugguacggguaucaucaccagaacgagcaaggaaguggcuacgcagcugaccucaaaagcacgcagaaugccaucgauaagauaaccaacaaagucaauuccgugauugagaagaugaacacacaguuuacugcuguggguaaggaguucaaucaccuggagaaaaggaucgaaaacuuaaauaagaaaguugacgauggguuccuggacaucuggaccuacaacgccgagcuccuugugcuguuggaaaaugagcggacacuagauuaucaugacucuaacgucaagaaccuguacgagaaagugcgcaaucagcucaagaacaaugcaaaggaaauuggcaacggauguuuugaguucuaucacaaaugcgauaauacuuguauggaaagcguaaagaacggcaccuacgacuauccuaaauacucagaggaagccaagcuggaucgagagaaaaucgacgggguuaaacuugagaguacaagaauuuaucaaauacuggcuaucuacuccaccguggcgagcucuuugguccucguggucucacugggagcaauuaguuuuuggaugugcagcaaugguuccuuacagugcaggaucuguaucuga

SEQ ID NO: 134670 - RNA, 1701 nt, Artificial Sequence; identical to SEQ ID NO: 132056
  derived and/or modified sequence opt3 from hemagglutinin__InfluenzaA__AIL94663

SEQ ID NO: 134671 - RNA, 1701 nt, Artificial Sequence; identical to SEQ ID NO: 132056
  derived and/or modified sequence opt3 from hemagglutinin__InfluenzaA__AIL94674

SEQ ID NO: 134672 - RNA, 1701 nt, Artificial Sequence; identical to SEQ ID NO: 132010
  derived and/or modified sequence opt3 from hemagglutinin__InfluenzaA__AIL94697

SEQ ID NO: 134673 - RNA, 1701 nt, Artificial Sequence; identical to SEQ ID NO: 132056
  derived and/or modified sequence opt3 from hemagglutinin__InfluenzaA__AIL94709

SEQ ID NO: 134674 - RNA, 1701 nt, Artificial Sequence; identical to SEQ ID NO: 132056
  derived and/or modified sequence opt3 from hemagglutinin__InfluenzaA__AIL94720

SEQ ID NO: 134675 - RNA, 1701 nt, Artificial Sequence; identical to SEQ ID NO: 132010
  derived and/or modified sequence opt3 from hemagglutinin__InfluenzaA__AIL94731

SEQ ID NO: 134676 - RNA, 1701 nt, Artificial Sequence; identical to SEQ ID NO: 134603
  derived and/or modified sequence opt3 from hemagglutinin__InfluenzaA__AIL94743

SEQ ID NO: 134677 - RNA, 1701 nt, Artificial Sequence
  derived and/or modified sequence opt3 from hemagglutinin__InfluenzaA__AIL94754
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccucaaaagcacccagaaugcuauugauaagaucacaaacaaaguuaauuccgugauagagaagaugaacacucaguuuaccgccguggguaaagaguucaaucaccuggagaagcggauugaaaacuuaaauaagaaagucgacgauggguuccuggacaucuggacauacaacgcugagcuccuuauccuguuggaaaaugagcgcacucuagauuaucaugacucuaacgugaagaaccuguacgagaaaguacgaaaucaacucaagaacaaugccaaagaaauuggcaacggauguuuugaguucuaucacaagugcgauaauaccuguauggaaagcgcaaagaacggcacauacgacuauccuaaauacucagaggaagccaagcugaauagagagaaaaucgaugggguuaaacuugagaguaccaggauuuaucagauacuggcuaucuacuccacuguggcgagcucuuugguccucguggucucacugggagcaauuaguuuuuggaugugcagcaacgguuccuuacagugccggaucuguaucuga

SEQ ID NO: 134678 - RNA, 1701 nt, Artificial Sequence; identical to SEQ ID NO: 134631
  derived and/or modified sequence opt3 from hemagglutinin__InfluenzaA__AIL94765

SEQ ID NO: 134679 - RNA, 1701 nt, Artificial Sequence; identical to SEQ ID NO: 132010
  derived and/or modified sequence opt3 from hemagglutinin__InfluenzaA__AIL94777

SEQ ID NO: 134680 - RNA, 1701 nt, Artificial Sequence; identical to SEQ ID NO: 133918
  derived and/or modified sequence opt3 from hemagglutinin__InfluenzaA__AIL94789

SEQ ID NO: 134681 - RNA, 1701 nt, Artificial Sequence; identical to SEQ ID NO: 132056
  derived and/or modified sequence opt3 from hemagglutinin__InfluenzaA__AIL94800

SEQ ID NO: 134682 - RNA, 1701 nt, Artificial Sequence
  derived and/or modified sequence opt3 from hemagglutinin__InfluenzaA__AIL94811
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagaacacucugaaacuugccacagggaugcggaaugugccagagaagcaaacccguggaaucuucggcgcuauugccggcuuuauagaaaacgggugggagggaaugguggaugguugguauggcuuccgccaccagaauagcgaggggagaggacaggcagcugaccugaaauccacucaagccgcgaucgaucagauuaacggcaaguugaauaggcucaucgguaaaacaaacgaaaaguuccaccagaucgagaaggaauuuucugaggucgaagggcggauucaggaccuggagaaauacguugaggauaccaagauagacuuauggagcuauaacgccgaacugcucguggcacuugagaaucaacauacgaucgaucugaccgacucagaaaugaacaaauuguucgagaagacaaagaagcagcuacgagaaaaugcugaggauaugggcaacggaugcuuuaagauuuaccacaaaugugacaaugccugcaucggcaguauucgcaacgggacuuaugaucauaauguauacagagacgaggcucugaacaauagguuccagaucaagggaguggaacucaaauccgguuacaaggacuggauacuguggaucagcuuugccauuucuugcuuccuucugugugucgcauugcucggcuuuaucaugugggccugccagaaagggaacauucgguguaauaucugcauauga

SEQ ID NO: 134683 - RNA, 1701 nt, Artificial Sequence; identical to SEQ ID NO: 131874
  derived and/or modified sequence opt3 from hemagglutinin__InfluenzaA__AIL94823

SEQ ID NO: 134684 - RNA, 1701 nt, Artificial Sequence
  derived and/or modified sequence opt3 from hemagglutinin__InfluenzaA__AIL94835
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauuauucuauuggugagaucugcgacucaccacaccagauacuagauggcgaaaacuguacacucaucgacgcucugcuuggggauccgcagugcgacggauuucagaauaaaaagugggaucuguucguggagaggaguaaagccuacagcaacuguuaucccuacgacgucccugauuaugcauccuugcggucucucguggccucgucaggcacccuggaauuuaauaacgagagcuucaauugggcugguguuacucaaaacgggacaaguuccgcaugcauucgcggaucuaauagcuccuuuuucucacgacugaacuggcucacccauuuaaauuuuaaguacccagcccugaacgugacgaugcccaacaaugagcaguucgacaaguuguauaucuggggcguccaccauccuggcacugauaaagaccagauuuuucuuuacgcucagaguagcgggcguaucaccgugucuacaaagagaucccaacaggccguaauaccaaacauuggaucaaggccccggauccgcaauauuccuagcagaaucaguaucuacuggacuauuguuaaaccaggugauauacugcuaaucaacucuaccggcaaucucauugcgccgaggggguauuucaagauccgguccggaaaaagcucgauaaugcgcucugacgcacccauuggcaaguguaaguccgaaugcaucacaccuaacgguucaaucccaaaugacaaacccuuucagaacgugaaucgaauuaccuacggggccuguccuagauaugucaagcagaguacgcugaaacuugcuacuggaaugaggaacgugccagagaagcaaacacggggcaucuucggcgccauugcaggguuuauagaaaauggaugggaggguaugguggauggcugguacggguuccgucaccagaacagcgagggacgcggccaggcugccgaccugaaauccacccaagcggccaucgaucagauuaaugguaaguugaacagacucaucgggaaaacuaaugaaaaguuccaccagaucgagaaggaauuuucugaggucgaaggcaggauucaggaccuggagaaauauguugaggauacaaagauagacuuauggagcuacaacgcagaacugcucguggcucuugagaaccaacauaccaucgaucugacggacucagaaaugaauaaauuguucgagaagaccaaaaagcagcuacgggaaaacgccgaggauaugggaaauggcugcuuuaagauuuaucacaaaugugacaacgcuugcaucgggaguauucgaaauggaacauacgaucaugacguauaccgcgacgaggcccugaacaauagauuccagaucaaggguguggaacucaaauccggcuauaaggauuggauacuguggaucagcuuugcaauuucuugcuuccuucugugugucgccuugcucggguuuaucaugugggcuugccagaaaggaaacauuagguguaauaucugcauauga

SEQ ID NO: 134685 - RNA, 1701 nt, Artificial Sequence
  derived and/or modified sequence opt3 from hemagglutinin__InfluenzaA__AIL94847
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacgacgagaaauucgauaaacuuuacauuuggggaguccaccauccuggcacagacaacgaucagaucuuuuuguaugcccaggcuagcggccguauuacugugucuaccaagagaucccaacagacaguaaucccaaauauagggucaaggccccggguucgcaacauuccuagcagaaucaguauuuacuggaccaucgugaagccaggagacauccugcuaauuaauucuacggguaaccucauagccccgaggggcuacuucaaaauccgguccggaaagagcucgauuaugcgcucugacgcgcccaucgggaaguguaauuccgaaugcauaacuccuaacggcucaauuccaaaugauaaacccuuucagaacgucaaucgaaucacauauggugcauguccuagauacgugaagcagaacacccugaaacuugccacugggaugaggaaugugccagagaagcaaacacggggaaucuucggcgcuauugccggcuuuaucgaaaacgggugggagggaauggucgacgguugguauggcuuccgucaccagaauagugaggggauuggacaggcagcugaucugaaaagcacccaagccgcgauagaccagaucaacggcaaguugaaucgccucauugguaaaacgaacgaaaaguuccaccagaucgagaaggaauuuuccgagguugaagggagaauccaggaucuggagaaauacguggaggacaccaagauugauuuauggucuuauaacgccgaacugcucguagcacuugagaaucaacauacaauagaccugacugauagcgaaaugaacaaauuguucgagaagaccaaaaagcagcuaagggaaaaugcugaggacaugggcaacggaugcuuuaagaucuaccacaaaugugauaaugccugcauuggcucaauccggaacgggacauaugaccaugacguguaccgagaugaggcucugaauaaccgcuuccagauuaagggagucgaacucaaaagugguuacaaggacuggauccuguggauauccuuugccaucagcugcuuccuucuguguguggcauugcucggcuuuauuaugugggccugccagaaagggaauaucagauguaacauuugcaucuga

SEQ ID NO: 134686 - RNA, 1701 nt, Artificial Sequence; identical to SEQ ID NO: 127549
  derived and/or modified sequence opt3 from hemagglutinin__InfluenzaA__AIL94859

SEQ ID NO: 134687 - RNA, 1701 nt, Artificial Sequence
  derived and/or modified sequence opt3 from hemagglutinin__InfluenzaA__AIL94871
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaauuuuaaguauccagcacugaacgugaccaugcccaacaaugagcaguucgacaaacuuuacauuuggggaguccaccauccuggcacagauaaggaccagaucuuuuuguaugcccaagcuagcggccguauuacugugucuaccaagagaucccagcaggccguaaucccaaacauagggucaaggccccggguucgcaauauuccuagcagaaucaguauuuacuggacaaucgugaaaccaggagauauccugcuaauuaacucuaccgguaaucucauagcgccgaggggcuacuucaagauccgguccgggaaaagcucgauuaugcgcucugacgcacccaucggaaaguguaacuccgaaugcauaacgccuaauggcucaauuccaaacgacaagcccuuucagaaugucaaccgaaucacuuauggugccuguccuagauacgugaaacaaaguacacugaaacuugcuaccgggaugaggaaugugccagagaagcagacucggggaaucuucggcgccauugcaggcuuuaucgaaaacgggugggagggaauggucgaugguugguauggcuuccgucaccagaauagcgaggggcgcggacaagcugccgaccugaaguccacacaggcggccauugaucagauaaacggcaaauugaauagacucaucgguaagaccaacgaaaaauuccaccagauugagaaggaauuuucugagguugaagggaggauccaagaccuggagaaguacguggaggauacgaaaaucgacuuauggagcuauaacgcagaacugcucguagcucuugagaaucagcauaccauugaucugacagacucagaaaugaacaaguuguucgagaaaacuaagaaacagcuacgggaaaaugccgaggauaugggcaacggaugcuuuaccauauaccacaagugugacaaugcuugcaucggcaguauucgaaacgggacauaugaucauaauguguaccgcgacgaggcccugaacaauagauuccagaucaagggaauugaacucaaauccgguuacaaggacuggauccuguggaucagcuuugcaauaucuugcuuccuucugugugucgccuugcucggcuuuauuaugugggcuugccaaaaagggaacaucagguguaauauuugcaucuga

SEQ ID NO: 134688 - RNA, 1701 nt, Artificial Sequence; identical to SEQ ID NO: 134096
  derived and/or modified sequence opt3 from hemagglutinin__InfluenzaA__AIL94883

SEQ ID NO: 134689 - RNA, 1701 nt, Artificial Sequence; identical to SEQ ID NO: 134081
  derived and/or modified sequence opt3 from hemagglutinin__InfluenzaA__AIL94894

SEQ ID NO: 134690 - RNA, 1701 nt, Artificial Sequence; identical to SEQ ID NO: 131874
  derived and/or modified sequence opt3 from hemagglutinin__InfluenzaA__AIL94906

SEQ ID NO: 134691 - RNA, 1701 nt, Artificial Sequence; identical to SEQ ID NO: 132010
  derived and/or modified sequence opt3 from hemagglutinin__InfluenzaA__AIL94918

SEQ ID NO: 134692 - RNA, 1701 nt, Artificial Sequence; identical to SEQ ID NO: 132010
  derived and/or modified sequence opt3 from hemagglutinin__InfluenzaA__AIL94930

SEQ ID NO: 134693 - RNA, 1701 nt, Artificial Sequence; identical to SEQ ID NO: 132010
  derived and/or modified sequence opt3 from hemagglutinin__InfluenzaA__AIL94942

SEQ ID NO: 134694 - RNA, 1701 nt, Artificial Sequence; identical to SEQ ID NO: 132056
  derived and/or modified sequence opt3 from hemagglutinin__InfluenzaA__AIL94954

SEQ ID NO: 134695 - RNA, 1701 nt, Artificial Sequence; identical to SEQ ID NO: 131874
  derived and/or modified sequence opt3 from hemagglutinin__InfluenzaA__AIL94965

SEQ ID NO: 134696 - RNA, 1701 nt, Artificial Sequence
  derived and/or modified sequence opt3 from hemagglutinin__InfluenzaA__AIM55837
augaaggccauccuggugguccuccuuuacaccuucgcuacagcaacugccgacacgcugugcauuggcuaucacgcgaacaauagcaccgauacaguugacacuguguuggagaagaacguaaccgugacacauuccgucaauuuacuggaagauaagcacaacgggaaacuauguaagcucagaggaguggcuccccugcaucuugguaaaugcaauauagccggcuggauccuggggaacccugagugugaaucuuugucaaccgcaaguagcugguccuacauuguugagacuucuucgucagacaauggaacaugcuauccaggcgauuuuaucaacuacgaagaacucagggagcagcugagcaguguguccucuuucgaacgguuugagauuuucccgaagaccagcuccuggcccaaucacgacucaaacaagggugucacggccgcuuguccucaugcaggggccaaaaguuuuuauaagaaucugaucuggcucgugaaaaagggaaacagcuacccaaaauuaucucaauccuauauaaaugauaagggcaaggaaguacugguucuuuggggcauccaccaccccucaacuaccgcugaccagcagagcuuguaccagaacgccgaugcguacguguucgucgggacaagucgcuauucuaaaaaguuuaaaccugagauugcaauccgaccaaaggugcgugaccaagagggaagaaugaauuacuauuggacucugguggaacccggugauaaaauuaccuucgaggccacaggcaaccuagucguuccuagguacgcuuuuaccauggaacggaacgccggguccggaaucauaauuagcgacacgccagugcaugauugcaauacuacaugucagaccccggagggcgcaaucaacacuucgcuccccuuccagaauauucacccuaucacaaucgguaagugcccaaaauauguaaagucuaccaagcugucccuugcuacggggcugcgcaacgugcccucaauucagaguagaggauuguuuggcgccauagcgggcuucaucgaagggggauggaccgguauggucgacggcugguacggguaucaucaccaaaaugagcagggaagcggcuacgccgcagaccucaaauccacacagaacgcuauugauaagaucacuaauaaagugaacucuguuauagagaagaugaauacccaguuuacagccguggguaaagaguucaaccaccuggagaagaggauugaaaauuuaaacaagaaagucgacgauggguuccuggacaucuggacuuacaaugcugagcuccuugugcuguuggaaaacgagcggacccuagauuaucaugacagcaauguaaagaaccuguacgagaaaguucgcaaccaacucaagaauaacgccaaagaaaucggcaauggauguuuugaguucuaucacaagugcgauaacacauguauggaaucagugaagaauggcaccuacgacuauccuaaauacagugaggaagcaaagcugaaccgagagaaaauugauggggucaaacuugaguccacuagaaucuaucagauucuggccauauacagcacgguggcuucuucauugguccucgugguuagucugggagcgaucagcuuuuggaugugcuccaaugguucuuuacagugcaggauuuguaucuga

SEQ ID NO: 134697 - RNA, 1701 nt, Artificial Sequence
  derived and/or modified sequence opt3 from hemagglutinin__InfluenzaA__AIM55848
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaauauucccuccauacagucaaggggauuguuuggcgccaucgcgggcuucauugaagggggauggacggguaugguggacggcugguacggguaucaucaccaaaacgagcagggaaguggcuacgccgcagaccucaaaagcacccagaaugcuaucgauaagauaacaaacaaagucaauuccgugauugagaagaugaacacucaguuuaccgccguugguaaagaguucaaucaccuggagaagcggaucgaaaacuuaaauaagaaaguggacgauggguuccuggacaucuggacauacaacacugagcuccuuguccuguuggaaaaugagcgcacccuagauuaucaugacucuaacgugaagaaccuguacgagaaaguacgaaaucaacucaagaacaaugcuaaagaaauuggcaacggauguuuugaguucuaucacaagugcgauaauacauguauggaaagcguuaagaacggcaccuacgacuauccuaaauacucagaggaagccaagcugaauagagagaaaaucgauggggugaaacuugagaguacuaggauuuaucagauacuggcaaucuacuccacggucgccagcucuuuggugcucgucgugucacugggagcuauuaguuuuuggaugugcagcaacgguuccuuacagugccggaucuguaucuga

SEQ ID NO: 134698 - RNA, 1701 nt, Artificial Sequence; identical to SEQ ID NO: 132056
  derived and/or modified sequence opt3 from hemagglutinin__InfluenzaA__AIM55859

SEQ ID NO: 134699 - RNA, 1701 nt, Artificial Sequence; identical to SEQ ID NO: 132056
  derived and/or modified sequence opt3 from hemagglutinin__InfluenzaA__AIM55870

SEQ ID NO: 134700 - RNA, 1701 nt, Artificial Sequence; identical to SEQ ID NO: 132056
  derived and/or modified sequence opt3 from hemagglutinin__InfluenzaA__AIM55881

SEQ ID NO: 134701 - RNA, 1701 nt, Artificial Sequence; identical to SEQ ID NO: 133918
  derived and/or modified sequence opt3 from hemagglutinin__InfluenzaA__AIM55893

SEQ ID NO: 134702 - RNA, 1701 nt, Artificial Sequence; identical to SEQ ID NO: 133037
  derived and/or modified sequence opt3 from hemagglutinin__InfluenzaA__AIM55904

SEQ ID NO: 134703 - RNA, 1701 nt, Artificial Sequence; identical to SEQ ID NO: 132056
  derived and/or modified sequence opt3 from hemagglutinin__InfluenzaA__AIM55915

SEQ ID NO: 134704 - RNA, 1710 nt, Artificial Sequence
  derived and/or modified sequence opt3 from hemagglutinin__InfluenzaA__AIM55926
augaaggccauccuggugguccuccuuuacaccuucgcuacaacuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaagaacucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuaucucaauccuauauaaacgauaagggcaaggaaguacugguucuuuggggcauccaccaccccucaacuaccgccgaccagcagagcuuguaccagaaugcugaugccuacguguucgucgggacaagucgcuauucuaaaaaguuuaaaccugagauugcgauccgaccaaaggugcgugaccaagagggaagaaugaacuacuauuggacucugguggaacccggugauaaaauuaccuucgaggcaacaggcaaccuagucguuccuagguacgccuuuaccauggaacggaaugcuggguccggaaucauaauuagcgacacgccagugcaugauugcaacacuacaugucagaccccggagggcgccaucaauacuucgcucacaucucugcccuuccagaacauucacccuaucaccaucgguaagugcccaaaauauguaaaguccacgaaacuucgccuggcaaccggguugagaaaugugcccucaauucagaguaggggacucuuuggcgcuauagccggcuucaucgaagggggauggacagguauggucgacggcugguacggguaucaucaccaaaacgagcagggaagcggcuacgcggccgaccugaaguccacucagaaugcaauugauaagaucaccaacaaaguuaauucugugauagagaagaugaacacacaguuuacugcuguggguaaagaguucaaucacuuagagaagcggauugaaaaccugaauaagaaagucgacgauggguuccucgacaucuggaccuacaacgccgagcuucugguguugcuagaaaaugagcgcacacuggauuaucaugacagcaacguaaagaaccucuacgagaaaguucgaaaucaacugaagaacaaugcuaaagaaaucggcaacggauguuuugaguucuaucacaagugcgauaauaccuguauggaaucagugaagaacggcacuuacgacuauccuaaauacagugaggaagccaaacuuaauagagagaagauugauggggucaagcuggaguccacgaggaucuaucagauuuuggcaauauacagcacaguggccucuucacucguccuggugguuaguuuaggagcuaucagcuuuuggaugugcuccaacgguucucugcagugccggauuuguaucuga

SEQ ID NO: 134705 - RNA, 1701 nt, Artificial Sequence; identical to SEQ ID NO: 132056
  derived and/or modified sequence opt3 from hemagglutinin__InfluenzaA__AIM55937

SEQ ID NO: 134706 - RNA, 1701 nt, Artificial Sequence; identical to SEQ ID NO: 133037
  derived and/or modified sequence opt3 from hemagglutinin__InfluenzaA__AIM55948

SEQ ID NO: 134707 - RNA, 1701 nt, Artificial Sequence; identical to SEQ ID NO: 133019
  derived and/or modified sequence opt3 from hemagglutinin__InfluenzaA__AIM55962

SEQ ID NO: 134708 - RNA, 1701 nt, Artificial Sequence; identical to SEQ ID NO: 133037
  derived and/or modified sequence opt3 from hemagglutinin__InfluenzaA__AIM55984

SEQ ID NO: 134709 - RNA, 1701 nt, Artificial Sequence; identical to SEQ ID NO: 133918
  derived and/or modified sequence opt3 from hemagglutinin__InfluenzaA__AIM55995

SEQ ID NO: 134710 - RNA, 1701 nt, Artificial Sequence
  derived and/or modified sequence opt3 from hemagglutinin__InfluenzaA__AIM56017
augaaggccauccuggugguccuccuuuacaccuucgcuacaacuaacgcagacacgcugugcauuggcuaucacgccaauaacagcaccgauacaguugacacuguguuggagaagaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaagaacucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggacacagcuacccaaaauuaucucaauccuauauaaaugauaagggcaaggaaguacugguucuuuggggcauccaccaucccucaacuaccgccgaccagcagagcuuguaccagaacgcugaugccuacguguucgucgggacaagucgcuauucuaaaaaguuuaaaccugagauugcgauccgaccaaaggugcgugaccaagagggaagaaugaauuacuauuggacucugguggaacccggugauaaaauuaccuucgaggcaacaggcaaccuagucguuccuagguacgccuuuaccauggaacggaacgcuggguccggaaucauaauuagcgacacgccagugcacgauugcaauacuacaugucagaccccggagggcgccaucaacacuucgcuccccuuccagaauauucauccuaucacaaucgguaagugcccaaaauauguaaagucuaccaagcugcgccuugcaacggggcugagaaacgugcccuccauucagucaaggggauuguuuggcgcuauagccggcuucaucgaagggggauggaccgguauggucgacggcugguacggguaucaccaccaaaaugagcagggaaguggcuacgcggccgaccucaaaagcacacagaacgcaauugauaagaucacuaauaaagugaacuccguuauagagaagaugaauacccaguuuacagcuguggguaaagaguucaaccaucuggagaagcggauugaaaauuuaaacaagaaagucgacgauggguuccuggacaucuggacuuacaaugccgagcuccuugugcuguuggaaaacgagcgcacccuagauuaucacgacucuaauguaaagaaccuguacgagaaaguucgaaaccaacucaagaauaacgcuaaagaaaucggcaauggauguuuugaguucuaucauaagugcgauaacacauguauggaaagcgugaagaauggcaccuacgacuauccuaaauacucagaggaagccaagcugaacagagagaaaauugauggggucaaacuugagaguacuaggaucuaucagauucuggcaauauacuccacgguggccagcucuuugguccucgugguuucacugggagcuaucaguuuuuggaugugcagcaaugguuccuuacagugccggauuuguaucuga

SEQ ID NO: 134711 - RNA, 1701 nt, Artificial Sequence; identical to SEQ ID NO: 134710
  derived and/or modified sequence opt3 from hemagglutinin__InfluenzaA__AIM56028

SEQ ID NO: 134712 - RNA, 1701 nt, Artificial Sequence
  derived and/or modified sequence opt3 from hemagglutinin__InfluenzaA__AIM56039
augaaggccauccuggugguccuccuuuaccccuucgcuaccgcaaacgccgacacacugugcauuggcuaucacgcgaauaacagcacugauacgguugacaccguguuggagaagaauguaacagugacucauuccgucaacuuacuggaagauaagcacaaugggaaacuauguaagcucagaggaguggcuccucugcaucuugguaaaugcaacauagccggcuggauccuggggaauccagagugugaaucuuugucaaccgcaaguagcugguccuacauuguugaggccucuucgucagacaacggaacaugcuauccgggcgauuuuaucaauuacgaagaacucagggagcagcugagcaguguguccucuuucgaacgguuugagauuuuccccaagaccagcuccuggccuaaccacgacucaaauaagggugucacugcugcauguccacaugccggggcuaaaaguuuuuauaagaaccugaucuggcucgugaaaaagggaaauagcuaccccaaauuaucucaauccuauauaaacgauaagggcaaggaaguacugguucuuuggggcauccaccacccuucaacaaccgccgaccagcagagcuuguaccagaaugcggaugcauacguguucgucgggacgagucgcuauucuaaaaaguuuaaaccagagauugccauccgacccaaggugcgugaccaagagggaagaaugaacuacuauuggacucugguggaaccuggugauaaaauuaccuucgaggcuacaggcaaccuagucguuccaagguacgccuuuacuauggaacggaaugcaggguccggaaucauaauuagcgacaccccggugcaugauugcaacacaaccugucagacgcccgagggcgcuaucaauacuucgcucccuuuccagaacauucacccaaucacaaucgguaagugccccaaauauguaaagucuaccaagcugcgccuugccacugggcugagaaaugugccuuccauucagucaaggggauuguuuggcgcgauagccggcuucaucgaagggggauggacagguauggucgacggcugguacggguaucaucaccaaaacgagcagggaaguggcuacgcagcugaccucaaaagcacccagaaugccauugauaagaucacgaacaaaguuaauuccgugauagagaagaugaacacccaguuuacagcuguggguaaagaguucaaucaccuggagaagcggauugaaaacuuaaauaagaaagucgacgauggguuccuggacaucuggacuuacaacgccgagcuccuugugcuguuggaaaaugagcgcacccuagauuaucaugacucuaacguaaagaaccuguacgagaaaguucgaaaucaacucaagaacaaugcaaaagaaaucggcaacggauguuuugaguucuaucacaagugcgauaauacauguauggaaagcgugaagaacggcacuuacgacuauccaaaauacucagaggaagccaagcugaauagagagaaaauugauggggucaaacuugagaguaccaggaucuaucagauucuggcuauauacuccacaguggcgagcucuuugguccucgugguuucacugggagcaaucaguuuuuggaugugcagcaacgguuccuuacagugccggauuuguaucuga

SEQ ID NO: 134713 - RNA, 1701 nt, Artificial Sequence
  derived and/or modified sequence opt3 from hemagglutinin__InfluenzaA__AIM56050
augaaggccauccuggugguccuccuuuacaccuucgcuacaacuaacgcagacacgcugugcauuggcuaucacgccaauaacagcaccgauacaguugacacuguguuggagaagaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaagaacucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuaucucaauccuauauaaacgauaagggcaaggaaguacugguucuuuggggcauccaccaccccucaacuaccgccgaccagcagagcuuguaccagaaugcugaugccuacguguucgucgggacaagucgcuauucuaaaaaguuuaaaccugagauugcgauccgaccaaaggugcgugaccaagagggaagaaugaacuacuauuggacucugguggaacccggugauaaaauuaccuucgaggcaacaggcaaccuagucguuccuagguacgccuuuaccauggaacggaaugcuggguccggaaucauaauuagcgacacgccagugcaugauugcaacacuacaugucagaccccggagggcgccaucaauacuucgcuccccuuccagaacauucacccuaucacaaucgguaagugcccaaaauauguaaagucuaccaagcugcgccuugcaacggggcugagaaaugugcccuccauucagucaaggggauuguuuggcgcuauagccggcuucaucgaagggggauggaccgguauggucgacggcugguacggguaucaucaccaaaacgagcagggaaguggcuacgcggccgaccucaaaagcacacagaaugcaauugauaagaucacuaacaaaguuaauuccgugauagagaagaugaacacccaguuuacagcuguggguaaagaguucaaucaccuggagaagcggauugaaaacuuaaauaagaaagucgacgauggguuccuggacaucuggacuuacaacgccgagcuccuugugcuguuggaaaaugagcgcacccuagauuaucaugacucuaacguaaagaaccuguacgagaaaguucgaaaucaacucaagaacaaugcuaaagaaaucggcaacggauguuuugaguucuaucacaagugcgauaauacauguauggaaagcgugaagaacggcaccuacgacuauccuaaauacucagaggaagccaagcugaauagagggaaaauugauggagucaaacuugagaguacuaggaucuaucagauucuggcaauauacuccacgguggccagcucuuugguccucgugguuucacugggugcuaucaguuuuuggaugugcagcaacggcuccuuacagugccggauuuguaucuga

SEQ ID NO: 134714 - RNA, 1701 nt, Artificial Sequence; identical to SEQ ID NO: 132056
  derived and/or modified sequence opt3 from hemagglutinin__InfluenzaA__AIM56061

SEQ ID NO: 134715 - RNA, 1701 nt, Artificial Sequence; identical to SEQ ID NO: 132056
  derived and/or modified sequence opt3 from hemagglutinin__InfluenzaA__AIM56072

SEQ ID NO: 134716 - RNA, 1701 nt, Artificial Sequence; identical to SEQ ID NO: 133909
  derived and/or modified sequence opt3 from hemagglutinin__InfluenzaA__AIM56083

SEQ ID NO: 134717 - RNA, 1701 nt, Artificial Sequence; identical to SEQ ID NO: 132056
  derived and/or modified sequence opt3 from hemagglutinin__InfluenzaA__AIM56105

SEQ ID NO: 134718 - RNA, 1701 nt, Artificial Sequence; identical to SEQ ID NO: 132056
  derived and/or modified sequence opt3 from hemagglutinin__InfluenzaA__AIM56116

SEQ ID NO: 134719 - RNA, 1701 nt, Artificial Sequence
  derived and/or modified sequence opt3 from hemagglutinin__InfluenzaA__AIM56127
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaaggccagcuccuggcccaaccacgacucaaauaagggugucacagcugcauguccucaugccggggcuaaaaguuuuuauaagaaccugaucuggcucgugaaaaagggaaauagcuacccaaaauuaucucaauccuauauaaacgauaagggcaaggaaguacugguucuuuggggcauccaccaccccucaaccacggccgaccagcagagcuuguaccagaaugcggaugcauacguguucgucgggaccagucgcuauucuaaaaaguuuaaaccugagauugccauccgaccaaaggugcgugaccaagagggaagaaugaacuacuauuggacucugguggaacccggugauaaaauuacauucgaggcuacuggcaaccuagucguuccuagguacgccuuuaccauggaacggaaugcaggguccggaaucauaauuagcgacacaccagugcaugauugcaacaccacgugucagacuccggagggcgcuaucaauacaucgcuccccuuccagaacauucacccuaucaccaucgguaagugcccaaaauauguaaagucuacuaagcugcgccuugccacagggcugagaaauauucccuccauacagucaaggggauuguuuggcgcgaucgccggcuucauugaagggggauggaccgguaugguggacggcugguacggguaucaucaccaaaacgagcagggaaguggcuacgcagcugaccucaaaagcacgcagaaugccaucgauaagauaaccaacaaagucaauuccgugauugagaagaugaacacacaguuuacugcuguugguaaagaguucaaucaccuggagaagcggaucgaaaacuuaaauaagaaaguggacgauggguuccuggacaucuggaccuacaacgccgagcuccuuguccuguuggaaaaugagcgcacacuagauuaucaugacucuaacgugaagaaccuguacgagaaaguacgaaaucaacucaagaacaaugcaaaagaaauuggcaacggauguuuugaguucuaucacaagugcgauaauacuuguauggaaagcguuaagaacggcaccuacgacuauccuaaauacucagaggaagccaagcugaauagagagaaaaucgauggggugaaacuugagaguacaaggauuuaucagauacuggcuaucuacuccaccgucgcgagcucuuuggugcucgucgugucacugggagcaauuaguuuuuggaugugcagcaacgguuccuuacagugccggaucuguaucuga

SEQ ID NO: 134720 - RNA, 1701 nt, Artificial Sequence; identical to SEQ ID NO: 132056
  derived and/or modified sequence opt3 from hemagglutinin__InfluenzaA__AIM56138

SEQ ID NO: 134721 - RNA, 1701 nt, Artificial Sequence; identical to SEQ ID NO: 132056
  derived and/or modified sequence opt3 from hemagglutinin__InfluenzaA__AIM56149

SEQ ID NO: 134722 - RNA, 1701 nt, Artificial Sequence; identical to SEQ ID NO: 133909
  derived and/or modified sequence opt3 from hemagglutinin__InfluenzaA__AIM56160

SEQ ID NO: 134723 - RNA, 1701 nt, Artificial Sequence; identical to SEQ ID NO: 132056
  derived and/or modified sequence opt3 from hemagglutinin__InfluenzaA__AIM56171

SEQ ID NO: 134724 - RNA, 1701 nt, Artificial Sequence
  derived and/or modified sequence opt3 from hemagglutinin__InfluenzaA__AIM56182
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaaggccagcuccuggcccaaccacgacucaaauaagggugucacagcugcauguccucaugccggggcuaaaaguuuuuauaagaaccugaucuggcucgugaaaaagggaaauagcuacccaaaauuaucucaauccuauauaaacgauaagggcaaggaaguacugguucuuuggggcauccaccaccccucaaccacggccgaccagcagagcuuguaccagaaugcggaugcauacguguucgucgggaccagucgcuauucuaaaaaguuuaaaccugagauugccauccgaccaaaggugcgugaccaagagggaagaaugaacuacuauuggacucugguggaacccggugauaaaauuacauucgaggcuacuggcaaccuagucguuccuagguacgccuuuaccauggaacggaaugcaggguccggaaucauaauuagcgacacaccagugcaugauugcaacaccacgugucagacuccggagggcgcuaucaauacaucgcuccccuuccagaacauucacccuaucaccaucgguaagugcccaaaauauguaaagucuacuaagcugcgccuugccacagggcugagaaauauucccuccauacagucaaggggauuguuuggcgcgaucgccggcuucauugaagggggauggaccgguaugguggacggcugguacggguaucaucaccaaaacgagcagggaaguggcuacgcagcugaccucaaaagcacgcagaaugccaucgauaagauaaccaacaaagucaauuccgugauugagaagaugaacacacaguuuacugcuguugguaaagaguucaaucaccuggagaagcggaucgaaaacuuaaauaagaaaguggacgauggguuccuggacaucuggaccuacaacgccgagcuccuuguccuguuggaaaaugagcgcacacuagauuaucaugacucuaacgugaagaaccuguacgagaaaguacgaaaucaacucaagaacaaugcaaaagaaauuggcaacggauguuuugaguucuaucacaagugcgauaauacuuguauggaaagcguuaagaacggcaccuacgacuauccuaaauacucagaggaagccaagcugaauaaagagaagaucgauggggugaaacuugagaguacaagaauuuaucagauacuggcuaucuacuccaccgucgcgagcucuuuggugcucgucgugucacugggagcaauuaguuuuuggaugugcagcaacgguuccuuacagugcaggaucuguaucuga

SEQ ID NO: 134725 - RNA, 1701 nt, Artificial Sequence
  derived and/or modified sequence opt3 from hemagglutinin__InfluenzaA__AIM56193
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaagucacuuucgaggccaccggcaaccuaguugugccuagguacgcuuuuacaauggaacggaaugccggguccggaauuaucauaagcgacaccccaguacaugauugcaacacgacuugucagacaccggagggcgcaauuaauaccucgcuccccuuccagaacauccacccuauuacuaucgguaagugcccaaaauaugugaagucuacaaagcugcgccuugcuaccgggcugagaaauguccccuccauccagucaaggggauuguuuggcgccauugcgggcuucauagaagggggauggacggguaugguggacggcugguacggguaucaucaccaaaacgagcagggaaguggcuacgccgcagaccucaaaagcacccagaaugcuaucgauaagauuacaaacaaaguuaauuccgugaucgagaagaugaacacucaguuuaccgccgucgguaaagaguucaaucaccuggagaagcggauagaaaacuuaaauaagaaaguggacgauggguuccuggacauuuggacauacaacgcugagcuccuuguacuguuggaaaaugagcgcacucuagauuaucaugacucuaacguuaagaaccuguacgagaaagugcgaaaucaacucaagaacaaugccaaagaaaucggcaacggauguuuugaguucuaucacaagugcgauaauaccuguauggaaagcgucaagaacggcacauacgacuauccuaaauacucagaggaagcaaagcugaauagagagaaaaucgauggggugaaacuugagaguaccaggauuuaucagauccuggccauuuacuccacugucgcuagcucuuuggugcucguugugucacugggagcgauaaguuuuuggaugugcagcaacgguuccuuacagugccggaucuguauuuga

SEQ ID NO: 134726 - RNA, 1701 nt, Artificial Sequence; identical to SEQ ID NO: 132056
  derived and/or modified sequence opt3 from hemagglutinin__InfluenzaA__AIM56204

SEQ ID NO: 134727 - RNA, 1701 nt, Artificial Sequence; identical to SEQ ID NO: 132056
  derived and/or modified sequence opt3 from hemagglutinin__InfluenzaA__AIM56215

SEQ ID NO: 134728 - RNA, 1701 nt, Artificial Sequence; identical to SEQ ID NO: 132056
  derived and/or modified sequence opt3 from hemagglutinin__InfluenzaA__AIM56226

SEQ ID NO: 134729 - RNA, 1701 nt, Artificial Sequence; identical to SEQ ID NO: 134467
  derived and/or modified sequence opt3 from hemagglutinin__InfluenzaA__AIM56237

SEQ ID NO: 134730 - RNA, 1701 nt, Artificial Sequence; identical to SEQ ID NO: 132056
  derived and/or modified sequence opt3 from hemagglutinin__InfluenzaA__AIM56259

SEQ ID NO: 134731 - RNA, 1701 nt, Artificial Sequence
  derived and/or modified sequence opt3 from hemagglutinin__InfluenzaA__AIM56270
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaguaaauaccucgcuccccuuccagaacauccacccuauuacuaucgguaagugcccaaaauaugugaagucuacaaagcugcgccuugcuaccgggcugagaaauguccccuccauccagucaaggggauuguuuggcgccauugcgggcuucauagaagggggauggacggguaugguggacggcugguacggguaucaucaccaaaacgagcagggaaguggcuacgccgcagaccucaaaagcacccagaaugcuaucgauaagauuacaaacaaaguuaauuccgugaucgagaagaugaacacucaguuuaccgccgucgguaaagaguucaaucaccuggagaagcggauagaaaacuuaaauaagaaaguggacgauggguuccuggacauuuggacauacaacgcugagcuccuuguacuguuggaaaaugagcgcacucuagauuaucaugacucuaacguuaagaaccuguacgagaaagugcgaaaucaacucaagaacaaugccaaagaaaucggcaacggauguuuugaguucuaucacaagugcgauaauaccuguauggaaagcgucaagaacggcacauacgacuauccuaaauacucagaggaagcaaagcugaauagagagaaaaucgauggggugaaacuugagaguaccaggauuuaucagauccuggccauuuacuccacugucgcuagcucuuuggugcucguugugucacugggagcgauaaguuuuuggaugugcagcaacgguuccuuacagugccggaucuguauuuga

SEQ ID NO: 134732 - RNA, 1701 nt, Artificial Sequence; identical to SEQ ID NO: 132056
  derived and/or modified sequence opt3 from hemagglutinin__InfluenzaA__AIM56281

SEQ ID NO: 134733 - RNA, 1701 nt, Artificial Sequence
  derived and/or modified sequence opt3 from hemagglutinin__InfluenzaA__AIM56292
augaaggccauccuggugguccuccuuuacacccuggcuacagcaaacgccgacacuuugugcauuggcuaucacgcgaauaacagcacggauaccguugacacaguguuagagaaaaauguaacugugacccauuccgucaaccugcuagaagauaagcacaaugggaaacucuguaagcugagaggaguggcuccccuucaucuggguaaaugcaacauagccggcuggaucuuggggaauccugagugugaaucucucucaacagcaaguagcugguccuacauuguugagaccucuucgucagacaacggaacuugcuauccaggcgauuucaucaauuacgaggaacugagggagcagcugagcaguguguccucuuuugaacgguucgagauuuuuccgaagacaagcuccuggcccaaccacgacucaaauaagggugucaccgccgcuuguccucaugcaggggccaaaaguuucuauaagaaccucaucugguuagugaaaaagggaaauagcuacccaaaacugucucaauccuauauaaacgauaagggcaaggaaauccuuguauuguggggcauucaccaccccucaacgacugcugaccagcagagccuguaccagaaugccgaugcguacguuuuuguggggaccagucgcuauucuaaaaaguucaaaccugagaucgcaauucgaccaaagguccgugaccaagagggaagaaugaacuacuauuggacacuuguggaacccggugauaaaaucacuuuugaggccaccggcaaccucguggucccuagguacgcuuucacaauggaacggaaugccggguccggaauaauuaucagcgacaccccaguucaugauugcaacacgacuugucagacaccggagggcgcaauuaauaccucgcugcccuuucagaacauccacccuaucacuauugguaagugcccaaaauaugugaagucuacaaagcuacgccuggcuaccggguugagaaauguacccuccauacagucaaggggacucuucggcgccaucgcgggcuuuauugaagggggauggacggguaugguggacggcugguacggguaucaucaccaaaacgagcagggaaguggcuacgccgcagaccugaaaagcacccagaaugcuaucgauaagauaacaaacaaagucaauuccgugauugagaagaugaacacucaguucaccgccguugguaaagaauuuaaucacuuagagaagcggaucgaaaaccugaauaagaaaguggacgauggguuccucgacaucuggacauacaacgcugagcuucuggucuugcuagaaaaugagcgcacucuggauuaucaugacucuaacgugaagaaccucuacgagaaaguacgaaaucaacugaagaacaaugccaaagaaauuggcaacggauguuucgaguuuuaucacaagugcgauaauaccuguauggaaagcguuaagaacggcacauacgacuauccuaaauacucagaggaagcaaaacuuaauagagagaagaucgauggggugaagcuggagaguaccaggauuuaucagauauuggccaucuacuccacugucgcuagcucucucgugcuggucgugucauuaggagcgauuaguuucuggaugugcagcaacgguucccugcagugccggaucuguaucuga

SEQ ID NO: 134734 - RNA, 1701 nt, Artificial Sequence
  derived and/or modified sequence opt3 from hemagglutinin__InfluenzaA__AIM56303
augaaggccauccuggugguccuccuuuacacccuggcuacagcaaacgccgacacuuugugcauuggcuaucacgcgaauaacagcacggauaccguugacacaguguuagagaaaaauguaacugugacccauuccgucaaccugcuagaagauaagcacaaugggaaacucuguaagcugagaggaguggcuccccuucaucuggguaaaugcaacauagccggcuggaucuuggggaauccugagugugaaucucucucaacagcaaguagcugguccuacauuguugagaccucuucgucagacaacggaacuugcuauccaggcgauuucaucaauuacgaggaacugagggagcagcugagcaguguguccucuuuugaacgguucgagauuuuuccgaagacaagcuccuggcccaaccacgacucaaauaagggugucaccgccgcuuguccucaugcaggggccaaaaguuucuauaagaaccucaucugguuagugaaaaagggaaauagcuacccaaaacugucucaauccuauauaaacgauaagggcaaggaaguacuuguuuuguggggcauccaccaccccucaacgacugcugaccagcagagccuguaccagaaugccgaugcguacguguuugucgggaccagucgcuauucuaaaaaguucaaaccugagauugcaauccgaccaaaggugcgugaccaagagggaagaaugaacuacuauuggacacuuguggaacccggugauaaaauuacuuuugaggccaccggcaaccucgucguuccuagguacgcuuucacaauggaacggaaugccggguccggaaucauaauuagcgacacccaggugcaugauugcaacacgacuugucagacaccagagggcgcaaucaauaccucgcugccguuucagaacauucaccccaucacuaucgguaagugcccuaaauauguaaagucuacaaagcuacgccuggcuaccggguugagaaaugugccauccauucaaucaaggggacucuucggcgccauagcgggcuuuaucgaagggggauggacggguauggucgacggcugguacggguaucaucaccagaacgagcagggaaguggcuacgccgcagaccugaaaagcacccagaaugcuauugauaagaucacaaacaaaguuaauuccgugauagagaagaugaacacucaauucaccgccguggguaaagaauuuaaucacuuagagaagcggauugaaaaccugaauaagaaagucgacgauggguuccucgacaucuggacauacaacgcugagcuucugguguugcuagaaaaugagcgcacucuggauuaucaugacucuaacguaaagaaccucuacgagaaaguucgaaaucagcugaagaacaaugccaaagaaaucggcaacggauguuucgaguuuuaucacaagugcgauaauaccuguauggaaagcgugaagaacggcacauacgacuaucccaaauacucagaggaagcaaaacuuaauagagagaagauugauggggucaagcuggagaguaccaggaucuaucagauuuuggccauauacuccacuguggcuagcucucucguccuggugguuucauuaggagcgaucaguuucuggaugugcagcaacgguucccugcaaugccggauuuguaucuga

SEQ ID NO: 134735 - RNA, 1701 nt, Artificial Sequence
  derived and/or modified sequence opt3 from hemagglutinin__InfluenzaA__AIM56314
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccucaaaagcacccagaaugcuauugauaagaucacaaacaaaguuaauuccgugauagagaagaugaacacucaguuuaccgccguggguaaagaguucaaucaccuggagaagcggauugaaaacuuaaauaagaaagucgacgauggguuccuggacaucuggacauacaacgcugagcuccuugugcuguuggaaaaugagcgcacucuagauuaucaugacucuaacguaaagaaacuguacgagaagguucgaaaccaacucaaaaauaacgccaaggaaaucggcaauggauguuuugaguucuaucacaagugcgauaacaccuguauggaaagcgugaaaaauggcacauacgacuauccuaaguacucagaggaagcaaaacugaacagagagaagauugauggggucaaacuugagaguaccaggaucuaucagauucuggccauauacuccacuguggcuagcucuuugguccucgugguuucacugggagcgaucaguuuuuggaugugcagcaaugguuccuuacagugccggauuuguaucuga

SEQ ID NO: 134736 - RNA, 1701 nt, Artificial Sequence; identical to SEQ ID NO: 132056
  derived and/or modified sequence opt3 from hemagglutinin__InfluenzaA__AIM56325

SEQ ID NO: 134737 - RNA, 1701 nt, Artificial Sequence
  derived and/or modified sequence opt3 from hemagglutinin__InfluenzaA__AIM56336
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaauauucccuccauacagucaaggggauuguuuggcgccaucgcgggcuucauugaagggggauggacggguaugguggacggcugguacggguaucaucaccaaaacgagcagggaaguggcuacgccgcagaccucaaaagcacccagaaugcuaucgauaagauaacaaacaaagucaauuccgugauugagaagaugaacacucaguuuaccgccguugguaaagaguucaaucaccuggagaagcggaucgaaaacuuaaauaagaaaguggacgauggguuccuggacaucuggacauacaacgcugagcuccuuguccuguuggaaaaugagcgcacucuagauuaucaugacucuaacgugaagaaccuguacgagaaaauucgaaaucaacucaagaacaaugccaaagaaaucggcaacggauguuuugaguucuaucacaagugcgauaauauguguauggaaagcguaaagaacggcaccuacgacuauccuaaauacucagaggaagcaaagcugaauagagagaaaauugaugggguuaaacuugagaguacaaggauauaucagauccuggccauuuacuccaccguggcuagcucuuugguccucguggucucacugggagcgaucaguuuuuggaugugcagcaacgguuccuuacagugccggaucuguauuuga

SEQ ID NO: 134738 - RNA, 1701 nt, Artificial Sequence
  derived and/or modified sequence opt3 from hemagglutinin__InfluenzaA__AIM56347
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacaaccaguagcugguccuacauuguugagacuucuucgucagacaacggaacaugcuauccaggcgauuuuaucaauuacgaagaacucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuaucucaauccuauauaaacgauaagggcaaggaaguacugguucuuuggggcauccaccaccccucaacuaccgccgaccagcagagcuuguaccagaaugcugaugccuacguguucgucgggacaagucgcuauucuaaaaaguuuaaaccugagauugcgauccgaccaaaggugcgugaccaagagggaagaaugaacuacuauuggacucugguggaacccggugauaaaauuaccuucgaggcaacaggcaaccuagucguuccuagguacgccuuuaccauggaacggaaugcuggguccggaaucauaauuagcgacacgccagugcaugauugcaacacuacaugucagaccccggagggcgccaucaauacuucgcuccccuuccagaacauucacccuaucacaaucgguaagugcccaaaauauguaaagucuaccaagcugcgccuugcaacggggcugagaaaugugcccuccauucagucaaggggauuguuuggcgcuauagccggcuucaucgaagggggauggaccgguauggucgacggcugguacggguaucaucaccaaaacgagcagggaaguggcuacgcggccgaccucaaaagcacacagaaugcaauugauaagaucacuaacaaaguuaauuccgugauagagaagaugaacacccaguuuacagcuguggguaaagaguucaaucaccuggagaagcggauugaaaacuuaaauaagaaagucgacgauggguuccuggacaucuggacuuacaacgccgagcuccuugugcuguuggaaaaugagcgcacccuagauuaucaugacucuaacguaaagaaccuguacgagaaaguucgaaaucaacucaagaacaaugcuaaagaaaucggcaacggauguuuugaguucuaucacaagugcgauaauacauguauggaaagcgugaagaacggcaccuacgacuauccuaaauacucagaggaagccaagcugaauagagagaaaauugauggggucaaacuugagaguacuaggaucuaucagauucuggcaauauacuccacgguggccagcucuuugguccucgugguuucacugggagcuaucaguuuuuggaugugcagcaacgguuccuuacagugccggauuuguaucuga

SEQ ID NO: 134739 - RNA, 1701 nt, Artificial Sequence
  derived and/or modified sequence opt3 from hemagglutinin__InfluenzaA__AIM56358
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacuggugaaacccggugauaagauuacuuucgaagccaccggcaaccuagucguuccuagguacgcuuuuacaauggagcggaaugccggguccggaaucauaauuagcgacaccccagugcaugauugcaacacgacuugucagacaccggaaggcgcaaucaauaccucgcuccccuuccagaacauucacccuaucacuaucgguaaaugcccaaaguauguaaagucuacaaaacugcgccuugcuaccgggcugagaaaugugcccuccauucagucaaggggauuguuuggcgccauagcgggcuucaucgaagggggauggacggguauggucgacggcugguacggguaucaucaccaaaacgaacagggaaguggcuacgccgcagaccucaagagcacccagaaugcuauugauaaaaucacaaacaagguaaauuccguuauagagaaaaugaacacucaguuuaccgccguggguaaggaguucaaucaccuggaaaagcggauugagaacuuaaauaaaaaggucgacgauggguuccuggacaucuggacauacaacgcugaacuccuugugcuguuggagaaugaacgcacucuagauuaucaugacucuaacgugaaaaaccuguacgagaagguucgaaaucaacucaaaaacaaugccaaggagaucggcaacggauguuuugaguucuaucacaagugcgauaauaccuguauggaaagcgugaaaaacggcacauacgacuauccuaaguacucagaagaggcaaaacugaauagagaaaagauugauggggucaaacuugagaguaccaggaucuaucagauucuggccauauacuccacuguggcuagcucuuugguccucgugguuucacugggagcgaucaguuuuuggaugugcagcaacgguuccuuacagugccggauuuguaucuga

SEQ ID NO: 134740 - RNA, 1701 nt, Artificial Sequence; identical to SEQ ID NO: 132056
  derived and/or modified sequence opt3 from hemagglutinin__InfluenzaA__AIM56369

SEQ ID NO: 134741 - RNA, 1701 nt, Artificial Sequence
  derived and/or modified sequence opt3 from hemagglutinin__InfluenzaA__AIM56380
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccucaaaagcacccagaaugcuauugauaagaucacaaacaaaguuaauuccgugauagagaagaugaacacucaguuuaccgccguggguaaagaguucaaucaccuggagaagcggauugaaaacuuaaauaagaaagucgacgauggguuccuggacaucuggacauacaacgcugagcuccuugugcuguuggaaaaugagcgcacucuagauuaucaugacucuaacguaaagaaccuguacgagaaaguucgaaaucaacucaagaacaaugccaaagaaaucggcaacggauguuuugaguucuaucacaagugcgauaauaccuguauggaaagcgugaagaacggcacauacgacuauccuaaauacucagaggaagcaaagcugaguagagagaaaauugauggggucaaacuugaguccaccaggaucuaucagauucuggccauauacagcacuguggcuucuucauugguccucgugguuagucugggagcgaucagcuuuuggaugugcuccaaugguucuuuacagugccggauuuguaucuga

SEQ ID NO: 134742 - RNA, 1701 nt, Artificial Sequence; identical to SEQ ID NO: 132056
  derived and/or modified sequence opt3 from hemagglutinin__InfluenzaA__AIM56391

SEQ ID NO: 134743 - RNA, 1701 nt, Artificial Sequence; identical to SEQ ID NO: 132056
  derived and/or modified sequence opt3 from hemagglutinin__InfluenzaA__AIM56402

SEQ ID NO: 134744 - RNA, 1701 nt, Artificial Sequence; identical to SEQ ID NO: 133909
  derived and/or modified sequence opt3 from hemagglutinin__InfluenzaA__AIM56413

SEQ ID NO: 134745 - RNA, 1701 nt, Artificial Sequence; identical to SEQ ID NO: 132056
  derived and/or modified sequence opt3 from hemagglutinin__InfluenzaA__AIM56425

SEQ ID NO: 134746 - RNA, 1701 nt, Artificial Sequence; identical to SEQ ID NO: 132056
  derived and/or modified sequence opt3 from hemagglutinin__InfluenzaA__AIM56436

SEQ ID NO: 134747 - RNA, 1701 nt, Artificial Sequence; identical to SEQ ID NO: 132056
  derived and/or modified sequence opt3 from hemagglutinin__InfluenzaA__AIM56447

SEQ ID NO: 134748 - RNA, 1701 nt, Artificial Sequence; identical to SEQ ID NO: 132056
  derived and/or modified sequence opt3 from hemagglutinin__InfluenzaA__AIM56469

SEQ ID NO: 134749 - RNA, 1701 nt, Artificial Sequence
  derived and/or modified sequence opt3 from hemagglutinin__InfluenzaA__AIM56480
augaaggccauccuggugguccuccuuuacaccuucgcuacaacuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaagaacucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuaucucaauccuauauaaacgauaagggcaaggaaguacugguucuuuggggcauccaccaccccucaacuaccgccgaccagcagagcuuguaccagaaugcugaugccuacguguucgucgggacaagucgcuauucuaaaaaguuuaaaccugagauugcgauccgaccaaaggugcgugaccaagagggaagaaugaacuacuauuggacucugguggaacccggugauaaaauuaccuucgaggcaacaggcaaccuagucguuccuagguacgccuuuaccauggaacggaaugcuggguccggaaucauaauuagcgacacgccagugcaugauugcaacacuacaugucagaccccggagggcgccaucaauacuucgcuccccuuccagaacauucacccuaucacacuggguaagugcccaaaauauguaaagucuaccaagcugcgccuugcaacgggguugagaaaugugcccuccauccagucaaggggacucuuuggcgcuauugccggcuucauagaagggggauggaccgguauggucgacggcugguacggguaucaucaccaaaacgagcagggaaguggcuacgcggccgaccugaaaagcacacagaaugcaaucgauaagauuacuaacaaaguuaauuccgugaucgagaagaugaacacccaguuuacagcuguggguaaagaguucaaucacuuagagaagcggauagaaaaccugaauaagaaagucgacgauggguuccucgacauuuggacuuacaacgccgagcuucugguguugcuagaaaaugagcgcacccuggauuaucaugacucuaacguaaagaaccucuacgagaaaguucgaaaucaacugaagaacaaugcuaaagaaaucggcaacggauguuuugaguucuaucacaagugcgauaauacauguauggaaagcgugaagaacggcaccuacgacuauccuaaauacucagaggaagccaaacuuaauagagagaagaucgauggggucaagcuggagaguacuaggauuuaucagaucuuggcaauuuacuccacgguggccagcucucucguccuggugguuucauuaggagcuauaaguuuuuggaugugcagcaacgguucccugcagugccggaucuguauuuga

SEQ ID NO: 134750 - RNA, 1701 nt, Artificial Sequence; identical to SEQ ID NO: 132056
  derived and/or modified sequence opt3 from hemagglutinin__InfluenzaA__AIM56491

SEQ ID NO: 134751 - RNA, 1710 nt, Artificial Sequence
  derived and/or modified sequence opt3 from hemagglutinin__InfluenzaA__AIM56502
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaaggccagcuccuggcccaaccacgacucaaauaagggugucacagcugcauguccucaugccggggcuaaaaguuuuuauaagaaccugaucuggcucgugaaaaagggaaauagcuacccaaaauuaucucaauccuauauaaacgauaagggcaaggaaguacugguucuuuggggcauccaccaccccucaaccacggccgaccagcagagcuuguaccagaaugcggaugcauacguguucgucgggaccagucgcuauucuaaaaaguuuaaaccugagauugccauccgaccaaaggugcgugaccaagagggaagaaugaacuacuauuggacucugguggaacccggugauaaaauuacauucgaggcuacuggcaaccuagucguuccuagguacgccuuuaccauggaacggaaugcaggguccggaaucauaauuagcgacacaccagugcaugauugcaacaccacgugucagacuccggagggcgcuaucaauacaucgcucaccucucugcccuuccagaacauucacccuaucacuaucgguaagugcccaaaauauguaaaguccacaaaacuucgccuggccaccggguugagaaauauucccucaauacagaguaggggacucuuuggcgcgaucgccggcuucauugaagggggauggacggguaugguggacggcugguacggguaucaucaccaaaacgagcagggaagcggcuacgcagcugaccugaaguccacccagaaugccaucgauaagauaacaaacaaagucaauucugugauugagaagaugaacacucaguuuaccgcuguugguaaagaguucaaucacuuagagaagcggaucgaaaaccugaauaagaaaguggacgauggguuccucgacaucuggacauacaacgccgagcuucuggucuugcuagaaaaugagcgcacucuggauuaucaugacagcaacgugaagaaccucuacgagaaaguacgaaaucaacugaagaacaaugcaaaagaaauuggcaacggauguuuugaguucuaucacaagugcgauaauaccuguauggaaucaguuaagaacggcacauacgacuauccuaaauacagugaggaagccaaacuuaauagagagaagaucgauggggugaagcuggaguccaccaggauuuaucagauauuggcuaucuacagcacugucgcgucuucacucgugcuggucgugaguuuaggagcaauuagcuuuuggaugugcuccaacgguucucugcagugccggaucuguaucuga

SEQ ID NO: 134752 - RNA, 1701 nt, Artificial Sequence; identical to SEQ ID NO: 132056
  derived and/or modified sequence opt3 from hemagglutinin__InfluenzaA__AIM56513

SEQ ID NO: 134753 - RNA, 1701 nt, Artificial Sequence; identical to SEQ ID NO: 134001
  derived and/or modified sequence opt3 from hemagglutinin__InfluenzaA__AIM56524

SEQ ID NO: 134754 - RNA, 1701 nt, Artificial Sequence; identical to SEQ ID NO: 132056
  derived and/or modified sequence opt3 from hemagglutinin__InfluenzaA__AIM56535

SEQ ID NO: 134755 - RNA, 1701 nt, Artificial Sequence; identical to SEQ ID NO: 132056
  derived and/or modified sequence opt3 from hemagglutinin__InfluenzaA__AIM56546

SEQ ID NO: 134756 - RNA, 1701 nt, Artificial Sequence; identical to SEQ ID NO: 133909
  derived and/or modified sequence opt3 from hemagglutinin__InfluenzaA__AIM56557

SEQ ID NO: 134757 - RNA, 1701 nt, Artificial Sequence
  derived and/or modified sequence opt3 from hemagglutinin__InfluenzaA__AIM56568
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucagcaagacauccucauggccgaaccacgacaguaauaagggugucaccgccgcuuguccccaugcaggggccaagagcuuuuauaagaaccugaucuggcucgugaaaaagggaaauucuuacccuaaauuaucccaaucauauauaaacgauaagggcaaggaaguacugguucuuuggggcauccaccacccaagcacgacugcugaccagcagaguuuguaccagaaugccgaugcguacguguucgucgggaccucucgcuauuccaaaaaguuuaaacccgagauugcaauccgaccuaaggugcgugaccaagagggaagaaugaacuacuauuggacacugguggaaccaggugauaaaauuacuuucgaggccaccggcaaccuagucguucccagguacgcuuuuacaauggaacggaaugccgggagcggaaucauaauuucggacaccccugugcaugauugcaacacgacuugucagacaccagagggcgcaaucaauaccucucucccguuccagaacauucaccccaucacuaucgguaagugcccuaaauauguaaaguccacaaagcugcgccuugcuaccgggcugagaaaugugccaucaauucagaguaggggauuguuuggcgccauagcgggcuucaucgaagggggauggacggguauggucgacggcugguacggguaucaucaccaaaacgagcagggaagcggcuacgccgcagaccucaaauccacccagaaugcuauugauaagaucacaaacaaaguuaauucugugauagagaagaugaacacucaguuuaccgccguggguaaagaguucaaucaccuggagaagcggauugaaaacuuaaauaagaaagucgacgauggguuccuggacaucuggacauacaacgcugagcuccuugugcuguuggaaaaugagcgcacucuagauuaucaugacagcaacguaaagaaccuguacgagaaaguucgaaaucaacucaagaacaaugccaaagaaaucggcaacggauguuuugaguucuaucacaagugcgauaauaccuguauggaaucagugaagaacggcacauacgacuaucccaaauacagugaggaagcaaagcugaauagagagaaaauugauggggucaaacuugaguccaccaggaucuaucagauucuggccauauacagcacuguggcuucuucauugguccucgugguuagucugggagcgaucagcuuuuggaugugcuccaacgguucuuuacagugccggauuuguaucuga

SEQ ID NO: 134758 - RNA, 1701 nt, Artificial Sequence
  derived and/or modified sequence opt3 from hemagglutinin__InfluenzaA__AIM56579
augaaggccauccuggugguccuccuuuacaccuucgcuacaacuaacgcagacacgcugugcauuggcuaucacgccaauaacagcaccgauacaguugacacuguguuggagaaaaauguaaccgugacacauuccgucaacuuacuggaagaugagcacaaugggaagcuauguaaacucagaggaguggcgccccugcaucuugguaagugcaacauagcuggcuggauccuggggaauccugaaugugagucuuugucaaccgccaguagcugguccuacauuguugaaacuucuucgucagacaacggaacaugcuauccaggcgauuuuaucaauuacgaggagcucagggaacagcugagcaguguguccucuuucgagcgguuugaaauuuucccgaaaaccagcuccuggcccaaccacgacucaaauaagggugucacggcagccuguccucaugcuggggcaaagaguuuuuauaaaaaccugaucuggcucgugaagaaaggaaauagcuacccaaaguuaucucaauccuauauaaacgauaaaggcaaggagguacugguucuuuggggcauccaccaccccucaacuaccgccgaccagcagagcuuguaccagaauacagaugcuuacguguucgucgggaccagucgcuauucuaagaaauuuaagccugagauugccauccgaccaaaagugcgugaccaagaaggaagaauguccuacuauuggacucugguggagcccggugauaagauuacauucgaagcgaccggcaaccuagucguuccuagguacgcauuuacgauggagcggaacgccgggagcggaaucauaauuucggacacuccagugcaugauugcaauacaaccugucagacuccggaaggcgcuaucaacacaucucuccccuuccagaauauucacccuaucaccaucgguaaaugcccaaaguauguaaaauccacgaagcugcgccuugccaccgggcugagaaacgugcccucaauucagaguaggggauuguuuggcgcaauagcuggcuucaucgaagggggauggacagguauggucgacggcugguacggguaucaucaccaaaaugagcagggaagcggcuacgccgcggaccucaaguccacucagaacgccauugauaaaaucaccaauaaggugaacucuguuauagagaaaaugaauacacaguuuacugcaguggguaaggaguucaaccaccuggaaaaacggauugagaauuuaaacaagaaggucgacgauggguuccuggacaucuggaccuacaaugcugaacuccuugugcuguuggagaacgagcgcacacuagauuaucaugacagcaauguuaaaaaccuguacgaaaagguacgaaaccaacucaaaaauaacgccaaggagaucggcaauggauguuuugaguucuaucacaaaugcgauaacaccuguauggaaucagugaagaauggcacuuacgacuauccuaaguacagugaagaggcuaaacugaacagagagaagauugauggggucaaacuugaauccacgaggaucuaucagauucuggccauauacagcacaguggcaucuucauugguccucgugguuagucugggagccaucagcuuuuggaugugcuccaaugguucuuuacagugccggauuuguaucuga

SEQ ID NO: 134759 - RNA, 1710 nt, Artificial Sequence
  derived and/or modified sequence opt3 from hemagglutinin__InfluenzaA__AIM56590
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcucacuucucugcccuuccagaacauucacccuaucacaaucgguaagugcccaaaauauguaaaguccaccaaacuucgccuggcuacgggguugagaaaugugcccucaauucagaguaggggacucuuuggcgccauagcgggcuucaucgaagggggauggaccgguauggucgacggcugguacggguaucaucaccaaaacgagcagggaagcggcuacgccgcagaccugaaguccacacagaaugcuauugauaagaucacuaacaaaguuaauucugugauagagaagaugaacacccaguuuacagccguggguaaagaguucaaucacuuagagaagcggauugaaaaccugaauaagaaagucgacgauggguuccucgacaucuggacuuacaacgcugagcuucugguguugcuagaaaaugagcgcacccuggauuaucaugacagcaacguaaagaaccucuacgagaaaguucgaaaucaacugaagaacaaugccaaagaaaucggcaacggauguuuugaguucuaucacaagugcgaugacacauguauggaaucagugaagaauggcaccuacgauuauccuaaauacagugaggaagcaaaacuuaacagagagaagauugacggggucaagcuggaguccacuaggaucuaucagauuuuggccauauacagcacgguggcuucuucacucguccuggugguuaguuuaggagcgaucagcuuuuggaugugcuccaaugguucucugcagugccggauuuguaucuga

SEQ ID NO: 134760 - RNA, 1710 nt, Artificial Sequence
  derived and/or modified sequence opt3 from hemagglutinin__InfluenzaA__AIM56601
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcucacuucucugcccuuccagaacauucacccuaucacaaucgguaagugcccaaaauauguaaaguccaccaaacuucgccuggcuacgggguugagaaaugugcccucaauucagaguaggggacucuuuggcgccauagcgggcuucaucgaagggggauggaccgguauggucgacggcugguacggguaucaucaccaaaacgagcagggaagcggcuacgccgcagaccugaaguccacacagaaugcuauugauaagaucacuaacaaaguuaauucugugauagagaagaugaacacccaguuuacagccguggguaaagaguucaaucacuuagagaagcggauugaaaaccugaauaagaaagucgacgauggguuccucgacaucuggacuuacaacgcugagcuucugguguugcuagaaaaugagcgcacccuggauuaucaugacagcaacguaaagaaccucuacgagaaaguucgaaaucaacugaagaacaaugccaaagaaaucggcaacggauguuuugaguucuaucacaagugcgauaauacauguauggaaucagugaagaacggcaccuacgacuauccuaaauacagugaggaagcaaaacuuaauagagagaagauugauggggucaagcuggaguccacuaggaucuaucagauuuuggccauauacagcacgguggcuucuucacucguccuggugguuaguuuaggagcgaucagcuuuuggaugugcuccaacgguucucugcagugccggauuuguaucuga

SEQ ID NO: 134761 - RNA, 1710 nt, Artificial Sequence
  derived and/or modified sequence opt3 from hemagglutinin__InfluenzaA__AIM56612
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaauaccggguccggaaucauaauuagcgacacgccagugcaugauugcaacacuacaugucagaccccggagggcgccaucaauacuucgcucacaucucugcccuuccagaacauucacccuaucaccaucgguaagugcccaaaauauguaaaguccacgaaacuucgccuggcaaccggguugagaaaugugcccucaauucagaguaggggacucuuuggcgcuauagccggcuucaucgaagggggauggacagguauggucgacggcugguacggguaucaucaccaaaacgagcagggaagcggcuacgcggccgaccugaaguccacucagaaugcaauugauaagaucaccaacaaaguuaauucugugauagagaagaugaacacacaguuuacugcuguggguaaagaguucaaucacuuagagaagcggauugaaaaccugaauaagaaagucgacgauggguuccucgacaucuggaccuacaacgccgagcuucugguguugcuagaaaaugagcgcacacuggauuaucaugacagcaacguaaagaaccucuacgagaaaguucgaaaucaacugaagaacaaugcuaaagaaaucggcaacggauguuuugaguucuaucacaagugcgauaauaccuguauggaaucagugaagaacggcacuuacgacuauccuaaauacagugaggaagccaaacuuaauagagagaagauugauggggucaagcuggaguccacgaggaucuaucagauuuuggcaauauacagcacaguggccucuucacucguccuggugguuaguuuaggagcuaucagcuuuuggaugugcuccaacgguucucugcagugccggauuuguaucuga

SEQ ID NO: 134762 - RNA, 1701 nt, Artificial Sequence
  derived and/or modified sequence opt3 from hemagglutinin__InfluenzaA__AIM56623
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugacguggcucgugaaaaagggaaauagcuacccaaaauuaucucaauccuauaucaacgauaagggcaaggaaguacugguucuuuggggcauacaccaccccucaacuaccgcugaccagcagagcuuguaccagaaugccgaugcguacguguucgucgggacaagucgcuauucuaaaaaguuuaaaccugagaucgcaauucgaccaaaggugcgugaccaagagggaagaaugaacuacuauuggacucugguggaacccggugauaaaaucaccuucgaggccacaggcaaccuagucguuccuagguacgcuuuuaccauggaacggaaugccggguccggaauuaucauaagcgacacgccagugcaugauugcaacacuacaugucagaccccggagggcgcaauuaauacuucgcuccccuuccagaacauccacccuauuacaaucgguaagugcccaaaauauguaaagucuaccaagcugcgccuugcuacggggcugagaaaugugcccuccauccagucaaggggauuguuuggcgccauugcgggcuucauagaagggggauggaccgguauggucgacggcugguacggguaucaucaccaaaacgagcagggaaguggcuacgccgcagaccucaaaagcacacagaaugcuaucgauaagauuacuaacaaaguuaauuccgugaucgagaagaugaacacccaguuuacagccguggguaaagaguucaaucaccuggagaagcggauagaaaacuuaaauaagaaagucgacgauggguuccuggacauuuggacuuacaacgcugagcuccuugugcuguuggaaaaugagcgcacccuagauuaucaugacucuaacguaaagaaccuguacgagaaaguucgaaaucaacucaagaacaaugccaaagaaaucggcaacggauguuuugaguucuaucacaagugcgauaauacauguauggaaagcgugaagaacggcaccuacgacuauccuaaauacucagaggaagcaaagcugaauagagagaaaaucgauggggucaaacuugagaguacuaggauuuaucagauccuggccauuuacuccacgguggcuagcucuuugguccucgugguuucacugggagcgauaaguuuuuggaugugcagcaacgguuccuuacagugccggaucuguauuuga

SEQ ID NO: 134763 - RNA, 1701 nt, Artificial Sequence
  derived and/or modified sequence opt3 from hemagglutinin__InfluenzaA__AIM56634
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaacaguuggagcuacauuguugagaccuccucuucggacaauggaacuugcuauccaggcgauuuuaucaacuacgaagaacucagggagcagcugucaagcgugaguuccuucgaacgguuugagauuuucccgaagacaucuagcuggcccaaucacgacuccaacaagggugucaccgccgcuuguccucaugcaggggccaaaucauuuuauaagaaucugaucuggcucgugaaaaagggaaacaguuacccaaaauuaagccaaucuuauauaaaugauaagggcaaggaaguacugguucuuuggggcauccaccaccccuccacgacugcugaccagcagucauuguaccagaacgccgaugcguacguguucgucgggaccagccgcuauaguaaaaaguuuaaaccugagauugcaauccgaccaaaggugcgugaccaagagggaagaaugaacuacuauuggacacugguggaacccggugauaaaauuacuuucgaggccaccggcaaucuagucguuccuagguacgcuuuuacaauggaacggaacgccgggucuggaaucauaauuuccgacaccccagugcaugauugcaauacgacuugucagacaccggagggcgcaaucaacaccagccuccccuuccagaauauucacccuaucacuaucgguaagugcccaaaauauguaaagucgacaaagcugcgccuugcuaccgggcugagaaacgugcccucuauucaguccaggggauuguuuggcgccauagcgggcuucaucgaagggggauggacggguauggucgacggcugguacggguaucaucaccaaaaugagcagggaucaggcuacgccgcagaccucaaaaguacccagaacgcuauugauaagaucacaaauaaagugaacagcguuauagagaagaugaauacucaguuuaccgccguggguaaagaguucaaccaccuggagaagcggauugaaaauuuaaacaagaaagucgacgauggguuccuggacaucuggacauacaaugcugagcuccuugugcuguuggaaaacgagcgcacucuagauuaucaugacuccaacguaaagaaucuguacgagaaaguucgaaaccaacucaagaauaacgccaaagaaaucggcaauggauguuuugaguucuaucacaagugcgauaacaccuguauggaaucugugaagaauggcacauacgacuauccuaaauacagcgaggaagcaaagcugaacagagagaaaauugauggggucaaacuugagucaaccaggaucuaucagauucuggccauauacaguacuguggcuuccagcuugguccucgugguuucucugggagcgaucucauuuuggaugugcaguaaugguagcuuacagugccggauuuguaucuga

SEQ ID NO: 134764 - RNA, 1710 nt, Artificial Sequence
  derived and/or modified sequence opt3 from hemagglutinin__InfluenzaA__AIM56645
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcucacuucucugcccuuccagaacauucacccuaucacaaucgguaagugcccaaaauauguaaaguccaccaaacuucgccuggcuacgggguugagaaaugugcccucaauucagaguaggggacucuuuggcgccauagcgggcuucaucgaagggggauggaccgguauggucgacggcugguacggguaucaucaccaaaacgagcagggaagcggcuacgccgcagaccagaaguccacacagaaugcuauugauaagaucacuaacaaaguuaauucugugauagagaagaugaacacccaauuuacagccguggguaaagaguucaaucaccuggagaagcggauugaaaacuuaaauaagaaagucgacgauggguuccuggacaucuggacuuacaacgcugagcuccuugugcuguuggaaaaugagcgcacccuagauuaucaugacagcaacguaaagaaccuguacgagaaaguucgaaaucagcucaagaacaaugccaaagaaaucggcaacggauguuuugaguucuaucacaagugcgauaauacauguauggaaucagugaagaacggcaccuacgacuauccuaaauacagugaggaagcaaagcugaauagagagaaaauugauggggucaaacuugaguccacuaggaucuaucagauucuggccauauacagcacgguggcuucuucauugguccucgugguuagucugggagcgaucagcuuuuggaugugcuccaacgguucuuuacaaugccggauuuguaucuga

SEQ ID NO: 134765 - RNA, 1701 nt, Artificial Sequence
  derived and/or modified sequence opt3 from hemagglutinin__InfluenzaA__AIM56656
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaaacagcuggcccaaucacgacuccaacaagggugucaccgccgcuuguccucaugcaggggccaaaucauuuuauaagaaucugaucuggcucgugaaaaagggaaacaguuacccaaaauuaagccaaucuuauauaaaugauaagggcaaggaaguacugguucuuuggggcauccaccaccccuccacgacugcugaccagcagucauuguaccagaacgccgaugcguacguguucgucgggaccagccgcuauaguaaaaaguuuaaaccugagauugcaauccgaccaaaggugcgugaccaagagggaagaaugaacuacuauuggacacugguggaacccggugauaaaauuacuuucgaggccaccggcaauaucgucguuccuagguacgcuuuuacaauggaacggaacgccgggucuggaauaauuaucuccgacaccccagugcaugauugcaauacgacuugucagacaccggagggcgcaauuaacaccagccuacccuuccagaauauccacccuaucacuauugguaagugcccaaaauauguaaagucgacaaagcuccgccuggcuaccgggcuuagaaacgugcccucuauacaguccaggggacuguuuggcgccaucgcgggcuucauugaagggggauggacggguauggucgacggcugguacggguaucaucaccaaaaugagcagggaucaggcuacgccgcagacuugaaaaguacccagaacgcuaucgauaagauaacaaauaaagugaacagcguuauugagaagaugaauacucaguuuaccgccguggguaaagaguucaaccaccucgagaagcggaucgaaaaucugaacaagaaagucgacgauggguucuuagacaucuggacauacaaugcugagcugcucgugcuucuggaaaacgagcgcacuuuggauuaucaugacuccaacguaaagaaucuauacgagaaaguucgaaaccaacugaagaauaacgccaaagaaauuggcaauggauguuuugaguucuaucacaagugcgauaacaccuguauggaaucugugaagaauggcacauacgacuauccuaaauacagcgaggaagcaaagcucaacagagagaaaaucgauggggucaagcuggagucaaccaggauuuaucagauacuugccaucuacaguacuguggcuuccagccuggucuuggugguuucucucggagcgauuucauuuuggaugugcaguaaugguagccugcagugccggaucuguaucuga

SEQ ID NO: 134766 - RNA, 1701 nt, Artificial Sequence; identical to SEQ ID NO: 132056
  derived and/or modified sequence opt3 from hemagglutinin__InfluenzaA__AIM56667

SEQ ID NO: 134767 - RNA, 1701 nt, Artificial Sequence
  derived and/or modified sequence opt3 from hemagglutinin__InfluenzaA__AIM56678
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggagugcccccucugcaucuugguaaaugcaacauagcuggcuggauccuggggaauccagagugugaaucuuugucaacagccaguagcugguccuacauuguugagaccucuucgucagacaacggaacuugcuauccgggcgauuuuaucaauuacgaagaacucagggagcagcugagcaguguguccucuuucgaacgguuugagauuuuccccaagacaagcuccuggccuaaccacgacucaaauaagggugucaccgcagccuguccacaugcuggggcaaaaaguuuuuauaagaaccugaucuggcucgugaaaaagggaaauagcuaccccaaauuaucucaauccuauauaaacgauaagggcaaggaaguacugguucuuuggggcauccaccacccuucaacgacugccgaccagcagagcuuguaccagaaugcugaugccuacguguucgucgggaccagucgcuauucuaaaaaguuuaaaccagagauugcgauccgacccaaggugcgugaccaagagggaagaaugaacuacuauuggacacugguggaaccuggugauaaaauuacuuucgaggcaaccggcaaccuagucguuccaagguacgccuuuacaauggaacggaaugcuggguccggaaucauaauuagcgacaccccggugcaugauugcaacacgacuugucagacacccgagggcgccaucaauaccucgcucccuuuccagaacauucacccaaucacuaucgguaagugccccaaauauguaaagucuacaaagcugcgccuugcaaccgggcugagaaaugugccuuccauucagucaaggggauuguuuggcgcuauagccggcuucaucgaagggggauggacggguauggucgacggcugguacggguaucaucaccaaaacgagcagggaaguggcuacgcggccgaccucaaaagcacccagaaugcaauugauaagaucacaaacaaaguuaauuccgugauagagaagaugaacacucaguuuaccgcuguggguaaagaguucaaucaccuggagaagcggauugaaaacuuaaauaagaaagucgacgauggguuccuggacaucuggacauacaacgccgagcuccuugugcuguuggaaaaugagcgcacucuagauuaucaugacucuaacguaaagaaccuguacgagaaaguucgaaaucaacucaagaacaaugcuaaagaaaucggcaacggauguuuugaguucuaucacaagugcgauaauaccuguauggaaagcgugaagaacggcacauacgacuauccaaaauacucagaggaagccaagcugaauagagagaaaauugauggggucaaacuugagaguaccaggaucuaucagauucuggcaauauacuccacuguggccagcucuuugguccucgugguuucacugggagcuaucaguuuuuggaugugcagcaacgguuccuuacagugccggauuuguaucuga

SEQ ID NO: 134768 - RNA, 1701 nt, Artificial Sequence; identical to SEQ ID NO: 134404
  derived and/or modified sequence opt3 from hemagglutinin__InfluenzaA__AIM56689

SEQ ID NO: 134769 - RNA, 1701 nt, Artificial Sequence; identical to SEQ ID NO: 132056
  derived and/or modified sequence opt3 from hemagglutinin__InfluenzaA__AIM56700

SEQ ID NO: 134770 - RNA, 1710 nt, Artificial Sequence
  derived and/or modified sequence opt3 from hemagglutinin__InfluenzaA__AIM56711
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggagugcccccucugcaucuugguaaaugcaacauagcuggcuggauccuggggaauccagagugugaaucuuugucaacagccaguagcugguccuacauuguugagaccucuucgucagacaacggaacuugcuauccgggcgauuuuaucaauuacgaagaacucagggagcagcugagcaguguguccucuuucgaacgguuugagauuuuccccaagacaagcuccuggccuaaccacgacucaaauaagggugucaccgcagccuguccacaugcuggggcaaaaaguuuuuauaagaaccugaucuggcucgugaaaaagggaaauagcuaccccaaauuaucucaauccuauauaaacgauaagggcaaggaaguacugguucuuuggggcauccaccacccuucaacgacugccgaccagcagagcuuguaccagaaugcugaugccuacguguucgucgggaccagucgcuauucuaaaaaguuuaaaccagagauugcgauccgacccaaggugcgugaccaagagggaagaaugaacuacuauuggacacugguggaaccuggugauaaaauuacuuucgaggcaaccggcaaccuagucguuccaagguacgccuuuacaauggaacggaaugcuggguccggaaucauaauuagcgacaccccggugcaugauugcaacacgacuugucagacacccgagggcgccaucaauaccucgcucacuucucugccuuuccagaacauucacccaaucacaaucgguaagugccccaaauauguaaaguccaccaaacuucgccuggcaacgggguugagaaaugugccuucaauucagaguaggggacucuuuggcgcuauagccggcuucaucgaagggggauggaccgguauggucgacggcugguacggguaucaucaccaaaacgagcagggaagcggcuacgcggccgaccugaaguccacacagaaugcaauugauaagaucacuaacaaaguuaauucugugauagagaagaugaacacccaguuuacagcuguggguaaagaguucaaucacuuagagaagcggauugaaaaccugaauaagaaagucgacgauggguuccucgacaucuggacuuacaacgccgagcuucugguguugcuagaaaaugagcgcacccuggauuaucaugacagcaacguaaagaaccucuacgagaaaguucgaaaucaacugaagaacaaugcuaaagaaaucggcaacggauguuuugaguucuaucacaagugcgauaauacauguauggaaucagugaagaacggcaccuacgacuauccaaaauacagugaggaagccaaacuuaauagagagaagauugauggggucaagcuggaguccacuaggaucuaucagauuuuggcaauauacagcacgguggccucuucacucguccuggugguuaguuuaggagcuaucagcuuuuggaugugcuccaacgguucucugcagugccggauuuguaucuga

SEQ ID NO: 134771 - RNA, 1701 nt, Artificial Sequence; identical to SEQ ID NO: 134404
  derived and/or modified sequence opt3 from hemagglutinin__InfluenzaA__AIM56722

SEQ ID NO: 134772 - RNA, 1701 nt, Artificial Sequence; identical to SEQ ID NO: 132056
  derived and/or modified sequence opt3 from hemagglutinin__InfluenzaA__AIM56733

SEQ ID NO: 134773 - RNA, 1701 nt, Artificial Sequence; identical to SEQ ID NO: 132056
  derived and/or modified sequence opt3 from hemagglutinin__InfluenzaA__AIM56744

SEQ ID NO: 134774 - RNA, 1701 nt, Artificial Sequence
  derived and/or modified sequence opt3 from hemagglutinin__InfluenzaA__AIM56755
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccucacacgacaguaacaagggugucaccgccgcuuguccucaugcaggggccaagagcuuuuauaagaaucugaucuggcucgugaaaaagggaaacucuuacccaaaauuaucccaaucauauauaaaugauaagggcaaggaaguacugguucuuuggggcauccaccaccccagcacgacugcugaccagcagaguuuguaccagaacgccgaugcguacguguucgucgggaccucucgcuauuccaaaaaguuuaaaccugagauugcaauccgaccaaaggugcgugaccaagagggaagaaugaauuacuauuggacacugguggaacccggugauaaaauuacuuucgaggccaccggcaaccuagucguuccuagguacgcuuuuacaauggaacggaacgccgggagcggaaucauaauuucggacaccccagugcaugauugcaauacgacuugucagacaccggagggcgcaaucaacaccucucuccccuuccagaauauucacccuaucacuaucgguaagugcccaaaauauguaaaguccacaaagcugcgccuugcuaccgggcugagaaacgugcccucaauucagaguaggggauuguuuggcgccauagcgggcuucaucgaagggggauggacggguauggucgacggcugguacggguaucaucaccaaaaugagcagggaagcggcuacgccgcagaccucaaauccacccagaacgcuauugauaagaucacaaauaaagugaacucuguuauagagaagaugaauacucaguuuaccgccguggguaaagaguucaaccaccuggagaagcggauugaaaauuuaaacaagaaagucgacgauggguuccuggacaucuggacauacaaugcugagcuccuugugcuguuggaaaacgagcgcacucuagauuaucaugacagcaauguaaagaaccuguacgagaaaguucgaaaccaacucaagaauaacgccaaagaaaucggcaauggauguuuugaguucuaucacaagugcgauaacaccuguauggaaucagugaagaauggcacauacgacuauccuaaauacagugaggaagcaaagcugaacagagagaaaauugauggggucaaacuugaguccaccaggaucuaucagauucuggccauauacagcacuguggcuucuucauugguccucgugguuagucugggagcgaucagcuuuuggaugugcuccaaugguucuuuacagugccggauuuguaucuga

SEQ ID NO: 134775 - RNA, 1710 nt, Artificial Sequence; identical to SEQ ID NO: 134760
  derived and/or modified sequence opt3 from hemagglutinin__InfluenzaA__AIM56766

SEQ ID NO: 134776 - RNA, 1701 nt, Artificial Sequence
  derived and/or modified sequence opt3 from hemagglutinin__InfluenzaA__AIM56777
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagggaagcacaauggaaaacuauguaagcucagagguguggcuccccugcaucuuggcaaaugcaacauagccggguggauccugggaaauccugagugugaaucuuugucaacagcaaguagcugguccuacauuguugagaccucuucgucagauaacggcacuugcuauccaggugacuuuaucaauuacgaggaacucagggagcagcugagcaguguguccucuuucgaacgguuugagauuuucccgaagacaagcuccuggcccaaccacgauucaaauaagggggucaccgccgcuuguccucaugcaggagccaaaaguuuuuauaagaaccugaucuggcucgugaaaaagggcaauagcuacccaaaauuaucucaauccuauauaaacgacaagggcaaggaaguacugguucuuugggggauccaccaccccucaacgacugcugaucagcagagcuuguaccagaaugccgacgcguacguguucgucggaaccagucgcuauucuaaaaaguuuaaaccugagauugcaauccgaccaaaggugcgugaucaagaggguagaaugaacuacuauuggacacugguggaacccggcgacaaaauuacuuucgaggccaccgggaaccuagucguuccuagguacgcuuuuacaauggaacggaaugccggauccggcaucauaauuagcgauaccccagugcaugacugcaacacgacuugucagacaccggagggugcaaucaauaccucgcuccccuaucagaacauucacccuaucacuaucgggaagugcccaaaauacguaaagucuacaaagcugcgccuugcuaccggacugagaaaugugcccuccauucagucaaggggcuuguucggcgccauagcgggguuuaucgaaggagguuggacgggcauggucgaugggugguauggauaccaucaccaaaacgagcagggcagugguuacgccgcagaccucaaaagcacccagaaugcuauugacaagaucacaaacaaaguuaauuccgugauagagaagaugaacacucaguucaccgccguggggaaagaauuuaaucaccuggagaagcggauugaaaacuuaaauaagaaagucgaugacggcuuccuggauaucuggacauauaacgcugagcuccuugugcuguuggaaaaugagcgcacucuagacuaccaugauucuaacguaaagaaccuguaugagaaaguucgaaaucaacucaagaacaaugccaaagaaaucggaaacggcuguuucgaguuuuaccacaagugcgacaauaccuguauggaaagcgugaagaacgggacauaugauuacccuaaauauucagaggaagcaaagcugaauagagagaaaauugacggagucaaacuugagaguaccaggaucuaccagauucuggccauauacuccacuguggcuagcucuuugguccucgugguuucacugggugcgaucaguuucuggaugugcagcaacggcuccuuacagugccggauuuguaucuga

SEQ ID NO: 134777 - RNA, 1701 nt, Artificial Sequence; identical to SEQ ID NO: 132056
  derived and/or modified sequence opt3 from hemagglutinin__InfluenzaA__AIM56788

SEQ ID NO: 134778 - RNA, 1701 nt, Artificial Sequence; identical to SEQ ID NO: 132056
  derived and/or modified sequence opt3 from hemagglutinin__InfluenzaA__AIM56799

SEQ ID NO: 134779 - RNA, 1701 nt, Artificial Sequence; identical to SEQ ID NO: 132056
  derived and/or modified sequence opt3 from hemagglutinin__InfluenzaA__AIM56810

SEQ ID NO: 134780 - RNA, 1701 nt, Artificial Sequence; identical to SEQ ID NO: 132056
  derived and/or modified sequence opt3 from hemagglutinin__InfluenzaA__AIM56821

SEQ ID NO: 134781 - RNA, 1683 nt, Artificial Sequence
  derived and/or modified sequence opt3 from hemagglutinin__InfluenzaA__AIN76383
augaacacccagauccugguguucgcccucauugcuauaguccccacaaaugcagacaagaucugccuuggccaccaugccguuagcaacgggacuaaagugaauacgcugaccgagagaggaguagaaguggucaacgcgacagagacuguggaaaggaccaauauuccucggaucuguuccaaggguaaaaagacaguugauuugggccaaugcggguuacugggaaccauuacuggcccaccgcagugugaccaguuucuagaguucucugcugaucucaucauagaacgccgagaggguucagacgugugcuaccccgggaaauuugucaacgaggaagcccugcgucagauccuuagagagaguggaggcauugauaaggaagcaaugggcuucacauauagcgggaucaggaccaauggaacgacuuccgccugucggcgcucugguucgucauuuuacgcugagaugaaguggcuguugagcaacaccgacaaugcagccuucccucaaaugacaaaaaguuauaagaacacuagaaaauccccagcucucauuguguggggcauccaccauucuguaagcaccgccgagcagacaaagcuguacggguccggaaauaaacugguuaccgugggcucaaguaacuaucagcagagcuuuguccccucuccuggugcgaggccacaagugaaugggcucuccggacggauagauuuccacugguuaaugcugaaccccaaugacacggugacuuuuucauucaacggcgcauuuauugccccugaucgcgcuagcuuccuucgaggcaagaguauggggauccagucuggaguccagguugacgccaacugcgaaggugauuguuaccauuccggcgggacaauuaucagcaauuugccauuucagaacaucgacucgagagcagugggaaagugcccgagguauguaaaacaaaagucucugcuacucgcuaccggcaugaaaaaugugcccgagauuccuaagggucgggggcuguucggcgccauagcgggauucaucgaaaacggcugggaggggcuuauugauggaugguacgguuuucgucaccagaaugcccagggcgaagggacugcagcugacuacaaauccacacaaucagccaucgaccagauaaccggaaagcugaaccgcuugauugagaaaacgaaucagcaguucgagcucaucgauaacgaauuuaaugaggucgaaaagcaaaucggcaacgugauuaauuggaccagagacaguaucacagagguuuggagcuauaacgcugaacuguuaguggccauggagaaucagcacacuauugaucuggcagacuccgagauggauaagcucuacgaaagggucaaacggcagcuucgagagaacgccgaagaggacgguaccggguguuucgaaauauuucauaagugcgaugacgauuguauggcuucuauccgcaauaacacauaugaccacagcaaauacagagaggaggcgaugcagaacaggauucaaaucgauccagugaagcugucaaguggcuauaaagacguaaucuugugguucuccuuuggagcaagcugcuucauucuacuggccauaguuaugggccucguguuuaucugcgucaagaaugggaacaugcgguguacuauuugcaucuga

SEQ ID NO: 134782 - RNA, 1689 nt, Artificial Sequence
  derived and/or modified sequence opt3 from hemagglutinin__InfluenzaA__AIP93103
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugcgcguaccggaauggucuuacaucauggagaaagagaacccccgauauucacucugcuacccuggcaguuuuaaugauuaugaagaacugaagcaucugcucagcuccgugaagcacuucgaaaaagucaagauuuuaccaaaagacgguuggacucaacaugagaccgaugggggaucuaaggcuugugccgugucgggcaaacccucauuuuuccguaacaugguuuggcugacaaagaagggcccuaauuacccaguggcaaaaagaagcuauaacaauaccaguggggagcagaugcuuaucauuuggggaguccaccaccccaacgacgaagccgagcagagggcuuuguaccagaauguggguacuuacguauccgcaucuacaagcacccugaacaagcgguccacgccugaaaucgccgcucgcccaaaaguuucaggccuagggaguagaauggaguuuagcuggacucuccuggaugugugggacaccauaucuuucgaauccacaggaaaucuugucgccccggaguauggcuuuaagauuucaaaaagggguagcagugggaucaugaagacugagggaacccugggcaacugcgaaacaaaaugucaaacccccuugggcgcgauuaacacgacucucccuuuccauaaugugcacccacugacaaucggggagugccccaaguacgugaagucugaaaaauuaguccuggcaaccggaccucggaacguuccacagaucgagucccgcggucucuuuggcgccauugcuggguucauagaaggaggcuggcaggguaugguggaugggugguauggcuaccaucacagcaaugaccagggaucgggcuaugccgcagauaaggagucuacucaaaaggcuuuugaccgaaucacaaacaaaguaaauuccgugauugagaaaaugaacacccaguucgaagccgucgggaaggaguuuucaaaucuugaaaagagacuggagaacuugaauaaaaagauggaagacggauuccuagauguguggacguacaacgcggagcugcucguucugauggagaaugaaaggacccuugacuuccacgauaguaacgugaaaaaucuguaugacaagguccggaugcaguugcgugauaacgugaaagagcucgguaauggcuguuuugaguucuaccauaagugcgacgaugaguguaugaacagcguaaagaacgggacauacgacuaucccaaauacgaggaagaguccaagcugaaacgcaaugaaaucaagggaguuaaauuaucuagcaugggcguguaucagauacuggccauuuacgcaacugucgcugguucacuaagucucgccaucaugaucgcugggauuuccuuuuggaugugcagcaacggcucucugcaaugcagaaucuguauuuga

SEQ ID NO: 134783 - RNA, 1689 nt, Artificial Sequence; identical to SEQ ID NO: 123671
  derived and/or modified sequence opt3 from hemagglutinin__InfluenzaA__AIP93115

SEQ ID NO: 134784 - RNA, 1701 nt, Artificial Sequence
  derived and/or modified sequence opt3 from hemagglutinin__InfluenzaA__AIR93971
augaaggccauccuggugguccuccuuuacaccuucgcuacaacuaacgcagacauucugugcauaggcuaucacgccaauaacagcacggauaccguugacacaguguuggagaaaaauguaacugugacccauuccgucaacuuacuggaagauaagcacaaugggaaacuauguaagcucagaggaguggcgccccugcaucuugguaaaugcaacaucgcuggcuggauucuggggaauccugagugugaaucuuugucaacagccaguagcugguccuacaucguugagaccucuucgucagacaacggaacuugcuauccaggcgauuuuauugacuacgaggagcucagggagcagcugagcaguguguccucuuucgaacgguuugagaucuucccgaagacaagcuccuggcccaaucacgauucaaacaagggugucaccgcagccuguccucaugcuggggcacgcaguuuuuauaaaaaucugauauggcucgugaagaaaggaaacagcuacccaaaguuaucuaaauccuauaucaaugacaagggcaaggaaguacugguucuuuggggcauucaccaccccucaacgagcgccgaucaacagaguuuguaccagaacgcugacgccuacguguucgucgggacuucucgauauuccaaaaaguuuaaaccugagaucgcgauucguccaaaggugagagauagggagggacggaugaauuacuauuggacccugguggaacccggugacaaaaucacauucgaggcaacuggcaaccuagucguuccucgcuacgccuuugcuauggaaagaaacgccgggagcggaauaauuaccucggauacaccagugcaugacugcaauaccacgugucagacuccgaagggcgcaaucaacacaucucuccccuuccaaaauauucacccuaucaccaucgguaaaugcccaaaguauguaaaguccacuaaacugaggcuugcuacagggcugcggaacgugcccucaauucagagucgcggauuguuuggcgccauagcgggcuucaucgaagggggauggaccgguauggucgacggcugguacggguaucaucaccagaaugaacagggaagcggcuacgccgcagaucucaaguccacgcaaaacgcuauugacgagaucaccaauaaagugaacucuguuauagagaagaugaauacacaguuuacugccguggguaaagaguucaaccaccuggaaaagcgaauugaaaauuuaaacaagaaagucgaugacggguuccuggauaucuggaccuacaaugcugagcuccuugugcuguuggaaaacgagagaacacuagacuaucaugauagcaauguaaagaaccuguacgagaaaguuaggucacagcucaagaacaaugccaaagaaaucggcaacggauguuuugaguucuaucacaagugcgacaauacuuguauggaaagugugaagaacggcaccuacgauuauccuaaauacuccgaggaagcaaagcugaaucgggaggagauugacggggucaaacuugaaagcacacguaucuaucagauucuggccauauacucuaccguggcuucaaguuugguccucgugguuagccugggagcgaucuccuuuuggaugugcucuaacgguucguuacaaugccgcauuuguaucuga

SEQ ID NO: 134785 - RNA, 1701 nt, Artificial Sequence
  derived and/or modified sequence opt3 from hemagglutinin__InfluenzaA__AIR93982
augaaggccauccuggugguccuccuuuacaccauugcuacagcaaacgccgacacucugugcauaggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacaucgccggcuggauucuggggaauccugagugugaaucuuugucaacagcaaguagcugguccuacaucguugagaccucuucgucagacaacggaacuugcuauccaggcgauuucauugacuacgaggagcucagggagcagcugagcaguguguccucuuuugaacgguucgagaucuuuccgaagacaagcuccuggcccaaucacgauucaaacaagggugucaccgccgcuuguccucaugcaggggcccgcaguuucuauaaaaaucugauauggcucgugaagaaaggaaacagcuacccaaaguuaucuaaauccuauaucaaugacaagggcaaggaaguacugguucuuuggggcauucaccaccccucaacgagcgcugaucaacagaguuuguaccagaacgccgacgcguacguguuugucgggacuucucgauauuccaaaaaguucaaaccugagaucgcaauucguccaaaggugagagauagggagggacggaugaauuacuauuggacccugguggaacccggugacaaaaucacauuugaggccacuggcaaccuagucguuccucgcuacgcuuucaccauggaaagaaacgccgggagcggaauaauuaucucggauacaccagugcaugacugcaauaccacgugucagacuccgaagggcgcaauuaacacaucucuccccuuucaaaauauccacccuaucaccauugguaaaugcccaaaguauguaaaguccacuaaacugaggcuugcuacagggcugcggaacgugcccucaauacagagucgcggauuguucggcgccaucgcgggcuuuauugaagggggauggaccgguauggucgacggcugguacggguaucaucaccagaaugaacagggaagcggcuacgccgcagaucucaaguccacgcaaaacgcuaucgacgagauaaccaauaaagugaacucuguuauugagaagaugaauacacaguucacugccguggguaaagaauuuaaccaccuggagaagcgaaucgaaaauuuaaacaagaaagucgaugacggguuccuggauaucuggaccuacaaugcugagcuccuugugcuguuggaaaacgagagaacacuagacuaucaugauagcaauguaaagaaccuguacgagaaaguuaggucacagcucaagacuaacgccaaagaaauuggcaauggauguuucgaguuuuaucacaagugcgacaacaccuguauggaaagugugaagaauggcacauacgauuauccuaaauacuccgaggaagcaaagcugaaccgggaggagaucgacggggucaaacuugaaagcacccguauuuaucagauacuggccaucuacucuacuguggcuucaaguuugguccucgugguuagccugggagcgauuuccuucuggaugugcucuaaugguucguuacaaugccgcaucuguaucuga

SEQ ID NO: 134786 - RNA, 1701 nt, Artificial Sequence
  derived and/or modified sequence opt3 from hemagglutinin__InfluenzaA__AIR93993
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucaaaggaguggcuccccugcaucuugguaagugcaacauagccggcuggauccuggggaauccugaguguggaucuuugucaacagcaaguagcugguccuacauuguugaaaccucuucgucagacaacggcacuugcuauccaggugauuuuaucgacuacgaggaacucagagagcagcugagcaguguguccucuuucgagagguuugaaauuuucccgaagacaagcuccuggcccaaucacgauucaaacaaaggggucaccgccgcuuguccuaaugcaggaaguaagagcuuuuauaaaaaccugaucuggcucgugaagaaaggcaauucuuacccaaaguuauccaagucauauauaaacgacaaaggcaaggagguacugguucuuugggggauccaucaccccagcacgagugccgaucaacagucuuuguaccagaaugcugacgccuacguguucgucggaacuucccgguauagcaaaaaguuuaaaccugaaauugcgauccgcccaaaggugcgaggucaggagggccguauggauuacuauuggacccugguggagcccggggacaaaauuacauucgaagcaacuggaaaccuagucguuccuagauacgccuuugcuauggagaggaacaccggcucggguaucauaauuucugauacaccagugcacgacugcaauaccaucugucaaacgccgaagggggccauuaacacuucccuccccuuccagaauauccauccuaucacaauuggaaagugcccaaaauauguaaagucaaccaaacugcggcuugcaacuggccugcgcaacgugcccaguauacagagcagaggcuuguuuggggcuaucgccggauucauugaagguggcuggacagggauggucgacggaugguacggcuaucaccaucagaaugagcaagguuccggguacgcggccgaucucaagucuacccagaacgcaaucgacgaaauaacgaauaaagugaacagcguuauugagaagaugaauacccaguuuacagcugugggcaaggaguucaaccaccuggaaaagaggaucgagaauuuaaacaagaaagucgaugacggauuccuggauaucuggacuuacaaugccgaacuccuugugcuguuggagaacgaacggacccuagacuaucacgauucaaauguaaagaaccuguacgagaaaguucgcagucagcucaagaacaaugcuaaggagauuggcaaaggguguuuugaguucuaucauaagugcgacacaauguguauggaauccgugaaaaacggaacuuacgauuauccuaaguacagcgaagaggccaaacugaaucgagaagagaucgacggugucaaacuugagucuaccagaauuuaucaaauacuggcaaucuacucaacaguggccaguagcuugguccucgugguuucccugggcgcuauuucuuuuuggaugugcucgaacgggagcuuacagugcaggaucuguaucuga

SEQ ID NO: 134787 - RNA, 1701 nt, Artificial Sequence
  derived and/or modified sequence opt3 from hemagglutinin__InfluenzaA__AIR94000
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucuuuccccuuucagaauauucacccuaucacaaucgguaagugcccaaaguauguaaaauccaccaagcuccgccuggccacugggcuuagaaacgugcccucaauucagaguaggggacuguucggcgcgauagccggcuuuaucgaagggggauggacagguauggucgacggcugguacggguaucaucaccagaaugaacaaggaagcggcuacgcagcugauuugaaauccacccagaacgccauugacgagaucacgaauaaggugaacucuguuauagagaaaaugaauacccaguucacagcuguggguaaggaguucaaccaccucgaaaagcggauugaaaaucugaacaaaaaggucgaugacggguuuuuagauaucuggacuuacaaugccgagcugcucgugcuucuggaaaacgagcgcaccuuggacuaucaugauagcaauguuaaaaaccuauacgagaagguacgaucacagcugaaaacaaacgcaaaggaaaucggcaauggauguuucgaguuuuaucacaagugcgacaacacuuguauggaaagugugaaaaauggcaccuacgauuauccuaaguacuccgaggaagccaaacucaacagagaggagauugacggggucaagcuggaaagcacaaggaucuaucaaauucuugcuauauacucuaccguggcgucaagucuggucuuggugguuagccucggagcaaucuccuucuggaugugcucuaaugguucgcugcagugccggauuuguaucuga

SEQ ID NO: 134788 - RNA, 1683 nt, Artificial Sequence
  derived and/or modified sequence opt3 from hemagglutinin__InfluenzaA__AIR94116
auggagaccgccagccugaucacaauucuccuuguggucacuguuuccaacgcugacaagauaugcaucggcuaccagucuacuaauucaaccgaaacaguggauacucugaccgagaacaauguacccgugacacacgcaaaagaauuguuacauaccgagcacaacgggaugcugugugccacgagucuaggacauccucucauucuggacacaugcaccaucgaaggucuuauuuauggcaauccaagcugugaucuguugcucgggggaagagagugguccuacaucgucgagaggccgucugcggugaacggccugugcuaucccgguaauguugaaaaccuggaggaacuccggucguuauucucaagcgcucgcaguuaccaacgaauacagaucuuuccugacacgauuuggaauguguccuauucugggacuagcaaggccuguuccgauucauucuaccguaguaugagauggcugacccagaaagacaacgcauauccaauccaggaugcccaauacacaaauaaccagggaaagaauauucuuuuuauguggggcaucaaccaucccccuacugacaccgcucagacaaauuuguacaccaggacggauacuacaaccagcgucgcaacugaggagauaaaccggacauucaaaccacugauuggcccccgcccucuagugaacgggcucaugggaagaaucaauuauuacuggucuguacugaagccaggucagacccuuaggauuaaguccaacggcaaucugaucgccccgugguaugggcacaucuugucaggagaaagccacggccggauucucaaaacggaccugaagcgcgguaguugcaccguucaaugucagacagagaaagggggauuaaacacuacccugcccuuucagaaugugucuaaguacgcuuucggcaacugcuccaaauauauaggcaucaagagccucaaacuugccgucgggcugcgaaaugugccuucgagaucuuccaggggauuguuuggugcgauugcaggcuucaucgaagggggauggucaggccuaguggccgguugguacggguuucagcacaguaacgaucaaggcgucggaauggcugccgaccgggauagcacacagaaggcaauagacaagauuacuuccaaaguuaauaacaucguggacaagaugaauaaacaguaugagaucauugaucaugaguucaacgaaguagagacccgucugaauaugaucaacaauaagauugacgaucaaauacaggacaucugggcuuacaacgccgaacuccuggugcuucuggagaaccagaaaacauuggaugaacacgacgcgaaugucaacaaucucuacaacaaggugaagcgcgcccugggcucuaaugcaguugaggaugggaaaggauguuuugaauuauaucauaagugcgacgaucaguguauggagaccauuagaaacgguacuuacaauaggcggaaauaucaagaggaaagcaagcuggagcgacagaaaaucgaaggcgugaagcuagagucagaagggacguacaagauccucacaauuuauaguaccgucgcuuccagccuggugauagccaugggauucgcugccuuucuuuucugggcaaugucuaacggcucaugccgcugcaauaucuguauuuga

SEQ ID NO: 134789 - RNA, 1701 nt, Artificial Sequence
  derived and/or modified sequence opt3 from hemagglutinin__InfluenzaA__AIT38333
augaagaccaucauuacacugagcuacauacucugccacguguucgcccagaaaauccauggcuccgacucuucaacugcuacgcuuugucuggggcaccaugcaguccccaacggaaccuugguuaagacaauuacuaaugaucaaaucgaggugaccaacgccacagaauuaguacagaguagcuccaccgguagaauuugcgacaauccucacaggauccuggauggcaaaaacuguacucuaauagacgcgcuccugggggauccacauugcgacgaguuucagaauaaggaaugggaucuuuucguggagcggucuaacgcuuauucggacuguuacccguauuacguccccgauuaugccucacugcgcagcuugguggcaaguuccggaacacucgaauuuaauaacgagucuuucaauuggaccggcaucagccaggacgguacguccucaaguugccgacgugggagcguuaaauccuuuuucucuagacugaacuggcugcacggacucgaguacaaguauccugcccaaaaugugacuauguuaaacaaugaugaauuugacaagcuguacauuuggggcguccaccauccaucaaccgauagcgaccagacaagucuuuacgugcagacuucuggcaggguaaccguuuccacaaaacggagccagcaaaccgugauccccaacauugggucgcgcccuugggucagaggaaucucuuccaggauaucaauucacuggacgaucgugaagccaggugacauuuugcugaucaauaguacuggcaaccuaaucgcuccccggggguauuucaaaauucgcggaggcaagagcuccauaaugcgaucugaugcaccuaucgacaacugugauagcgagugcgugacaccaaaugguaacauuccgaaugacaaacccuuucagaacgucaauagaaucaccuacgggccuuguccaagguauauaaagcagaacacucucaagcuggccacaggaaugcggaauguucccgaaaaacagacccguggcgugcuuggcgcuauugccggguucaucgagaacggaugggaggguaugguagauggcugguacggguuucgccaucaaaauucagaaggaacgggccaggcggcagaccugaagaguacccaggccgcuaucgaucaaauuaacgguaaauugaauagacucaucgggaagacaaacgagaaauuccaccagauugaaaaggaguuuuccgaaauagagggcagggugcaggaccuggagaaauaugucgaagauacuaagaucgacuuauggagcuacaaugccgagcugcucgugguucuugaaaaccagcacaccauugaucugacagacucugagaugaauaaguuguucgaacggacucgacgccaacuaagagagaacgcagaggacaugggaaacggcugcuucaaaaucuaucauaagugugauaaugcuugcaucgggucaauuaggaacggaaccuacgugcacgacgucuaccgggaugaagcccugaauaaccgcuuucagauaaaagguguggagcucaagaguggcuauaaagacuggauccuguggauuagcuucgcgaucuccugcuuucuucugugugccguauugcucggguucauuacaugggcaugccagaagggaaauaucagauguaacauaugcaucuga

SEQ ID NO: 134790 - RNA, 1698 nt, Artificial Sequence
  derived and/or modified sequence opt3 from hemagglutinin__InfluenzaA__AIT38344
augaagaucaaacugcucauucuucugugcaccuucacagccacuuacgcugacacgauauguaucggcuaucacgcaaacaauagcaccgauacaguggacacugucuuggagaagaacguuaccgugacacauuccguaaauuuacuggaagauucucacaacgggaaacuaugccuccugagaggaauugcgccccuucagcuggguaauuguucaguggccggcuggaucuuggggaacccugagugcgaaagucucauuagcaaggaguccuggucuuacaucgucgaaaaaccaaauccggagaacggaaccuguuaucccggcuacuuugcugacuaugaggaacugagggagcaacugucgucagugagcaguuucgaacgguuugagauauucccuaaggaguccucuuggccaaaucauacuguuacaggugugagcgccuccugcucauacaacgggaagggaaauuuuuauaaaaaccucuuauggcugacccgcaagaauggccuuuaccccaacuugaguaaaagcuacacgaauaacaaggaaaaagagguccugauccuauggggcgugcaccauccuucuaacauuaaggaucagcgaacucucuaucacaccgaaaaugcauacguauccguugugucaagccacuauagucguagauucacaccagagaucacuaagaggcccaaaguccgggaccaggaagggcgcauuaacuacuauuggacccugcuugagccuggagauacaaucauauuugaggccaaugguaaccugauugcuccaugguacgcauucgccuugucuagaggcuuuggguccggaaucauuaccagcaaugcuccgauggacgaaugugaggccaagugccagacgcccaggggcgcgaucaacucgucucucccuuuccaaaaugugcauccagugacuaucggugaaugucccaaauauguccgguccgcaaagcugcgcaugguuacaggguuacgaaacauuccuucaauacagaguagaggacuguuuggcgccaucgcuggcuucauugaagggggauggaccgguaugaucgauggcugguacggguaccaccaucagaaugaacagggaagcggcuaugccgcagacaaagaguccacucaaaacgcuauaaaugguauuacaaacaagguaaauucugugaucgagaaaaugaacacccaguuuacgaccguggggaaggaguucaauaagcucgagaggcggauggaaaaccuuaacaaaaaggucgaugacggcuuccuggauaucuggacauacaaugccgaguugcuagugcugcucgaaaacgagcguacucuggacuuucacgacagcaauguuaaaauucuuuaugagaaggugaaaucacagcugaagaacaaugcgaaggaaaucggaaacggcugcuucgaguuuuaccacaaauguaauaacgaaugcauggagagugucaagaaugggaccuaugauuacccaaaauauuccgaggaaagcaaguugaaccgcgagaaaauugacggagugaagcucgaaucuauggguguauaccagauacuggccaucuacucaacaguugcaaguagcuuagugcugcuagucucccucggcgcuauuucuuucuggaugugcucgaaugggagccugcaauguagaaucugcaucuga

SEQ ID NO: 134791 - RNA, 1698 nt, Artificial Sequence
  derived and/or modified sequence opt3 from hemagglutinin__InfluenzaA__AIT38360
augaagaucaaacugcucauucuucugugcaccuucacagccacuuacgcugacacgauauguaucggcuaucacgcaaacaauagcaccgauacaguggacacugucuuggagaagaacguuaccgugacacauuccguaaauuuacuggaagauucucacaacgggaaacuaugccuccugaagggaauugcgccccuucagcuggguaauuguucaguggccggcuggaucuuggggaacccugagugcgaaagucucauuagcaaagaguccuggucuuacaucgucgaaaagccaaauccggagaacggaaccuguuaucccggcuacuuugcugacuaugaggaacugagagagcaacugucgucagugagcaguuucgaaagguuugagauauucccuaaggaguccucuuggccaaaucauacuguuacaggugugagcgccuccugcucauacaacgggaaaggaaauuuuuauaagaaccucuuauggcugacccggaaaaauggccuuuaccccaacuugaguaagagcuacacgaauaacaaagaaaaggagguccugauccuauggggcgugcaccauccuucuaacauugaagaucagcgcacucucuaucacaccgagaaugcauacguauccguugugucaagccacuauagucgacguuucacaccagaaaucacuaagagacccaaagucagggggcaggagggacggauuaacuacuauuggacccugcuugagccuggugacacaaucauauuugaagccaauggcaaccugauugcuccaugguacgcauucgccuugucucgcgggcucggauccggcaucauuaccagcaaugcuccgauggaugagugugaagccaagugccagacgcccagaggugcgaucaacucgucucugccuuuucaaaaugugcauccagugacuaucggggagugucccaaauaugucagguccgcaaaguuacggaugguuacaggacugcgcaacauuccuucaauacagagucgaggccucuucggcgccaucgcuggguuuauugaaggagguuggaccggcaugaucgacgggugguacggauaccaccaucagaaugagcagggcagcgguuaugccgcagauaaagaguccacucaaaacgcuauaaaugggauuacaaacaagguaaauucugugaucgaaaagaugaacacccaguucacgaccgugggcaaggaguuuaauaaacuugaaagaaggauggagaaccugaacaaaaaggucgacgauggauucuuggacaucuggacauacaaugccgaacuacuggugcuccuggagaacgagcggacucuugauuuccacgacagcaauguuaaaaaccuguaugaaaaggugaaaucacaguugaagaauaacgcgaaggagauuggcaaugggugcuuugaguucuaccacaaauguaacaaugaaugcauggagagugucaagaacggaaccuaugacuacccaaaauauuccgaagagagcaagcucaaucgugagaaaaucgauggugugaagcuggaaucuaugggcguauaccagauuuuagccauauacucaacaguugcaaguagccuggugcuacucgucucccugggggcuaucucuuuuuggaugugcucgaacggaagccuucaaugucgcauuugcaucuga

SEQ ID NO: 134792 - RNA, 1701 nt, Artificial Sequence; identical to SEQ ID NO: 132056
  derived and/or modified sequence opt3 from hemagglutinin__InfluenzaA__AIT93147

SEQ ID NO: 134793 - RNA, 1701 nt, Artificial Sequence; identical to SEQ ID NO: 124685
  derived and/or modified sequence opt3 from hemagglutinin__InfluenzaA__AIU39700

SEQ ID NO: 134794 - RNA, 1701 nt, Artificial Sequence
  derived and/or modified sequence opt3 from hemagglutinin__InfluenzaA__AIU39702
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucuuuccccuuucagaauauucacccuaucacaaucgguaagugcccaaaguauguaaaauccaccaagcuccgccuggccacugggcuuagaaacauucccucaauacagaguaggggacuguucggcgcgaucgccggcuuuauugaagggggauggacagguaugguggacggcugguacggguaucaucaccagaaugaacaaggaagcggcuacgcagcugauuugaaauccacccagaacgccaucgacgagauaacgaauaaggucaacucugugauugagaaaaugaauacccaguucacagcuguugguaaggaguucaaccaccucgaaaagcggaucgaaaaucugaacaaaaagguggaugacggguuuuuagauaucuggacuuacaaugccgagcugcucguccuucuggaaaacgagcgcaccuuggacuaucaugauagcaaugugaaaaaccuauacgagaagguacgaucacagcugaaaaacaaugcaaaggaaauuggcaacggauguuucgaguuuuaucacaagugcgacaauacauguauggaaaguguuaaaaacggcacuuacgauuauccuaaguacuccgaggaagccaaacucaauagagaggagaucgacggggugaagcuggaaagcaccaggauuuaucaaauacuugcuaucuacucuacagucgcgucaagucugguguuggucgugagccucggagcaauuuccuucuggaugugcucuaacgguucgcugcagugccggaucuguaucuga

SEQ ID NO: 134795 - RNA, 1701 nt, Artificial Sequence; identical to SEQ ID NO: 128925
  derived and/or modified sequence opt3 from hemagglutinin__InfluenzaA__AIU39704

SEQ ID NO: 134796 - RNA, 1704 nt, Artificial Sequence
  derived and/or modified sequence opt3 from hemagglutinin__InfluenzaA__AIU46609
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggagaaaacccacaaugggaaguuaugugaucugaacggagucaaaccccuaauucucaaggacugcucaguggccgguuggcugcuuggcaauccuaugugugaugaguucaucagaguuccagaauggaguuauauaguggagagggcgaacccggcuaaugaccugugcuaccccgggaacuugaaugauuaugaggaacucaagcaucugcugagccggaucaaccacuuugagaaaauucucaucauuccuaaguccucuuggacaaaucaugaaacuucguuaggagucucagccgcauguccauaccagggcacccccagcuucuuucgcaacgugguauggcugaucaaaaagaaugacgccuauccuacaauaaaaauuaguuacaacaauaccaaccaggaggaucuuuugauccugugggguauucaccacuccaacaaugcugcagagcaaacuaaccuauauaagaauccaacaaccuacaucucuguugggacgagcacucucaaccagcgacuggugcccaagaucgccacccguucccaggucaauggacagagaggcaggauggacuucuuuuggacaauucuuaaaccuaacgaugcuauacauuucgaaucaaauggcaacuuuaucgccccagaguacgcguauaagauugugaaaaagggggacaguacuaucaugaaaagcgaaguggaguacggacacugcaauaccaagugucaaacaccgauaggugcaauuaacucuuccaugcccuuccauaauauccacccucugaccaucggcgaaugcccaaaauaugucaagucaaacaaguugguucucgccacggggcugcggaauagccccuuacgcgagaaaagaaggaagcggggacuguuuggcgcuauugccgguuucaucgaagggggauggcagggcaugguggauggcugguacggguaucaccauaguaacgaacagggaucugguuacgcagcugacaaagaguccacucagaaggccauugacggcguaacaaauaaagugaacagcauaaucgauaagaugaacacccaauuugaagcggucgggcgcgaguucaauaaccucgaacgaagaauugagaaucuuaacaagaaaauggaggacggauuucuggauguguggacuuauaaugccgaauugcuaguucugauggagaacgaaaggacacucgacuuccacgauucgaaugugaagaaccuguacgacaaaguccggcuucagcugcgugauaaugcaaaggaguugggcaacgguuguuucgaauuuuaccauaaaugcgacaaugaguguauggagucugugcgcaacgggaccuaugauuacccucaguauuccgaagaggcuagacucaagagggaagagaucucaggcguaaagcuggagaguaucggaacguaccaaauuuuaagcauauauuccaccguugccucuagccuggcucuagccaucauuguggcaggccucucacuguggaugugcaguaaugggucccuucagugccggaucuguauuuga

SEQ ID NO: 134797 - RNA, 1689 nt, Artificial Sequence
  derived and/or modified sequence opt3 from hemagglutinin__InfluenzaA__AIU46714
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugcgcguaccggaauggucuuacaucauggagaaagagaaccccaaguauucacucugcuacccuggcaguuuuaaugauuaugaagaacugaagcaucugcucagcuccgugaaacacuucgaaaaggucaaaauuuuaccaaaggacgguuggacucaacauaaaaccgaugggggaucuaaggcuugugccgugucgggcaagcagucauuuuuccgaaacaugguuuggcugaccaaaaagggccagaauuaccccguggcaaaacguagcuauaacaauacaaguggggagcagaugcuuaucauuuggggaguccaccacccuaacgacgaggaggagcaaagagccuuguaccagaagguggguacuuacguauccgcuucuacaagcacccugaauaaaagguccacgccagaaaucgcagcccggcccgagguuaacggccuagggucacgcauggaauuuaguuggacucuccuggaugugugggacaccauaaauuucgagagcacaggaaaccuugucgcuccugaguauggcuuuaagauuucuaaaagagguuccucagggaucauuaagacugaaggaacccugggcaacugcgagacaaagugucagaccccauugggcgccaucaauacgacucucccguuccauaacgugcacccccugacaaucggggaaugcccuaaauacguaaagagcgagaaauuaguccuggcgaccggacucaggaauguuccacagauugaaagucggggucuuuuuggcgcaauagccggguucaucgagggaggcuggcaagguaugguggaugggugguauggcuaccaucacucuaacgaccagggauccggcuaugcugccgauaaggagagcacucagaaagcauuugaccgcauuacaaauaagguaaacucggugaucgaaaagaugaauacccaguucgaggcugucgggaaagaauuuucuaaccuggagcgaagauuggaaaaucuaaacaagaaaauggaggacggauuccuggauguguggacguacaaugccgagcuccugguucuuauggaaaacgagaggacccuggacuuccacgauuccaaugugaagaacuuguaugacaaaguccggaugcaacuccgugauaaugugaaggaacuggguaacggcuguuuugaguucuaccauaagugcgacaacgaguguaugaacucagugaaaaaugggacauacgauuaucccaaguacgaagaggaaaguaaauuaaagcgcaaugagauaaaaggaguuaagcugagcuccaugggcguguaucagauucuagcgaucuacgccacugucgcagguucucucagccuggcuaucaugauugccgggaucucauuuuggaugugcaguaacggcucccuucagugcagaauuuguauauga

SEQ ID NO: 134798 - RNA, 1701 nt, Artificial Sequence
  derived and/or modified sequence opt3 from hemagglutinin__InfluenzaA__AIV09219
augaaggccauccuggugguccuccuuuacaccuucgcuacaacuaacgcagacauucugugcauaggcuaucacgccaauaacagcacggauaccguugacacaguguuggagaaaaauguaacugugacccauuccgucaacuuacuggaagauaagcacaaugggaaacuauguaagcucagaggaguggcgccccugcaucuugguaaaugcaacaucgcuggcuggauucuggggaauccugagugugaauugcucucuacaaccucaaguuggagcuacaucguugagacuuccucuucggacaacggaacaugcuauccaggcgauuuuauugacuacgaagaacugagggagcagcugucaagcgugaguuccuucgaacgguuugagaucuucccgaagaccucuagcuggcccgaucacgacuccaauaagggugucacggccgcauguccucaugccggggcuggaucauuuuauaaaaaccucauaugguuagugaagaaaggcaauaguuacccaaagcugagcaaaucuuauaucaacgauaagggcaaggaaguacuuguuuugugggggauucaccaucccccuacuuccgcagaccaacagcgccuguaccagaaugccgaugcuuacguguucgucggaaccucacgauauagcaaaaaguuuaaaccagagaucgccauucgucccaaggugagagaccaggaggguaggaugaacuacuauuggacacuuguggaaccuggcgauaaaaucacuuucgaggcgaccgggaaucucgucguuccacgguacgcauuugccauggaacgcaacgcuggaaguggcauaauuacaucugacaccccggugcacgacugcaacacgacuugucaaacacccaagggugccaucaauaccucccugccuuuccagaacauucacccaaucacuaucgggaaaugccccaaguauguaaagagcacaaaacuuagacuggcaaccggauugaggaaugugccuucgauucagucucggggccucuuuggcgcuauagccggguucaucgagggagguuggacgggcauggucgaugggugguacggauaucaucaccagaacgaacaaggcuccgguuacgcggccgaccugaagucaacccagaaugcaauugaugagaucacaaacaaagugaauaguguuauagacaagaugaacacucaguuuaccgcuguggggaaagaguucaaucacuuagaaaagcgcauugagaaccugaauaagaaagucgaugacggcuuccucgauaucuggacauacaacgccgaacuucugguguugcuagagaaugaacgaacucuggacuaucaugauagcaacguaaagaaucucuacgagaaaguuagaucccagcugaagaacaacgcuaaagagaucggaaauggcuguuuugaguucuaucacaagugcgacaacaccuguauggagucugugaagaaugggacauacgauuauccaaaauacagcgaagaggccaagcuaaacagggaagagauugacggagucaaacuggagucaacccggaucuaucaaauuuuggcaauauacaguacuguggccuccagccucguccuggugguuucuuuaggugcuaucucauuuuggaugugcaguaauggcagccugcagugccguauuuguaucuga

SEQ ID NO: 134799 - RNA, 1701 nt, Artificial Sequence
  derived and/or modified sequence opt3 from hemagglutinin__InfluenzaA__AIW60689
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucugacuguuaccccuaugaugucccugacuacgcaucgcuccgcucacugguggccagcaguggcacucuggaguuuacaaaugaagguuucaacuggaccgggguugcucaggauggaacguccuaugcaugcaagcgaggcucugucaagagcuuuuucucccgucucaauugguuacacaaacuggaguacaaguauccagcccuuaacgugacuaugcccaauaacgacaaauuugauaaguuguacauauggggcgugcaucacccuucaaccgacagugaccaaacaagcaucuacguacaggcuucugggagaguuacuguguccaccaaaaggucacagcagacagucauuccaaauaucggaagccggcccugggugcgcgguauuaguucuagaaucuccauauauuggaccauugugaagccuggcgauauccugcuaauuaacagcacggggaaucucaucgccccaaggggauacuucaagauccggucgggcaaaucuuccauuaugcgcucagacgcgccgauagguaacuguaacagugagugcaucacucccaaugggagcauuccuaacgauaagccauuucaaaaugucaaccgaaucacauauggagcaugucccagauacguuaaacagaauacccugaaacuugccacuggcaugaggaacgugccugaaaagcagacacggggcauauucggggcuauugccggauuuaucgagaaugguugggaaggcaugguagacgggugguauggauuccgucaccagaacuacgagggcaccggucaagcagcugaucugaaguccacgcaggccgcgaucaaucagauuaacgggaaauugaaucgccucaucgagaagaccaacgaaaaguuucaucaaauugagaaagaguucucugaaguggaaggcagaauacaggaccuggagaaguaugucgaggauacaaaaaucgacuuauggagcuacaaugccgaacugcucguggcacuugagaaccagcacacuauugaucugaccgacucagaaaugaauaaguuguucgagaggacacggaaacagcuacgagaaaacgcugaggauaugggaaacggcugcuuuaagaucuaccauaagugugacaaugccugcaucgggaguauucgcaacggaacuuaugaccacgaugcuuacagagacgaggcccugaauaacagguuccaaauaaaagguguugaacucaaguccggcuauaaagauuggauccuguggauuagcuuugcaaucucuugcuuccuucuguguguggucuugcucggguuuauuaugugggccugccagaagggaaauauccgguguaacauaugcaucuga

SEQ ID NO: 134800 - RNA, 1701 nt, Artificial Sequence
  derived and/or modified sequence opt3 from hemagglutinin__InfluenzaA__AIW60690
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucugacuguuaccccuaugaugucccugacuacgcaucgcuccgcucacugguggccagcaguggcacucuggaguuuacaaaugaagguuucaacuggaccgggguugcucaggauggaacguccuaugcaugcaagcgaggcucugucaagagcuuuuucucccgucucaauugguuacacaaacuggaguacaaguauccagcccuuaacgugacuaugcccaauaacgacaaauuugauaaguuguacauauggggcgugcaucacccuucaaccgacagugaccaaacaagccuguacguacaggcuucugggagaguuacuguguccaccaaaaggucacagcagacagucaucccaaauauuggaagccggcccugggugcgcggugugaguucuagaaucuccauuuauuggaccaucgucaagccuggcgauauacuacucauuaacagcacggggaaucugaucgccccaaggggauacuucaagauucggucgggcaaaucuuccaucaugcgcucagacgcgccgaucgguaacuguaacagugagugcauuacucccaaugggagcauaccuaacgauaagccauuucaaaauguuaaccgaaucacauauggagcaugucccagauacgugaaacagaauacccuuaagcuggccacuggcaugaggaacguaccugaaaaacagacacggggcauuuucggggcuaucgccggauuuauagagaaugguugggaaggcaugguggacgggugguauggauuccgucaccagaacuacgagggcaccggucaagcagcugauuugaaguccacgcaggccgcgauuaaucagaucaacgggaaacucaaucgccugaucgagaagaccaacgaaaaguuucaucaaauugagaaagaguucucugaagucgaaggcagaauccaggacuuagagaaguauguggaggauacaaaaauugaccuguggagcuacaaugccgaacuccuuguugcacuggagaaccagcacacuauagauuugaccgacucagaaaugaauaagcuauucgagaggacacggaaacagcugcgagaaaacgcugaggauaugggaaacggcugcuuuaagaucuaccauaagugugacaaugccugcauugggaguauccgcaacggaacuuaugaccacgaugcuuacagagacgaggcccucaauaacagguuccaaaucaaagguguggaacugaaguccggcuauaaagauuggauucuuuggaucagcuuugcaauaucuugcuuccuguugugugucgugcuccugggguuuauuaugugggccugccagaagggaaauauccgguguaacauuugcaucuga

SEQ ID NO: 134801 - RNA, 1701 nt, Artificial Sequence
  derived and/or modified sequence opt3 from hemagglutinin__InfluenzaA__AIW60691
augaagaccaucauugcccugagcuacauacucugccuuguguucgcucagaaacugcccggcaacgacaauuccacagcaacuuuguguuuagggcaccaugccgucccuaacggaacgcugguuaaggcgaucaccaaugaucaaauugaggugacaaacgcuacugagcuaguacagucuucaaguaccgguagaaucugcgacagcccacacaggauucucgauggcaaaaauuguacacugaucgacgcccuucugggggauccgcauugcgacggauuucagaacaaggaaugggauuuguucguggaacgguccaaagcauauucugacuguuaccccuaugaugucccugacuacgccucgcuccgcucacugguggcuagcaguggcacccuggaguuuacuaaugaagguuucaacuggacagggguugcacaggauggaaccuccuaugccugcaagcgaggcucugucaagagcuuuuucucccgucucaauugguuacacaaacuggaguacaaguauccagcucuuaacgugacgaugcccaauaacgacaaauuugauaaguuguacauauggggcgugcaucacccuucaacugacagugaccaaaccagacuguacguacaggccagcgggaggguuacagugucuacuaaacggucccagcagaccgucaucccaaauauuggaucacgccccugggugagagguaucagcaguaggauuucuaucuauuggacaauagugaagccuggcgauauucuacucaucaacuccaccgggaaucugauugcgccacggggauacuucaagauccgcagcggcaaaucgucuaucaugcgauccgacgcaccgauugguaacuguaacucagagugcauaacgcccaaugggaguaucccuaacgauaagccauuucaaaaugucaacagaauuacuuauggagccugucccagguacguuaaacagaauacacuuaagcuggcuaccggcaugcggaacgugccugaaaaacagacucguggcaucuucggggccauagcaggauuuauugagaaugguugggaaggcaugguagacgggugguauggauuccgccaccagaacagcgagggcacaggucaagcugccgauuugaaguccacccaggcggccaucaaucagaucaacgggaaacucaauagacugauugagaagacgaacgaaaaguuucaucaaaucgagaaagaguucucugaaguggaaggcaggauucaggacuuagagaaguacgucgaggauaccaaaauagaccuguggagcuauaaugcagaacuccuuguggcucuggagaaccagcacacaaucgauuugacugacucagaaaugaauaagcuauucgagcggacccgaaaacagcugcgcgaaaacgccgaggauaugggaaacggcugcuuuaagauuuaccauaagugugacaaugcuugcaucgggaguaucagaaacggaacauacgaccacgauguuuauagggacgaggcccucaauaaccgguuccaaauuaaagguguggaacugaaguccggcuacaaagauuggauacuuuggaucagcuuugcaauuucuugcuuccuguugugugucgugcuccugggguuuaucaugugggccugccagaagggaaauauucgcuguaacaucugcauauga

SEQ ID NO: 134802 - RNA, 1701 nt, Artificial Sequence
  derived and/or modified sequence opt3 from hemagglutinin__InfluenzaA__AIW60692
augaagaccaucauugcccugagcuacauacucugccuuguguucgcucagaaacugcccggcaacgacaauuccacagcaacuuuguguuuagggcaccaugccgucccuaacggaacgcugguuaaggcgaucaccaaugaucaaauugaggugacaaacgcuacugaacugguacagucuucaaguaccgguagaaucugcgacagcccacacaggauucucgauggcaaaaauuguacacugaucgacgcccuucugggggauccgcauugcgacggauuucagaacaaggagugggauuuguucguggaacgguccaaagcauauucugacuguuaccccuaugaugucccugacuacgccucgcuccgcucacugguggcuagcaguggcacccuggaguuuacuaaugaagguuucaacuggacagggguugcacaggauggaaccuccuaugccugcaagcgaggcucugucaagagcuuuuucucccgucucaauugguuacacaaacuggaguacaaguauccagcucuuaacgugacgaugcccaauaacgacaaauuugauaaguuguacauauggggcgugcaucacccuucaacugacagugaccaaaccagccuguacguacaggccucugggagaguuacaguguccacuaaaaggucacagcagaccgucaucccaaauauuggaagccggcccugggugcgcgguaucaguucuagaauuuccaucuauuggacaauagugaagccuggcgauauucuacucaucaacagcaccgggaaucugauugcgccaaggggauacuucaagauccggucgggcaaaucuuccaucaugcgcucagacgcaccgauugguaacuguaacagugagugcauaacgcccaaugggagcaucccuaacgauaagccauuucaaaaugucaaccgaauuacuuauggagccugucccagauacguuaaacagaauacacuuaagcuggcuaccggcaugaggaacgugccugaaaaacagacucggggcaucuucggggccauagcaggauuuauugagaaugguugggaaggcaugguagacgggugguauggauuccgucaccagaacuccgagggcacaggucaagcugccgauuugaagucuacccaggcggccaucaaucagaucaacgggaaacucaaucgccugauugagaagacgaacgaaaaguuucaucaaaucgagaaagaguucagcgaaguggaaggcaggauucaggacuuagagaaguacgucgaggauaccaaaauagaccuguggucauauaaugcagaacuccuuguggcucuggagaaccagcacacaaucgauuugacugacagugaaaugaauaagcuauucgagagaacccggaaacagcugcgagaaaacgccgaggauaugggaaacggcugcuuuaagauuuaccauaagugugacaaugcuugcaucggguccauccgcaacggaacauacgaccacgauguuuauagagacgaggcccucaauaacagguuccaaauuaaagguguggaacuaaagagcggcuacaaagauuggauacuuuggaucucuuuugcaauuucaugcuuccuguugugugucgugcuccugggguuuaucaugugggccugccagaagggaaauauucgguguaacaucugcauauga

SEQ ID NO: 134803 - RNA, 1701 nt, Artificial Sequence
  derived and/or modified sequence opt3 from hemagglutinin__InfluenzaA__AIW60693
augaagaccaucauugcccugagcuacauacucugccuuguguucgcucagaaacugcccggcaacgacaauuccacagcaacuuuguguuuagggcaccaugccguccugaacggaacgcuaguuaagaccaucacaaaugaucaaauugaggugacuaacgcgaccgaacucguacagaauagcucaacagguagaaucugcgacaguccucaccagauucuggauggcgagaacuguacccuuaucgacgcucuguugggggauccacauugcgacggauuucagaauaaagaaugggaucucuucguggagaggagcaaggccuauuccaacuguuacccguaugacguccccgauuacgcaucucugcggucgcugguggccucaagcggcacucucgaauuuaauaacgagaguuucaauuggacagguguugcucaaaacgggaccuccucugcaugcaaacgccgaagcauaaaguccuuuuucucacguuuaaauuggcugcaccagcuuaaguauaaauacccugccuugaacgugacgaugccaaauaacgagaaguuugacaaacuguauaucuggggaguccaucaccccaguacugauagcgaccagaccucuauuuacgcucaggccuccggcagagugacaguaucaacuaagaggagccaacagaccguuaucccuaacauuggcagucggccaugggugcgcggggucucuuccaucauaagcauuuacuggacaaucgugaaacccggagauauucuacucaucaauucgaccgguaaccugaucgcgccuagaggcuauuucaagauuaggucugggaaguccucaauaaugcggagugacgcaccaaucggaaaauguaauagcgaaugcauuacgccgaacggcuccauccccaaugacaagccuuuucagaacgugaaucgcauaacuuacggugccuguccacgauaugucaaacagaacacacuuaagcuggcuaccgggaugagaaauguucccgagaaacaaacuaggggaauuuucggcgccaucgcaggcuuuaucgaaaacgggugggagggaaugguggaugguugguacggcuuccggcaccaaaauucugaggggacaggacaggcugccgacuugaagucuacccaggcggccauuaaccagaucaauggcaaacucaaccgucugauugaaaagacgaaugagaaguuucaucagauagaaaaagaguucucagaaguagagggucgcauccaggauuuagagaaguauguggaagacaccaaaauugaucuguggaguuacaacgcagagcuccuugucgcucuggaaaaccaacacacaaucgacuugacugauuccgagaugaauaagcuauucgaaagaaccaggaaacagcugcgggagaacgccgaggacauggggaauggcugcuuuaagaucuaucauaagugugauaacgcuugcauuggaagcauacgaaauggcacauacgaccacgauguguaccgcgacgaagcccucaacaauagauuccagaucaaagggguugagcugaagucuggauauaaagacuggauucuuuggaucucauuugcaauuaguugcuuccuguugugugugguccuccuggguuuuaucaugugggccugccagaagggcaacauaagguguaauaucugcauuuga

SEQ ID NO: 134804 - RNA, 1701 nt, Artificial Sequence
  derived and/or modified sequence opt3 from hemagglutinin__InfluenzaA__AIW60694
augaagaccaucauugcccugagcuacauacucugccuuguguucgcucagaaacugcccggcaacgacaauuccacagcaacuuuguguuuagggcaccaugccguccugaacggaacgcuaguuaagaccaucacaaaugaucaaauugaggugacuaacgcgaccgaacucguacaaaauucuucaacagguagaaucugcgacaguccucaccagauucuggauggcgagaacuguacccuuaucgacgcucuguugggggauccacauugcgacggauuucagaauaaagaaugggaucucuucguggagaggagcaaggccuauuccaacuguuacccguaugacguccccgauuacgcaucucugcggucgcugguggccucaagcggcacucucgaauuuaauaacgagaguuucaauuggacagguguugcucagaacgggaccuccucugcaugcaaacgccgaagcauaaaguccuuuuucucacguuuaaauuggcugcaccagcuuaaguauaaauacccugccuugaacgugacgaugccaaauaacgagaaguuugacaaacuguauaucuggggaguccaucaccccaguacugauagcgaccagaccucucuauacgcucaggccuccggcagagugacaguaucaacuaagaggagccaacagaccguuauuccuaacaucggcagucggccaugggugcgcggggucucuuccagaauuagcaucuacuggacaauagugaaacccggagauauucuccugaucaauucgaccgguaaccuuauugcgccuaggggcuauuucaagauccggucugggaaguccucaaucaugcgcagugacgcaccaauuggaaaauguaauagcgaaugcauaacgccgaacggcuccauccccaaugacaagccuuuucagaacgugaaucgaauuacuuacggugccuguccaagauaugucaaacagaacacacugaaguuggcuaccgggaugaggaauguucccgagaaacaaacucggggaaucuucggcgccauagcaggcuuuauugaaaacgggugggagggaaugguggaugguugguacggcuuccgucaccaaaauucugaggggacaggacaggcugccgaccucaagagcacccaggcggccaucaaccagaucaauggcaaacugaaccgcuuaauugaaaagacgaaugagaaguuucaucagaucgaaaaagaguucucagaaguagaggguaggauucaggaucuggagaaguauguggaagacaccaaaauagaucucuggaguuacaacgcagagcuucuggucgcuuuggaaaaccaacacacaaucgaccuaacugauuccgagaugaauaagcuguucgaaagaacccggaaacagcuccgagagaacgccgaggacauggggaauggcugcuuuaagauuuaucauaagugugauaacgcuugcaucggaagcauccgcaauggcacauacgaccacgauguguacagagacgaagcccugaacaauagguuccagauuaaagggguugagcuuaagucuggauauaaagacuggauacuguggaucucauuugcaauuaguugcuucuugcucugugugguccuguuagguuuuaucaugugggccugccagaagggcaacauucgguguaauaucugcauauga

SEQ ID NO: 134805 - RNA, 1701 nt, Artificial Sequence
  derived and/or modified sequence opt3 from hemagglutinin__InfluenzaA__AIW60695
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaacuauaaguacccagcccuuaaugugacgaugcccaacaacgagaaauuugacaaguuguauauauggggcguccaucacccuagcacugauucugaccagaucuccauuuacgcucaggccccaggccgugugaccguaucaacaaaaagaagccaacagacuguuauccccaauauugggaguaggccuugggugcggggagucucuuccaucauaagcauuuacuggaccaucgugaagccaggugauauucugcuaaucaacuguacaggcaaucucaucgcgccgcgcggguauuucaaaauuagaucgggaaagucuuccauaaugaggucagacgcaaguaucggcaagugcaacagcgaauguauuacccccaaugguuccaucccuaacgacaaaccauuucagaaugugaaccggauaacguacggggccugcccccgcuaugucaagcagaauacucugaaacuugcuacaggaaugcgaaacguuccugagaagcaaaccagaggcauuuucggcgccaucgcaggguuuaucgaaaauggaugggaggguaugguggauggcugguacggguucaggcaccagaacucugagggaacuggccaggcugccgaccugaaaagcacacaagcggccauuaaucagaucaacgguaaguugaaucggcucauugagaaaaccaacgaaaaguuucaucagauagaaaaggaguucucagaaguagaggggcguauccaggaucuggagaaauauguggaagacacgaagauugauuuauggaguuacaacgcagagcugcucgucgcucuugaaaaucaacacaccaucgaccugacagauuccgagaugaacaaauuguucgaacgcacuaagaaacagcuaagagagaaugccgaggacaugggcaacggauguuuuaagaucuaucauaagugcgauaaugcuugcauuggcagcauaaggaacgggaccuacgaccacgauguguaccgggacgaagcccugaauaaccgauuccagaucaaaggaguugagcucaagucugguuauaaagacuggauucuguggaucucauuugcaauuaguuguuuccuucugugcguggucuugcucggcuuuaucaugugggccugucagaaggggaauauacgcugcaacaucuguauuuga

SEQ ID NO: 134806 - RNA, 1701 nt, Artificial Sequence
  derived and/or modified sequence opt3 from hemagglutinin__InfluenzaA__AIW60696
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugaccaaaauggaaccucuagcgcuugcaaacggcgcuccaacaagucauuuuucagucgacucaauugguuacaccagcugaaguauaaauacccagcacuuaacguggccaugcccaauaacgagaaguuugauaaauuguauauauggggcguccaucacccuagcacggacucugaucagaucucccuguacgcucaggccccaggccgugugacuguaucaaccaagagaagccaacagacaguuauucccaacaucgggaguaggccuugggugcggggagucucuucccgcauuagcaucuacuggacuauagugaaaccaggugacauucuacucaucaauuguaccggcaaccugauugcgccgagaggguauuucaagaucaggucgggaaagucuuccaucaugcggucagacgcaaguauuggcaaaugcaauagcgaauguauaacacccaacgguuccaucccuaaugauaagccauuucagaacgugaaucgcauuaccuacggggccugcccccgauaugucaaacagaacacgcuuaagcuggcuacuggaaugagaaauguuccugagaaacaaacaaggggcaucuucggcgccauagcaggguuuauugaaaacggaugggaggguaugguggacggcugguacggguuccggcaccaaaauucugagggaaccggccaggcugccgauuugaaaagcacucaggcggccaucaaccagaucaaugguaaacucaaccgucugauugaaaagacaaaugagaaguuucaucagaucgaaaaagaguucucagaaguagaggggcgcauucaggacuuagagaaguauguggaagauaccaaaauagaccuguggaguuacaacgcagagcuccuugucgcucuggaaaaccaacacacgaucgauuugaccgacuccgagaugaauaagcuauucgaaagaacaaagaagcagcugagggagaacgccgaggauaugggcaauggauguuuuaagauuuaucauaaaugcgacaacgcuugcaucggcagcauccggaaugggacuuacgaucacgacguguaccgagacgaagcccucaacaaucgcuuccagauuaagggaguugagcugaaaucugguuauaaggauuggauacuuuggaucucauuugcaauuaguuguuuccuguugugcgugguccuccugggcuuuaucaugugggccugucagaaagggaacauuagaugcaauaucuguauauga

SEQ ID NO: 134807 - RNA, 1701 nt, Artificial Sequence
  derived and/or modified sequence opt3 from hemagglutinin__InfluenzaA__AIW60697
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugaucaugcaucguugaggucacucguggccagcagugguacucuggaguuuaacaaugaauccuucgacuggacagggguuacccagaacggaacgucuagcuccugcaagcggcgcucaaauaagagcuuuuucagucgacugaacuggcucacucacuuaaaauacaaguauccagcucugaaugugaccaugcccaacaaugagaaauuugauaaacuuuacaucuggggcguccaucacccugacacagauucugugcagauuuccuuguaugcacaggccucaggccguaucacuguaagcaccaagagaagucaacagacaguuauuccaaacaucgggucuaggccccgggugcgcgacauauccagcagaauuucgaucuacuggaccauugucaagccuggagacauccugcuaaucaacucuacggguaaucucauugcuccaaggggcuacuucaagauacgguccgggaaaucaaguaucaugcgcagcgaugccccgauuggaaaguguaacuccgagugcaucacucccaauggcucuauaccuaacgacaaaccauuucagaaugugaaccgaauuacauauggugcgugucccagauacgugaagcagaauacccugaaacuugcaacugggaugaggaacgucccugaaaagcaaacacggggaaucuucggcgccaucgcuggcuuuauugagaaugggugggaaggaaugguugaugguugguauggcuuccgucaccagaacagcgaggggaccggacaggccgcagaccugaaaucaacgcaagcugccaucaaucagauuaacggcaaguugaaucgccucauagguaagaccaacgagaaauuucaucagaucgaaaaggaguucagugaaguggaggggaggauucaggaucuggaaaaauacguagaggacacaaagaucgauuuaugguccuauaaugcggagcugcucguggcccuugaaaaccaacacacuaucgaccugaccgauagcgagaugaacaaauuguucgaaagaacaaagaagcagcuacgggagaaugcagaagacaugggcaacggaugcuuuaaaauuuaccauaagugugauaaugcuugcauaggcucuauccgaaacgggacuuaugaccacgacgucuaccgcgaugaggcccugaauaacagauuccagauuaaaggaguggagcucaagucagguuacaaagacuggauccuguggauuaguuuugcuaucagcugcuuccuucuguguguugccuugcucggcuuuauaaugugggcaugccagaaggggaauaucagguguaacauuugcaucuga

SEQ ID NO: 134808 - RNA, 1701 nt, Artificial Sequence
  derived and/or modified sequence opt3 from hemagglutinin__InfluenzaA__AIW60698
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugaucaugcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucacuuaaaauacaaguauccagcacugaaugugaccaugcccaacaaugagaaauuugauaaacuuuacaucuggggcguccaucacccuggcacagacagcgaucagauuucuuuguaugcccaggcuuccgggcguaucacugugucaaccaagagaagccaacagacaguaauuccaaacaucggaaguaggccccggguucgcgacauaucuuccagaauuagcaucuacuggaccauugugaagccuggugacauccugcuaaucaacucgacgggcaaucucauugccccaaggggguacuucaagauacggucuggaaaauccucaaucaugcgcagugaugcgccgauuggcaaguguaacagcgagugcaucacucccaaugguuccauaccuaacgacaaaccauuucagaaugucaaccgaauuacauauggggcaugucccagauacgugaagcagaauacccugaaacuugccacuggaaugaggaacgugccugaaaagcaaacacggggcaucuucggcgcuaucgccggguuuauugagaauggaugggaagguauggucgauggcugguauggguuccgucaccagaacucugagggaaccggccaggcagcugaccugaaaagcacgcaagccgcgaucaaucagauuaacgguaaguugaaucgccucauagggaagaccaacgagaaauuucaucagaucgaaaaggaguucucagaaguugagggcaggauucaggaucuggaaaaauacguggaggacacaaagaucgauuuauggaguuauaaugccgagcugcucguagcacuugaaaaccaacacacuaucgaccugaccgauuccgagaugaacaaauuguucgaaagaacaaagaagcagcuacgggagaaugcugaagacaugggaaacggcugcuuuaaaauuuaccauaagugugauaaugccugcauagggagcauccgaaacggaacuuaugaccacgacguguaccgcgaugaggcucugaauaacagauuccagauuaaaggugucgagcucaagucuggcuacaaagacuggauccuguggauuucauuugccaucaguugcuuccuucuguguguggcauugcucggguuuauaaugugggccugccagaagggaaauaucagguguaacauuugcaucuga

SEQ ID NO: 134809 - RNA, 1701 nt, Artificial Sequence
  derived and/or modified sequence opt3 from hemagglutinin__InfluenzaA__AIW60699
augaagaccaucauugcccugagcuacauacucugccuuguguucgcucagaaacugcccggcaacgacaauuccacagcaacuuuguguaucgggcaccaugccgucccuaacggaacgauuguuaagaccaucacaaaugaucaaauugaggugacuaacgcgaccgaauuaguacagucuucaaguacagguggcaucugcgacagcccacaccagauacuggauggggagaauuguacccuaaucgacgcucuccugggagauccgcagugcgacggcuuucaaaacaaaaagugggaucuuuucguggaaagauccaaagccuauucuaauuguuaccccuaugacgucccugauuacgcaucgcugaggucauugauugccagcagugguacucucgaguuuaacaaugaauccuucaacuggacaggggugacccagaauggaacgucuagcgcuugcaagcggcgcuccaacaauucauuuuucagucgacugaacuggcugacucaucucaaguuuaaauauccagcauuaaauguuaccaugcccaacaacgaggaguucgacaagcuguacaucuggggcgugcaccauccugucacagauaaugaccagauuagccuuuaugcccaggcuucuggcaaaaucacuguguccaccaagcguucacaacagacaguaauaccaaacauugggagcagacccaggguucgggauaucccuagucgcauuucuaucuacuggaccaucgugaaaccaggagacauuuugcugauaaaguccacggguaaucuaaucgccccgagaggcuacuuuaagauuaggagcgggaaaucgucuaucaugcgguccgacgcgcccauaggaaaguguaacucagaaugcauuacuccuaauggcaguaucccaaacgauaaacccuuccagaaugucaaccgcaucacauauggugcauguccucgauacgugaagcagaauacccucaaacuggccacugggaugagaaacgugccagagaagcaaacaaggggaauuuuuggcgcuaucgccggcuucauugaaaaugggugggagggaauggucgacgguugguauggcuuucggcaccagaacagcgaggggauaggacaggcagcugaucuuaaauccacccaagccgcgaucgaccagauuaauggcaagcugaaccguuugaucgguaagacgaaugaaaaauuccaccagaucgagaaggaguucucugaaguugaagggcgcauucaggaucucgagaaauacguggaggacaccaagauagaucuguggagcuauaacgccgaauuacugguagcacucgagaaccaacauacaaucgaccuuacugauucagaaaugaauaaacuguuugaggaaaccaagaagcaguugagagagaacgcugaggacaugggcaauggaugcuucaaaauuuaccacaagugugauaacgccugcaucggcaguauuaggaaugggacauaugaccaugacguguaccgggaugaagcucuaaacaaucgauuucagaucaaaggagucgagcugaaguccgguuacaaagacuggauacucuggaucagcuucgccauuucuugcuuucugcuuuguguggcacuguugggcuucaucaugugggccugccagaaggggaacauucgcuguaauaucugcauauga

SEQ ID NO: 134810 - RNA, 1701 nt, Artificial Sequence
  derived and/or modified sequence opt3 from hemagglutinin__InfluenzaA__AIW60700
augaagaccaucauugcccugagcuacauacucugccuuguguucgcucagaaacugcccggcaacgacaauuccacagcaacuuuguguaucgggcaccaugccgucccuaacggaacgauuguuaagaccaucacaaaugaucaaauugaggugacuaacgcgaccgaauuaguacagucuucaaguacagguggcaucugcgacagcccacaccagauacuggauggggagaauuguacccuaaucgacgcucuccugggagauccgcagugcgacggcuuucaaaacaaaaagugggaucuuuucguggaaagauccaaagccuauucuaauuguuaccccuaugacgucccugauuacgcaucgcugaggucauugauugccagcagugguacucucgaguuuaacaaugaauccuucaacuggacaggggugacccagaauggaacgucuagcgcuugcaagcggcgcuccaacaauucauuuuucagucgacugaacuggcugacucaucucaaguuuaaauauccagcauuaaauguuaccaugcccaacaacgaggaguucgacaagcuguacaucuggggcgugcaccauccuggcacagauaaugaccagauuagccuuuaugcccaggcuucugggaaaaucacugucuccaccaagcguucacaacagacagugauaccaaacauuggaagcagacccaggguacgggauaucccuagucgcauuucuaucuacuggaccaucguuaaaccaggugacauuuugcugauaaauuccacgggcaaccuaaucgccccgagaggguacuuuaagauuaggagcggaaagucgucuaucaugcgguccgacgcgcccauaggcaaauguaauucagaaugcauuacuccuaacgguaguaucccaaaugauaagcccuuccagaacgugaaucgcaucacauauggggcauguccucgauacgucaaacagaacacccucaagcuggccacuggaaugagaaaugugccagagaaacaaacaaggggcauuuuuggcgcuaucgccggguucauugaaaacggaugggaggguaugguggacggcugguauggguuucggcaccagaauagcgagggaauaggccaggcagcugaucuuaaguccacccaagccgcgaucgaccagauuaacgguaaacugaaucguuugaucgggaagacgaacgaaaaguuccaccagaucgagaaagaguucucugaagucgaaggccgcauucaggaucucgagaaguacguugaggacaccaaaauagaucuguggagcuauaacgccgaauuacugguggcacucgagaaucaacauacaaucgaccuuacugauucagaaaugaacaagcuguuugaggaaaccaaaaagcaguugagagagaaugcugaggacaugggaaacggcugcuucaagauuuaccacaaaugugauaaugccugcaucgggaguauuaggaacggaacauaugaccaugacguauaccgggaugaagcucuaaauaaccgauuucagaucaaggguguggagcugaaauccggcuacaaggacuggauacucuggaucagcuucgccauuucuugcuuucugcuuugugucgcacuguugggguucaucaugugggccugccagaaaggaaauauucgcuguaacaucugcauauga

SEQ ID NO: 134811 - RNA, 1701 nt, Artificial Sequence
  derived and/or modified sequence opt3 from hemagglutinin__InfluenzaA__AIW60701
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacagucuucaaguaccggugagauuugcgacagcccacaccagauccuagauggcgaaaauuguacucucauagacgcgcugcuuggggauccgcagugcgacggauuucaaaacaaaaagugggaucuguucguggagagauccaaggcuuauucuaauuguuaccccuaugacgucccugauuacgccucguugaggucacucguggcaagcaguggcacacuggaauuuaacaaugaguccuucaacuggaccgguguuacgcagaaugggacuucuagcgccugcauccggcgcuccaacaauucauuuuucagucgacugaacuggcucacccauuuaaaguuuaaguauccagcucugaaugugacaaugcccaacaacgagaaauucgacaaacuuuacauuuggggaguccaccauccuggcacugauaaugaccagaucuuuccauaugcacaggccagcggccguauuaccgugucuacaaaaagaucccaacagaccguaauccccaacauagggucaaggccucggguucgcaauauuccaagcagaaucaguauuuacuggacgaucgugaagccgggagauaucuugcugauuaacucuacugguaaucuaauagcucccaggggcuacuucaaaauccgguccgggaaaagcucgauuaugcgcucugacgccccuaucggaaaguguaacuccgaaugcauaacaccaaauggcucaauucccaacgacaaaccuuuucagaaugucaaccgaaucaccuauggugcguguccaagauacgugaagcagaauacucucaaacuggcaacagggaugaggaacgugcccgagaagcaaacccggggaaucuucggcgccauugcuggcuuuaucgaaaaugggugggagggaauggucgaugguugguauggcuuccgucaccagaacagugaggggauuggacaggccgcagaccuuaaaagcacgcaagcugccauagaucagaucaauggcaagcugaaccgcuugauugguaaaaccaacgaaaaguuccaccagaucgagaaggaauuuuccgagguugaagggagaauccaggaccucgagaaauacguggaggauacaaagauugaccuguggucuuauaaugcggaauuacugguagcccucgagaaccaacauacuauagaucuuaccgacagcgaaaugaauaaacuguucgagaagacaaagaagcaguugagggaaaacgcagaggauaugggcaauggaugcuuuaagaucuaccacaaaugugacaacgcuugcauuggcucaauccggaaugggacuuaugaucaugacguguaccgagacgaggcccuaaacaaucgcuuccagauuaagggagucgaacugaaaagugguuacaaggauuggauccucuggauauccuuugcuaucagcugcuuccugcuuuguguggcccuguugggcuuuauuaugugggcaugccagaaagggaacaucagauguaauauuugcaucuga

SEQ ID NO: 134812 - RNA, 1701 nt, Artificial Sequence
  derived and/or modified sequence opt3 from hemagglutinin__InfluenzaA__AIW60702
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacagucuucaaguaccggugagauuugcgacagcccacaccagauccuagauggcgaaaauuguacucucauagacgcgcugcuuggggauccgcagugcgacggauuucaaaacaaaaagugggaucuguucguggagagauccaaggcuuauucuaauuguuaccccuaugacgucccugauuacgccucguugaggucacucguggcaagcaguggcacacuggaauuuaacaaugaguccuucaacuggaccgguguuacgcagaaugggacuucuagcgccugcauccggcgcuccaacaauucauuuuucagucgacugaacuggcucacccauuuaaaguuuaaguauccagcucugaaugugacaaugcccaacaacgagaaauucgacaaacuuuacauuuggggaguccaccauccuggcacugauaaugaccagaucuuuuuguaugcacaggccagcggccguauuaccgugucuacaaaaagaucccaacagaccguaaucccaaacauagggucaaggccccggguucgcaauauuccuagcagaaucaguauuuacuggacgaucgugaagccaggagauauccugcuaauuaacucuacugguaaucucauagcuccgaggggcuacuucaaaauccgguccgggaaaagcucgauuaugcgcucugacgcccccaucggaaaguguaacuccgaaugcauaacaccuaauggcucaauuccaaacgacaaacccuuucagaaugucaaccgaaucaccuauggugcguguccuagauacgugaagcagaauacucugaaacuugcaacagggaugaggaacgugccagagaagcaaacccggggaaucuucggcgccauugcuggcuuuaucgaaaaugggugggagggaauggucgaugguugguauggcuuccgucaccagaacagugaggggauuggacaggccgcagaccugaaaagcacgcaagcugccauagaucagaucaauggcaaguugaaccgccucauugguaaaaccaacgaaaaguuccaccagaucgagaaggaauuuuccgagguugaagggagaauccaggaccuggagaaauacguggaggauacaaagauugacuuauggucuuauaaugcggaacugcucguagcccuugagaaccaacauacuauagaucugaccgacagcgaaaugaauaaauuguucgagaagacaaagaagcagcuaagggaaaacgcagaggauaugggcaauggaugcuuuaagaucuaccacaaaugugacaacgcuugcauuggcucaauccggaaugggacuuaugaucaugacguguaccgagacgaggcccugaacaaucgcuuccagauuaagggagucgaacucaaaagugguuacaaggauuggauccuguggauauccuuugcuaucagcugcuuccuucuguguguggccuugcucggcuuuauuaugugggcaugccagaaagggaacaucagauguaauauuugcaucuga

SEQ ID NO: 134813 - RNA, 1701 nt, Artificial Sequence; identical to SEQ ID NO: 134557
  derived and/or modified sequence opt3 from hemagglutinin__InfluenzaA__AIZ07211

SEQ ID NO: 134814 - RNA, 1701 nt, Artificial Sequence
  derived and/or modified sequence opt3 from hemagglutinin__InfluenzaA__AIZ07212
augaagaccaucauggcccugagcuacauucucugccuuguguucgcucagaaacugcccggcaacgacaauuccacagcaacuuuguguuuagggcaccaugccgucccuaacggaacgauaguuaagaccaucacaaaugauagaauugaggugacuaacgcgaccgaacugguacaaaauucuucaaucggugagauuugcgacaguccacaccagauccuagauggcgaaaacuguacacucauagacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauccgcggaagcaauuccucauuuuucagucgacugaacuggcucacccauagcaauuuuaaguauccagccuuaaacgugacgaugcccaacaaugagcaguucgacaagcuguacauuuggggcguccaccauccuggcacugauaaagaccagaucuuucuuuaugcucagucuuccgggcguauuaccgugucaacaaagagaagccaacaggccguaaucccaaacauaggaaguaggccccggauucgcaauaucccuucuagaauuuccaucuacuggacuaucguuaaaccaggugauauuuugcugauaaacagcaccggcaaucuaaucgcgccgaggggguacuucaagauucggucgggaaaaucuuccaucaugcgcucagacgcacccauaggcaaguguaagagugaaugcauuacaccuaacgguagcaucccaaaugacaaacccuuucagaacgugaaucgaaucaccuauggggccuguccuagauacgucaagcaguccacgcucaaacuggcuacuggaaugaggaacgugccagagaagcaaacacggggcauuuucggcgccaucgcaggguuuauugaaaauggaugggaggguaugauggauggcugguauggguuccgucaccagaacucugagggacgcggccaggcugccgaccuuaaaagcacccaagcggccauagaucagaucaaugguaagcugaacagauugauugggaaaacuaaugaaaaguuccaccagaucgagaaggaauuuucagagguggaaggcaggauccaggaccucgagaaauacgucgaggauacaaagauugaccuguggaguuauaacgcagaauuacugguugcucucgagaaccaacauaccauagaucuuacggacuccgaaaugaauaaacuguucgagaagaccaaaaagcaguugcgggaaaacgccgaggauaugggaaauggcugcuuuaagaucuaccacaaaugugacaacgcuugcauugggagcauccgaaauggaacauaugaucaugacguguaccgcgacgaggcccuaaacaauagauuccagauuaaggguguagaacugaaaucuggcuacaaggauuggauccucuggauaucauuugcaaucaguugcuuccugcuuuguguggcccuguugggguuuauuaugugggcuugccagaaaggaaacaucagguguaauauuugcaucuga

SEQ ID NO: 134815 - RNA, 1683 nt, Artificial Sequence
  derived and/or modified sequence opt3 from hemagglutinin__InfluenzaA__AJD78175
auggagaccgccagccugaucacaauucuccuuguggucacuguuuccaacgcugacaagauaugcaucggcuaccagucuacuaauucaaccgaaacaguggauacucugaccgagaacaauguacccgugacacacgcaaaagaauuguuacauaccgagcacaacgggaugcugugugccacgagucuaggacaaccucucauucuggacacaugcaccaucgaaggucuuauuuauggcaauccaagcugugaucuguugcucgggggaagagagugguccuacaucgucgagaggccgucugcggcuaacggccugugcuaucccgguaauguggaaaaccuggaggaacuccggucguuauucucaagcgcccgcaguuaccagcgaauacagaucuuuccugacacgauuuggaauguuuccuauucugggacuagcaaggcauguuccgauucauucuaccguaguaugagauggcugacccagaaagacaacacauauccaauccaagaugcccaguacacuaauaaccagggaaagaauauucuuuuuauguggggcaucaaccaucccccuaccgacacagcucagaccaauuuguacacgaggacugauacaaccacuagcguggcaacagaggagauaaaccggaccuucaaaccacugauuggcccccgcccucuagucaacgggcucaugggaagaaucaauuauuacuggucugugcugaagccaggucaaacgcuuaggauuaaguccaacggcaaucugaucgccccgugguaugggcacaucuugucaggagaaagccauggccggauucucaaaaccgaccugaagcgcgguaguugcacaguacagugucagacugagaaagggggauuaaacaccacacugcccuuucagaauguuucuaaguacgcuuucggcaacugcuccaaauauauaggcaucaagagccucaaacuugccguggggcugcgaaaugucccuucgagaucuuccaggggauuguuuggugcgauugcaggcuucaucgaagggggauggucaggccuaguggccgguugguacggguuucaacacaguaacgaucagggcgugggaauggcugccgaccgggauagcacucagaaggcaauagacaagauuaccuccaaagucaauaacaucguugacaagaugaauaaacaauaugagaucauugaucacgaguucaacgaaguggagacacgucugaauaugaucaacaauaagauugacgaucagauacaggacaucugggcuuacaacgccgaacuccugguacuucuggagaaccagaaaaccuuggaugaacaugacgcgaaugugaacaaucucuacaacaaggucaagcgcgcccugggcucuaaugcaguggaggaugggaaaggauguuuugaauuauaucacaagugcgacgaucaauguauggagacuauuagaaacgguacguacaauaggcggaaauaucaggaggaaagcaagcuggagcgacagaaaaucgaaggcguuaagcuagagucagaagggacauacaagauccucaccauuuauaguacuguggcuuccagccuggucauagccaugggauucgcugccuuucuuuucugggcaaugucuaacggcucaugccgcugcaauaucuguauuuga

SEQ ID NO: 134816 - RNA, 1683 nt, Artificial Sequence
  derived and/or modified sequence opt3 from hemagglutinin__InfluenzaA__AJD78187
auggagaccgccagccugaucacaauucuccuuguggucacuguuuccaacgcugacaagauaugcaucggcuaccagucuacuaauucaaccgaaacaguggauacucugaccgagaacaauguacccgugacacacgcaaaagaauuguuacauaccgagcacaacgggaugcugugugccacgagucuaggacauccucucauucuggacacaugcaccaucgaaggucuuauuuauggcaauccaagcugugaucuguugcucgggggaagagagugguccuacaucgucgagaggccgucugcggugaacggccugugcuaucccgguaauguugaaaaccuggaggaacuccggucguuauucucaagcgcucgcaguuaccaacgaauacagaucuuuccugacacgauuuggaauguguccuauucugggacuagcaagaccuguuccgauucauucuaccguaguaugagauggcugacacagaaagacaacgccuauccaauccaggaugcacaauacacuaauaaccagggaaagaauauucuuuuuauguggggcaucaaccaucccccuaccgacacaacccagacgaauuuguacacuaggacagauaccacuacaagcgucgccaccgaggagauaaaccggacguucaaaccacugauuggcccccgcccucuagugaacgggcucaugggaagaaucaauuauuacuggucuguacugaagccaggucagacccuuaggauuaaguccaacggcaaucugaucgcuccgugguaugggcacaucuugucaggagaaagccacggccggauucucaaaacagaccugaagcgcgguaguugcacuguucaaugucagaccgagaaagggggauuaaacacaacucugcccuuucagaaugugucuaaguacgcauucggcaacugcuccaaauauauaggcaucaagagccucaaacuugccgucgggcugcgaaaugugccuucgagaucuuccaggggauuguuuggugcuauugccggcuucaucgaagggggauggucaggccuaguggcggguugguacggguuucagcacaguaacgaucaaggcgucggaauggcagccgaccgggauagcacccagaaggcuauagacaagauuacauccaaaguuaauaacaucguggacaagaugaauaaacaguaugagaucauugaucaugaguucucugaaguagagacccgucugaacaugaucaauaacaagauugacgaucaaauacaggacaucugggccuacaaugcagaacuccuggugcuucuggagaaccagaaaacuuuggaugaacacgacgcuaacgucaauaaccucuacaauaaggugaagcgcgcccugggcagcaacgcgguugaggaugggaaaggauguuuugaauuauaucauaagugcgacgaucaguguauggagacgauuagaaaugguacauacaacaggcggaaauaucaagaggaaucaaagcuggagcgacagaaaaucgaaggcgugaagcuagagagugaagggaccuacaagauccucacuauuuauuccaccgucgccagcucucuggugauagcaaugggauucgcugccuuucuuuucugggcuaugucaaauggcaguugccgcugcaacaucuguauuuga

SEQ ID NO: 134817 - RNA, 1683 nt, Artificial Sequence
  derived and/or modified sequence opt3 from hemagglutinin__InfluenzaA__AJD78199
auggagaccgugagccugaucacaauucuccuugucgccacuguuuccaacgcugacaagauaugcaucggcuaccagucuacuaauucaaccgaaacaguggauacucugaccgagaacaauguacccgugacacacgcaaaagaauuguuacauaccgagcacaacgggaugcugugugccacgagucuaggacaaccucucauucuggacacaugcaccaucgaaggucuuauuuauggcaauccaagcugugaucuguccuuggaggggagagaguggucuuacaucgucgaaaggccgucggcggugaacggacucugcuaucccggcaauguugagaaccuggaggaacugcggucacucuucagcagugcucgcuccuaccagcgaauacagaucuuuccugacacgauuuggaaugugucuuaugaugguacuagcaccgccuguuccgggucauucuaccguaguaugagaugguuaacaaggaagaacggagacuauccaauccaggaugcacaauacacuaauaaccagggcaaaaauauucuguuuauguggggcaucaaccaucccccuaccgacacaacccagcgggaucuuuacacgcgcacugacacaaccacuagcgucgccacagaggaaauaaauagaauuuucaagccauugaucgggcccaggccucuggugaacggacuaaugggucggauugauuauuacuggucuguacucaaaccaggccagacccugcgcaucaaguccgacgggaaccuuaucgcuccgugguauggacacauucugucaggcgagagccauggucgaauauugaagacggaucucaaaagagggaguugcaccguucaaugucagacagaaaagggaggccugaauacuaccuuacccuuucagaacgugucuaaauacgcauucggcaauugcuccaaguauaucgggauuaaaagccugaagcucgccgucggacuuaggaacgugccuucgcggucuucccguggucuguuuggcgcuaucgccggguucauagagggaggcuggucagguuugguggcggggugguacggcuuucagcacaguaaugaccaaggagucggcauggcagccgaccgcgauagcacacagaaggcuauugacaaaaucacuuccaagguuaacaauaucguggauaaaaugaacaagcaguaugaaauuaucgaccacgaguucucugagguagaaaccagacuaaauaugauuaacaauaaaauagaugaccaaauccaggauauuugggccuacaacgcagagcugcucgugcugcuugaaaaucagaagacacuggacgagcaugaugcuaacgucaauaacuuguacaacaaagugaagagggcccucgggagcaaugcgguugaagacggaaaggguuguuuugagcuguaucacaaaugcgaugaccaguguauggagaccauccggaacggcacuuacaaucgacgcaaguaucaagaagagucaaaauuagaaagacagaagaucgagggggugaaacuggaaagugagggaacguacaagauucuaacaauauauuccaccgucgccagcucucucgugaucgcaaugggcuucgcugccuuucuguucugggcuaugucaaacgguaguuguaggugcaauauuugcaucuga

SEQ ID NO: 134818 - RNA, 1683 nt, Artificial Sequence
  derived and/or modified sequence opt3 from hemagglutinin__InfluenzaA__AJD78211
auggagaccgugagccugaucacaauucuccuugucgccacuguuuccaacgcugacaagauaugcaucggcuaccagucuacuaauucaaccgaaacaguggauacucugaccgagaacaauguacccgugacacacgcaaaagaauuguuacauaccgagcacaacgggaugcugugugccacgagucuaggacaaccucucauucuggacacaugcaccaucgaaggucuuauuuauggcaauccaagcugugaucuguccuuggaggggagagaguggucuuacaucgucgaaaggccgucggcggugaacggacucugcuaucccggcaauguugagaaccuggaggaacugcggucacucuucagcagugcucgcuccuaccagcgaauacagaucuuuccugacacgauuuggaaugugucuuaugaugguacuagcaccgccuguuccgggucauucuaccguaguaugagaugguuaacaaggaagaacggagacuauccaauccaggaugcacaauacacuaauaaccagggcaaaaauauucuguuuauguggggcaucaaccaucccccuaccgacacaacccagcgggaucuuuacacgcgcacugacacaaccacuagcgucgccacagaggaaauaaauagaauuuucaagccauugaucgggcccaggccucuggugaacggacuaaugggucggauugauuauuacuggucuguacucaaaccaggccagacccugcgcaucaaguccgacgggaaccuuaucgcuccgugguauggacacauucugucaggcgagagccauggucgaauauugaagacggaucucaaaagagggaguugcaccguucaaugucagacagaaaagggaggccugaauacuaccuuacccuuucagaacgugucuaaauacgcauucggcaauugcuccaaguauaucgggauuaaaagccugaagcucgccgucggacuuaggaacgugccuucgcggucucgucgcggucuguuuggcgcuaucgccggguucauagagggaggcugguccgguuugguggcggggugguacggcuuucagcacucaaaugaccaaggagucggcauggcagccgacagagauaguacacagaaggcuauugacaaaaucacuagcaagguuaacaauaucguggauaaaaugaacaagcaguaugaaauuaucgaccacgaguucuccgagguagaaaccaggcuaaauaugauuaacaauaaaauagaugaccaaauccaggauauuugggccuacaacgcagagcugcucgugcugcuugaaaaucagaagacacuggacgagcaugaugcuaacgucaauaacuuguacaacaaagugaagcgggcccucgggucuaaugcgguugaagacggaaaggguuguuuugagcuguaucacaaaugcgaugaccaguguauggagaccauccgaaacggcacuuacaaucgcagaaaguaucaagaagagagcaaauuagaaaggcagaagaucgagggggugaaacuggaaucagagggaacguacaagauucuaacaauauauaguaccgucgccuccagccucgugaucgcaaugggcuucgcugccuuucuguucugggcuaugucuaacgguucaugccggugcaauauuuguaucuga

SEQ ID NO: 134819 - RNA, 1689 nt, Artificial Sequence
  derived and/or modified sequence opt3 from hemagglutinin__InfluenzaA__AJI76401
auggccaucauuuaccugauacuccuuuucgcuaccgugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugcgcguaccggaauggucuuacaucauggagaaagagaacccccgauauucacucugcuacccuggcagucugaaugauuaugaagaacugaagcaucucuuaagcuccgugaagcacuuugaaaaaguccguauucugccaaaggacagauggacuaaccauaccacaaccggugggucuaaggcuugugccgugucgggaaaacccucauucuuuaggaauaugguuuggcuuacuaaaaagggcccuaacuacccaguggcaaagggcagcuauaauaacacaaguggggagcaaauguugaucauuuggggaguccaccaccccaucgaugaggccgaacagcgggcucuguaccagaauguggguaccuacguauccgcaucuacgagcacucuauauaaacgcuccauaccugagauugccgcuagaccagaaguuaacggccucgggucaaggauggaguucaguuggacccugcuugacgugugggauacaaucaauuuugaaagcacuggaaaccuggucgccccggaguacggcuucaagauuucuaaacgggguuccucagggaucaugaagaccgagggaacauugggcaacugcgaaaccaaaugucagacgccccucggcgcgaucaauacuacacugccuuuucauaacgugcacccauuaaccauuggggagugccccaaguaugugaaaagcgaaaagcugguccucgcaacuggacuucgcaauguuccucaaauagagagucgaggucuguucggcgccaucgcuggguuuauugaaggaggcuggcaggguaugguggacgggugguacggcuaucaucacucuaacgaucagggauccggcuacgccgcagacaaggagagcacacagaaggcuuucgaugggaucaccaauaaaguaaacucggugauagagaaaaugaauacgcaauuugaagccgucggaaaggaguucaacaauuuggagaaaagacuagagaaccugaauaagaggauggaagacgguuuucucgacguguggaccuauaacgcggagcugcuuguucugauggagaaugaacggacauuggauuuccacgacucuaacgugaagaaucucuacgagaaaguccguaugcagcugcgcgauaacgugagagaauuaggcaacggguguuucgaguuuuaccauaagugcgacgaugaguguaugaacuccguuaaaaauggaacuuaugacuacccaaaguaugaagaggaaucaaaacugaagaggaaugagauuaagggcguaaaacuaaguagcauggguguguaccagauccucgccaucuaugcaaccgucgcugggucccugucucuugccauuaugguggcuggcaucagcuucuggaugugcucaaacggaaguuugcagugccggauuuguauauga

SEQ ID NO: 134820 - RNA, 1701 nt, Artificial Sequence; identical to SEQ ID NO: 134081
  derived and/or modified sequence opt3 from hemagglutinin__InfluenzaA__AJI80137

SEQ ID NO: 134821 - RNA, 1701 nt, Artificial Sequence; identical to SEQ ID NO: 134081
  derived and/or modified sequence opt3 from hemagglutinin__InfluenzaA__AJI80149

SEQ ID NO: 134822 - RNA, 1701 nt, Artificial Sequence; identical to SEQ ID NO: 132056
  derived and/or modified sequence opt3 from hemagglutinin__InfluenzaA__AJI80161

SEQ ID NO: 134823 - RNA, 1701 nt, Artificial Sequence
  derived and/or modified sequence opt3 from hemagglutinin__InfluenzaA__AJI80172
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguagccucaucgacgcucugcuuggggauccgcagugcgacggauuucagaauaaaaagugggaucuguucguggagagguccaaagccuauucuaacuguuaccccuaugacgucccugauuacgcaucguugcggucacucguggccagcaguggcacacuggaauuuaauaacgaguccuucaauugggcugguguuacccaaaacgggacuucuagcgcaugcauucgcggauccaauucaaguuucuuuagccgacugaacuggcucacacauuuaaauuuuaaguauccagcccugaacgugaccaugcccaacaaugagcaguucgacaaguuguacaucuggggcguccaccauccuggcacggauaaagaccagauuuuucuuuaugcucagucuuccgggcguaucacugugucaaccaagagaagccaacaggccguaauaccaaacauuggaaguaggccccggauccgcaauauuccuucuagaaucuccaucuacuggacaauuguuaaaccaggugauauacugcuaaucaacagcacuggcaaucucauugcgccgaggggguacuucaagauccggucgggaaaaucuuccauaaugcgcucagacgcacccauuggcaaguguaagagugaaugcaucaccccuaacgguagcaucccaaaugacaaacccuuucagaacgugaaucgaauuacauauggggccuguccuagauacgucaagcaguccacccugaaacuugcuacgggaaugaggaacgugccagagaagcaaacucggggcaucuucggcgccauugcaggguuuauagaaaauggaugggaggguaugguggauggcugguauggguuccgucaccagaacucugagggacgcggccaggcugccgaccugaaaagcacacaagcggccaucgaucagauuaaugguaaguugaacagacucaucgggaaaaccaaugaaaaguuccaccagaucgagaaggaauuuucagaggucgaaggcaggauucaggaccuggagaaauacguugaggauacuaagauagacuuauggaguuauaacgcagaacugcucguggcucuugagaaccaacauacaaucgaucugaccgacuccgaaaugaauaaauuguucgagaagacgaaaaagcagcuacgggaaaacgccgaggauaugggaaauggcugcuuuaagauuuaccacaaaugugacaacgcuugcaucgggagcauucgaaauggaaccuaugaucaugacguauaccgcgacgaggcccugaacaauagauuccagaucaaggguguggaacucaaaucuggcuacaaggauuggauacuguggaucucauuugcaauuaguugcuuccuucugugugucgccuugcucggguuuaucaugugggcuugccagaaaggaaacauuagguguaauaucugcauauga

SEQ ID NO: 134824 - RNA, 1701 nt, Artificial Sequence
  derived and/or modified sequence opt3 from hemagglutinin__InfluenzaA__AJI80196
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaagagugggaucuguucguggaaaggagcaaggccuauuccaacuguuaccccuaugacgucccugauuacgcaucuuugcggucgcucguggccucaagcggcacccuggaguuuaauaacgagaguuucaauugggcugguguuacucaaaacgggacauccucugcaugcauucgcggaagcaauuccucauuuuucagucgacugaacuggcucacccauuuaaauuuuaaauauccagcccugaacgugacgaugcccaacaaugaacaguucgacaagcuguacaucuggggcguccaccauccuggcacugauaaggaccagaucuuuuuguaugcucagagcucugggcguauuaccguguccacaaaaagaucacaacaggccguaauaccaaacauuggaagcaggccccggauccgcaauauuccuaguagaaucucuaucuacuggacuauuguuaagccaggugauauacugcuaaucaacuccaccggcaaucucauugcgccgaggggguacuucaaaauccggagcggaaagucgucuauaaugcgcuccgacgcacccauuggcaaauguaagucagagugcaucacaccuaacgguaguaucccaaaugacaagcccuuucagaacauuaaucgaaucaccuauggggccuguccuagauacgugaaacagagcacgcugaaacuugcuacuggaaugaggaacgucccagaaaaacaaacacggggcauuuucggcgccauagcaggguuuaucgagaauggaugggaggguaugguggauggcugguauggguuccgucaccagaacuccgaaggacgcggccaggcugccgaccugaagucuacccaagcggccauugaucagaucaaugguaaauugaacagacucaucgggaagacuaaugagaaauuccaccagauugaaaaggaguuuagcgaaguggagggcaggauacaggaccuggagaaguacgucgaagauacaaaaaucgacuuauggucauauaacgcagaguuccugguugcucucgaaaaccaacauaccauugaucuuacggacagugagaugaauaagcuguuugaaaagaccaagaaacaguugcgggagaacgccgaggauaugggaaauggcugcuucaagaucuaccacaagugugacaacgcuugcauuggguccauccgaaauggaacauaugaucaugacguguaccgcgacgaagcccuaaacaauagauuucagauaaaagguguagagcuuaagagcggcuacaaagauuggauccucuggauuucuuucgcaaucucaugcuuucugcuuuguguggcccuguugggguucauuaugugggcuugccagaagggaaacaucagguguaauauaugcauuuga

SEQ ID NO: 134825 - RNA, 1701 nt, Artificial Sequence; identical to SEQ ID NO: 134631
  derived and/or modified sequence opt3 from hemagglutinin__InfluenzaA__AJI80208

SEQ ID NO: 134826 - RNA, 1701 nt, Artificial Sequence; identical to SEQ ID NO: 132010
  derived and/or modified sequence opt3 from hemagglutinin__InfluenzaA__AJI80220

SEQ ID NO: 134827 - RNA, 1701 nt, Artificial Sequence; identical to SEQ ID NO: 134823
  derived and/or modified sequence opt3 from hemagglutinin__InfluenzaA__AJI80232

SEQ ID NO: 134828 - RNA, 1701 nt, Artificial Sequence; identical to SEQ ID NO: 132010
  derived and/or modified sequence opt3 from hemagglutinin__InfluenzaA__AJI80244

SEQ ID NO: 134829 - RNA, 1701 nt, Artificial Sequence; identical to SEQ ID NO: 131874
  derived and/or modified sequence opt3 from hemagglutinin__InfluenzaA__AJI80256

SEQ ID NO: 134830 - RNA, 1701 nt, Artificial Sequence; identical to SEQ ID NO: 132010
  derived and/or modified sequence opt3 from hemagglutinin__InfluenzaA__AJI80268

SEQ ID NO: 134831 - RNA, 1701 nt, Artificial Sequence
  derived and/or modified sequence opt3 from hemagglutinin__InfluenzaA__AJI80280
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauugguaaaaucugcgacaguccacaccagauacuagauggcgagaacuguacacucaucgacgcucugcuuggggauccgcagugcgacggauuucagaauaaggaaugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggauucaggaccuggagaaauacguugaggauacaaagauagacuuauggucauauaacgcagaacugcucguggcucuugagaaccaacauaccaucgaucugacggacagugaaaugaauaaauuguucgagaagaccaaaaagcagcuacgggaaaacgccgaggauaugggaaauggcugcuuuaagauuuaccacaaaugugacaacgcuugcaucggguccauucgaaauggaacauaugaucaugacguauaccgcgacgaggcccugaacaauagauuccagaucaaggguguggaacucaaaagcggcuacaaggauuggauacuguggaucucuuuugcaauuucaugcuuccuucugugugucgccuugcucggguuuaucaugugggcuugccagaaaggaaacauuagguguaauaucugcauauga

SEQ ID NO: 134832 - RNA, 1701 nt, Artificial Sequence; identical to SEQ ID NO: 134603
  derived and/or modified sequence opt3 from hemagglutinin__InfluenzaA__AJI80292

SEQ ID NO: 134833 - RNA, 1701 nt, Artificial Sequence; identical to SEQ ID NO: 134631
  derived and/or modified sequence opt3 from hemagglutinin__InfluenzaA__AJI80303

SEQ ID NO: 134834 - RNA, 1701 nt, Artificial Sequence; identical to SEQ ID NO: 134603
  derived and/or modified sequence opt3 from hemagglutinin__InfluenzaA__AJI80315

SEQ ID NO: 134835 - RNA, 1701 nt, Artificial Sequence
  derived and/or modified sequence opt3 from hemagglutinin__InfluenzaA__AJI80326
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaaaagaaugccggguccggaaucauaauuagcgacaccccagugcaugauugcaacacgacuugucagacaccggagggcgcaaucaauaccucgcuccccuuccagaacauucacccuaucacuaucgguaaaugcccaaaguauguaaagucuacaaaacugcggcuugcuaccgggcugcgcaaugugcccuccauucagucaagaggauuguuuggcgccauagcgggcuucaucgaagggggauggacggguauggucgacggcugguacggguaucaucaccaaaacgagcagggaaguggcuacgccgcagaccucaagagcacccagaaugcuauugauaaaaucacaaacaagguaaauuccguuauagagaaaaugaacacucaguuuaccgccguggguaaggaguucaaucaccuggagaagaggauugaaaacuuaaauaaaaaggucgacgauggguuccuggacaucuggacauacaacgcugagcuccuugugcuguuggaaaaugagcggacucuagauuaucaugacucuaacgugaaaaaccuguacgagaagguucgcaaucaacucaaaaacaaugccaaggaaaucggcaacggauguuuugaguucuaucacaagugcgauaauaccuguauggaaagcgugaaaaacggcacauacgacuauccuaaguacucagaggaagcaaaacugaaucgagagaagauugauggggucaaacuugagaguaccagaaucuaucagauucuggccauauacuccacuguggcuagcucuuugguccucgugguuucacugggagcgaucaguuuuuggaugugcagcaacgguuccuuacagugcaggauuuguaucuga

SEQ ID NO: 134836 - RNA, 1701 nt, Artificial Sequence
  derived and/or modified sequence opt3 from hemagglutinin__InfluenzaA__AJI80337
augaaggccauccuggugguccuccuuuacaccuucgcuacagcaaacgccgacacucugugcauuggcuaucacgcgaauaacagcacggauaccguugacacaguguuggagaagaauguaacugugacccauuccauaaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauuaauuacgaagaacucagggagcagcugagcaguguuuccucuuucgaacgguuugagauguucccgaagacaagcuccuggcccaaccacgacucaaauaagggugugaccgccgcuuguccucaugcaggggccaaaaguuuuuauaagaaccugaucuggcucgucaaaaagggaaauagcuacccaaaauuaucuaaguccuauauaaacgauaagggcaaagaagugcugguacuuuggggcauccaccaccccucaacgacugcugaccaacagagcuuguaccagaaugccaacgcguacguuuucguggggaccaguaaguauucuaaaaaguuuaaaccugagauugcaauccgcccaaagguccgagaucaggagggacguaugaacuacuauuggacacugauugaacccggugacaaaaucacuuucgaggccaccggcaaucuaguggugccuagauacgcuuuugccauggaaaggaacgcaggguccggaauaauuaucagcgauacaccaguccaugacugcaauaccacgugucaaacuccggagggcgcuauuaacacaucgcuccccuuccagaauauccacccuaucaccauugguaagugcccaaaguauguuaaaucuacuaagcugcggcuugccacagggcugcgcaacauacccuccauccagucaagaggauuguuuggcgcgauugccggcuucaucgaagggggauggaccgguaugguggauggcugguacggguaucaucaccagaaugagcaaggaaguggcuacgcagcugaccucaaaagcacgcagaacgccauagacaagauuaccaauaaaguaaacuccgugaucgagaagaugaauacacaguuuacugcugucgguaaggaguucaaccaccuggagaaaaggaucgaaaauuuaaacaagaaaguggaugacggguuccuggauauuuggaccuacaaugccgagcuccuuguucuguuggaaaacgagcggacacuagacuaucaugauucuaacgugaagaaucuguacgagaaaguccgcaaccagcucaagaauaacgcaaaggaaaucggcaauggauguuuugaguucuaucacaaaugcgacaacacuuguauggaaagcgugaagaauggcaccuacgauuauccuaaauacucagaggaagccaagcugaaccgagagaaaauugacgggguaaaacuugagaguacaagaauauaucaaauccuggcuauuuacuccaccguugcgagcucuuuggugcucgucgugucacugggagcaaucaguuuuuggaugugcagcaaugguuccuuacagugcaggaucuguauuuga

SEQ ID NO: 134837 - RNA, 1701 nt, Artificial Sequence; identical to SEQ ID NO: 132010
  derived and/or modified sequence opt3 from hemagglutinin__InfluenzaA__AJI80348

SEQ ID NO: 134838 - RNA, 1701 nt, Artificial Sequence; identical to SEQ ID NO: 131874
  derived and/or modified sequence opt3 from hemagglutinin__InfluenzaA__AJI80360

SEQ ID NO: 134839 - RNA, 1701 nt, Artificial Sequence; identical to SEQ ID NO: 131874
  derived and/or modified sequence opt3 from hemagglutinin__InfluenzaA__AJI80372

SEQ ID NO: 134840 - RNA, 1701 nt, Artificial Sequence; identical to SEQ ID NO: 132056
  derived and/or modified sequence opt3 from hemagglutinin__InfluenzaA__AJI80384

SEQ ID NO: 134841 - RNA, 1701 nt, Artificial Sequence; identical to SEQ ID NO: 132056
  derived and/or modified sequence opt3 from hemagglutinin__InfluenzaA__AJI80395

SEQ ID NO: 134842 - RNA, 1701 nt, Artificial Sequence; identical to SEQ ID NO: 132056
  derived and/or modified sequence opt3 from hemagglutinin__InfluenzaA__AJI80406

SEQ ID NO: 134843 - RNA, 1701 nt, Artificial Sequence; identical to SEQ ID NO: 132056
  derived and/or modified sequence opt3 from hemagglutinin__InfluenzaA__AJI80417

SEQ ID NO: 134844 - RNA, 1701 nt, Artificial Sequence; identical to SEQ ID NO: 132056
  derived and/or modified sequence opt3 from hemagglutinin__InfluenzaA__AJI80428

SEQ ID NO: 134845 - RNA, 1701 nt, Artificial Sequence; identical to SEQ ID NO: 132010
  derived and/or modified sequence opt3 from hemagglutinin__InfluenzaA__AJI80439

SEQ ID NO: 134846 - RNA, 1701 nt, Artificial Sequence; identical to SEQ ID NO: 132010
  derived and/or modified sequence opt3 from hemagglutinin__InfluenzaA__AJI80462

SEQ ID NO: 134847 - RNA, 1701 nt, Artificial Sequence
  derived and/or modified sequence opt3 from hemagglutinin__InfluenzaA__AJI80474
augaaggccauccuggugguccuccuuuacaccuucgcuacagcaaacgccgacacucugugcauuggcuaucacgcgaauaacagcacggauaccguugacacaguguuggagaagaauguaacugugacccauuccauaaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauuaauuacgaagaacucagggagcagcugagcaguguuuccucuuucgaacgguuugagaucuucccgaagacaagcuccuggcccaaccacgacucaaauaagggugugaccgccgcuuguccucaugcaggggccaaaaguuuuuauaagaaccugauauggcucgucaaaaagggaaauagcuacccaaaauuaucucaauccuauaucaacgauaagggcaaggaagugcugguacuuuggggcauucaccaccccucaacgacugcugaccagcagagcuuguaccagaaugccgaugcguacguuuucguggggaccagucgcuauucuaaaaaguuuaaaccugagaucgcaauucgaccaaagguccgugaccaagagggaagaaugaacuacuauuggacacugguggaacccggugauaaaaucacuuucgaggccaccggcaaccuaguggucccuagguacgcuuuuacaauggaacggaaugccggguccggaauaauuaucagcgacaccccaguucaugauugcaacacgacuugucagacaccggagggcgcaauuaauaccucgcuccccuuccagaacauccacccuaucacuauugguaagugcccaaaauaugugaagucuacaaagcugcgccuugcuaccgggcugagaaauguacccuccauacagucaaggggauuguuuggcgccaucgcgggcuucauugaagggggauggacggguaugguggacggcugguacggguaucaucaccaaaacgagcagggaaguggcuacgccgcagaccucaaaagcacccagaaugcuaucgauaagauaacaaacaaagucaauuccgugauugagaagaugaacacucaguuuaccgccguugguaaagaguucaaucaccuggagaagcggaucgaaaacuuaaauaagaaaguggacgauggguuccuggacaucuggacauacaacgcugagcuccuuguccuguuggaaaaugagcgcacucuagauuaucaugacucuaacgugaagaaccuguacgagaaaguacgaaaucaacucaagaacaaugccaaagaaauuggcaacggauguuuugaguucuaucacaagugcgauaauaccuguauggaaagcguuaagaacggcacauacgacuauccuaaauacucagaggaagcaaagcugaauagagagaaaaucgauggggugaaacuugagaguaccaggauuuaucagauacuggccaucuacuccacugucgcuagcucuuuggugcucgucgugucacugggagcgauuaguuuuuggaugugcagcaacgguuccuuacagugccggaucuguaucuga

SEQ ID NO: 134848 - RNA, 1701 nt, Artificial Sequence; identical to SEQ ID NO: 134847
  derived and/or modified sequence opt3 from hemagglutinin__InfluenzaA__AJI80485

SEQ ID NO: 134849 - RNA, 1701 nt, Artificial Sequence; identical to SEQ ID NO: 132056
  derived and/or modified sequence opt3 from hemagglutinin__InfluenzaA__AJI80496

SEQ ID NO: 134850 - RNA, 1701 nt, Artificial Sequence; identical to SEQ ID NO: 134659
  derived and/or modified sequence opt3 from hemagglutinin__InfluenzaA__AJI80507

SEQ ID NO: 134851 - RNA, 1701 nt, Artificial Sequence; identical to SEQ ID NO: 132056
  derived and/or modified sequence opt3 from hemagglutinin__InfluenzaA__AJI80518

SEQ ID NO: 134852 - RNA, 1701 nt, Artificial Sequence; identical to SEQ ID NO: 130148
  derived and/or modified sequence opt3 from hemagglutinin__InfluenzaA__AJJ98765

SEQ ID NO: 134853 - RNA, 1701 nt, Artificial Sequence
  derived and/or modified sequence opt3 from hemagglutinin__InfluenzaA__AJJ98777
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuuuuucaacaggugagauuugcaauaguccacaccagauccuagacggcgaaaacuguacccucauagaugcucugcuuggggacccgcagugcgauggauuccaaaauaaaaagugggaccuguuuguggagagaagcaaagccuauuccaacuguuaccccuaugaugucccugacuacgcaucuuugaggucgcucguggccucaagcggcacucuggaguucaauaacgaaaguuuuaauuggacagguguuacccagaacgggacguccucugcuugcauccggcgcagcaauaacuccuucuuuucacgacugaauuggcucacucauuuaaaguucaaguauccagcacugaacgugaccaugcccaacaaugaggaauuugauaaacuuuacauuuggggaguccaccauccuggcacagacaacgaucagaucuucuuguaugcccaggcuaguggccguauuacugugagcaccaagagaucucaacagacaguaaucccaaauauaggguccaggccccggguucgcaacauuccuucaagaaucagcauuuacuggaccaucgugaaaccaggagacauccugcuaauuaauaguacggguaaccucauagccccgaggggcuacuuuaagauccggucugggaaauccagcauuaugcgcucggaugcgcccaucggaaaguguaauucugagugcauaacuccuaacggcuccauuccaaaugacaagcccuuccagaacgucaaucgaaucacauauggugcauguccuagauacgugaaacagaacacccugaaacuugccacugggaugaggaaugugccagaaaaacaaacacggggaaucuuuggcgcuauugccggcuucaucgagaacgggugggagggaauggucgacgguugguauggcuuccgucaccaaaauucagaagggauuggacaggcagcugaucugaagaguacccaggccgcgauagaccagaucaacggcaaauugaaccgccucauugguaagacgaaugagaaauuucaccagaucgaaaaggaguucagcgaaguugaggggagaauccaggaucuggagaaguacguggaagacaccaaaauugauuuaugguccuauaacgccgagcugcucguagcacuugaaaaucaacauacaauagaccugacugauucugagaugaacaaguuguuugaaaagaccaagaaacagcuaagggagaaugcugaggacaugggcaacggaugcuucaagaucuaccacaagugugauaaugccugcauuggcagcauccggaacgggacauaugaccaugauguguaccgagacgaagcucugaauaaccgcuuucagauuaaaggagucgagcucaagucagguuacaaagacuggauccuguggauaaguuucgccaucuccugcuuucuucuguguguggcauugcucggcuucauuaugugggccugccagaaggggaauaucagauguaacauuugcaucuga

SEQ ID NO: 134854 - RNA, 1701 nt, Artificial Sequence; identical to SEQ ID NO: 131469
  derived and/or modified sequence opt3 from hemagglutinin__InfluenzaA__AJJ98789

SEQ ID NO: 134855 - RNA, 1701 nt, Artificial Sequence
  derived and/or modified sequence opt3 from hemagglutinin__InfluenzaA__AJJ98801
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagagaaacaaagccuauagcaauuguuaccccuaugacgucccugauuacgcauccuugaggucucucguggccucgucaggcacccuggaauuuaacaaugagagcuucaacuggacugguguuacacagaaugggaccaguuccgcuugcauucggcgcucuaacaauagcuuuuucucccgacugaacuggcucacgcauuuaaacuuuaaguauccagcacugaaugugacuaugcccaacaaugagcaguucgacaaacuuuacaucuggggaguccaccauccuggcaccgauaaagaccagaucuuuuuguaugcccaaucaaguggccguauuacagugagcacuaagagaucucagcaggcuguaauaccaaacauuggguccaggccccggauccgcaauauuccuucaagaaucagcaucuacuggaccauuguuaaaccaggagauauacugcuaaucaacaguacagguaaucucauugccccgaggggcuacuucaagauccggucugggaaauccagcauaaugcgcucggacgcgcccauuggaaaguguaagucugaaugcaucaccccuaacggcuccaucccaaaugacaaacccuuucagaacgugaaucgaauuacguauggugcauguccuagauacgucaagcaaucaacucugaaacuugccacagggaugaggaacgugccagagaagcagacccggggaaucuucggcgcuauugccggcuuuauagaaaaugggugggagggaaugguggaugguugguauggcuuccgucaccagaacagugaggggcgcggacaagcagcugaccugaaaagcacucaggccgcgaucgaucagauuaauggcaaguugaacagacucaucgguaaaacaaacgaaaaguuccaccagaucgagaaggaauuuuccgaggucgaagggaggauucaagaccuggagaaauacguugaggauaccaagauagacuuauggucuuauaaugccgaacugcucguggcacuugagaaccagcauacgaucgaucugaccgacagcgaaaugaauaaauuguucgagaagacaaagaagcagcuacgggaaaacgcugaggauaugggcaauggaugcuuuaagauuuaccacaaaugugacaacgccugcaucggcucaauucgaaaugggacuuaugaucaugacguauaccgcgacgaggcucugaacaauagauuccagaucaagggaguggaacucaaaagugguuacaaggauuggauacuguggaucuccuuugccauuagcugcuuccuucugugugucgcauugcucggcuuuaucaugugggccugccaaaaagggaacauuagguguaauaucugcauauga

SEQ ID NO: 134856 - RNA, 1701 nt, Artificial Sequence
  derived and/or modified sequence opt3 from hemagglutinin__InfluenzaA__AJJ98813
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaguuccaaacauagggagccggccccgcauuagaaauaucccuaguaggauuucuaucuacuggaccaucgugaaaccaggagauauucugcuaauaaacuccacagguaaucucaucgccccgcggggcuacuucaagauucgcagcgggaaaucgucuaucaugcgauccgacgcgcccauaggaaaguguaagucagaaugcauuaccccuaacggcaguaucccaaaugacaaacccuuucagaacgucaauagaaucacguauggugcauguccuagguacgugaagcagagcacucugaaacuugccacagggaugcggaacgugccagagaagcaaacccguggaauuuucggcgcuaucgccggcuuuauugaaaaugggugggagggaauggucgaugguugguauggcuuccgccaccagaacuccgaggggagaggacaggcagcugaccugaaaucuacucaagccgcgauagaucagaucaauggcaaguugaacaggcucauugguaaaacaaaugaaaaguuccaccagaucgagaaggaauuuagcgagguugaagggcggauccaggaccuggagaaauacguggaggauaccaagauugacuuauggucauauaacgccgaacugcucguagcacuugagaaccaacauacgauagaucugaccgacagugaaaugaauaaauuguucgagaagacaaagaagcagcuacgagaaaacgcugaggauaugggcaauggaugcuuuaagaucuaccacaaaugugacaacgccugcauuggcuccauccgcaaugggacuuaugaucaugacguguacagagacgaggcucugaacaauagguuccagauuaagggagucgaacucaaaagcgguuacaaggauuggauccuguggauaucuuuugccaucucaugcuuccuucuguguguggcauugcucggcuuuauuaugugggccugccagaaagggaacauccgguguaauauuugcaucuga

SEQ ID NO: 134857 - RNA, 1701 nt, Artificial Sequence
  derived and/or modified sequence opt3 from hemagglutinin__InfluenzaA__AJJ98825
augaagaccaucauugcccugagcuacauacucugccuuguguucgcucaggagcugcccggcaacgacaauuccacagcaacuuuguguuuagggcaccaugccgucccuaacggaacgaucguuaaaaccauuacaaaugauagaaucgaagugacuaacgcgaccgagcugguacaaaauucuucaauuggugaaaucugcgacaguccacaccagauacuagauggcgagaacuguacacucaucgacgcucugcuuggggauccgcagugcgacggauuucagaauaagaaaugggaucuguucguggaaaggagcaaggccuauuccaacuguuaccccuaugacgucccugauuacgcaucuuugcggucgcucguggccucaagcggcacccuggaguuuaauaacgagaguuucaauuggacugguguuacacaaaacgggaccuccucugcuugcauucgccgaagcaauaacuccuuuuucucacgucugaauuggcucacgcauuuaaacuuuaaauauccagcacugaacgugacuaugcccaauaacgaacaguucgacaaguuguacaucuggggaguccaccauccuggcaccgauaaggaccagauuuuucuuuaugcccagaguagcggcagaaucacagugucuacuaaaaggucccaacaggcuguaauaccaaauauugggucacggcaccgcaucagaaacauucccagcaggaucaguaucuacuggaccauuguuaagccuggagauauacugcuaaucaauucuacagguaaccucauugccccacggggcuacuucaaaauccgcuccggaaagagcucgauaaugcgaucugacgcgccgauugggaaauguaaguccgagugcaucacccccaauggcucaaucccuaacgacaagccauuucagaaugugaacagaauuacguauggugcaugucccagguacgucaaacagaguacucugaaacuugccacagggaugcggaaugugccugaaaaacaaacccguggaaucuucggcgcuauugccggcuuuauagagaacgggugggagggaaugguggaugguugguauggcuuccgccaccagaauagcgaagggagaggacaggcagcugaccugaaguccacucaagccgcgaucgaucagauuaacggcaaauugaauaggcucaucgguaagacaaacgagaaauuccaucagaucgaaaaggaguuuucugaagucgaggggcggauucaggaccuggagaaguacguugaagauaccaaaauagacuuauggagcuauaacgccgagcugcucguggcacuugaaaaucaacacacgaucgaucugaccgacucagagaugaacaaguuguucgaaaagacaaagaaacagcuacgagagaaugcugaggauaugggcaacggaugcuuuaagauuuaccauaagugugacaaugccugcaucggcaguauucgcaacgggacuuaugaucacgacguauacagagacgaagcucugaauaacagguuccagaucaaaggaguggagcucaaguccgguuacaaagauuggauacuguggaucagcuuugccauuucuugcuuccuucugugugucgcauugcucggcuuuaucaugugggccugccagaaggggaauauucgguguaacaucugcauauga

SEQ ID NO: 134858 - RNA, 1701 nt, Artificial Sequence
  derived and/or modified sequence opt3 from hemagglutinin__InfluenzaA__AJJ98837
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcuagcggccguauuacugugucuaccaagagaucccagcaggccguaaucccaaauauagggucaaggccccggguucgcaacauuccuagcagagugaguaucuauuggacaauugucaaaccaggagacauccugcuaaucaauucuaccgguaaccucauugcgccgaggggcuacuucaagauacgguccgggaaaagcucgaucaugcgcucugaugcacccauuggaaaguguaauuccgccugcaucacgccuaacggcucaauaccaaaugacaagcccuuucagaacgugaaucgaauuacuuacggugcuuguccuagauaugugaaacaaaguacacugaaacuugccaccgggaugaggaacgucccagaaaagcagacucggggaaucuucggcgcaaucgcuggcuuuauugagaaugggugggaaggaaugguugacgguugguacggcuuccgucaccagaacagcgaggggcgcggacaagccgcggaucugaaguccacacaggccgcaaucgaccagauuaauggcaaauugaacagacucauagguaagaccaacgagaaauuccaucagaucgaaaaggaguuuucugaaguggaggggaggauucaagaucuggaaaaguauguagaggacacgaaaaucgauuuauggagcuacaaugcugagcugcucguggcccuugaaaaccagcacaccaucgaccugacagauucagagaugaauaaguuguucgaaaagacuaagaaacagcuacgggagaacgcugaagacaugggcaauggaugcuuuaagauuuaucauaagugugauaacgccugcauaggcaguauccgaaaugggaccuacgaccacgaugucuaucgcgacgaggcacugaacaauagauuccagauuaaaggaguggagcucaaguccgguuacaaagacuggauccuguggauuagcuuugccaucucuugcuuccuucuguguguugcuuugcucggcuuuauaaugugggcgugccaaaaggggaacaucagguguaauauuugcaucuga

SEQ ID NO: 134859 - RNA, 1701 nt, Artificial Sequence
  derived and/or modified sequence opt3 from hemagglutinin__InfluenzaA__AJJ98849
augaagaccaucauugcccugagcuacauacucugccuuguguucgcucaggagcugcccggcaacgacaauuccacagcaacuuuguguuuagggcaccaugccgucccuaacggaacgaucguuaaaaccauuacaaaugaucaaaucgaagugacuaacgcgaccgagcugguacagucuucaaguacaggugaaauuugcaauagcccacaccagauccuagacggcgagaacuguacccucauagaugcucugcuuggggacccgcagugcgauggauuucaaaauaagaaaugggaccuguucguggaaagauccaaggcccauucuaacuguuaucccuacgaugucccugacuaugcaucguugaggucacucguggccagcaguggcacucuggaguuuaauaacgaguccuucaauuggacagguguuacccagaacgggacgucuagcgcuugcauccggcgcuccaauaacucauuuuucagucgacugaauuggcucacucacuuaaacuuuaaauacccagcacugaacgugaccaugcccaauaacgaacaguucgauaaacuuuauauuuggggaguccaucacccuggcacagacaaggaucagaucuuuuuguacgcccaagcuagcggccguauuacugugucuaccaagagaucccagcaggccguaaucccaaauauagggucaaggcugcggguucgcaacauucccagcagagugaguaucuauuggacaauugucaagccuggagacauccuacucaucaauucuaccgguaaccugauugcgccaaggggcuacuucaaaauacgguccggaaagagcucgaucaugcgcucugaugcaccgauugggaaauguaauuccgccugcaucacgcccaacggcucaauaccuaaugacaagccauuucagaacgugaaucgaauuacuuacggugcuugucccagauaugugaagcaaaacacacuuaaacuggccaccgggaugaggaaugucccugagaagcagacucggggaaucuucggcgcaaucgcuggcuuuauugaaaacgggugggagggaaugguugacgguugguacggcuuccgucaccagaauagugaggggcgcggacaagccgcggauuugaaaagcacacaggccgcaaucgaccagauuaacggcaagcucaacagacugauagguaaaaccaaugaaaaguuccaucagaucgagaaagaauuuuccgagguggaagggaggauucaagauuuagagaaguauguagaggacacgaagaucgaucuguggucuuacaacgcugaacuccuuguggcccuggagaaucagcacaccaucgacuugacagauagcgaaaugaacaaacuauucgagaagacuaaaaagcagcugcgggaaaaugcugaggacaugggcaacggaugcuuuaaaauuuaucauaagugugauaaugccugcauaggcucaauccgaaacgggaccuacgaccacgaugucuaucgcgacgaggcacucaauaacagauuccagauuaagggaguggaacugaaaagugguuacaaggacuggauccuuuggauuuccuuugccaucagcugcuuccuguuguguguugcucuccugggcuuuauaaugugggcgugccaaaaagggaauaucagguguaacauuugcaucuga

SEQ ID NO: 134860 - RNA, 1701 nt, Artificial Sequence
  derived and/or modified sequence opt3 from hemagglutinin__InfluenzaA__AJJ98861
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacaggugagaucugcgacaguccacaccagauacuagauggcgaaaauuguacccucaucgacgcucugcuuggggauccgcagugcgacggauuucaaaacaaaaagugggaucuguucguggagagaagcaaagccuauuccaauuguuaccccuaugacgucccugauuacgcaucuuugaggucgcucguggccucaagcggcacucuggaauuuaacaaugagaguuucaacuggacagguguuacccagaaugggacguccucugcuugcauucggcgcagcaacaauuccuuuuucucacgacugaacuggcucacucauuuaaaguuuaaguauccagcacugaaugugaccaugcccaacaacgagcaguucgacaaacuuuacaucuggggaguccaccauccuggcacagauaaugaccagaucuuuuuguaugcccaagcuaguggccguauuacugugagcaccaagagaucucagcagacaguaauaccaaacauuggguccaggccccggguucgcaauaucccuucaagaauuagcaucuacuggaccaucgugaaaccaggagauauucugcuaauaaacaguacggguaaucucaucgccccgaggggcuacuucaagauucggucugggaaauccagcaucaugaagucggacgcgcccauaggaaaguguaacucugaaugcauuacuccuaauggcuccaucccaaacgacaaacccuuucagaaugucaaccgcaucacauauggugcauguccucgauacgugaagcaaaauacccugaaacuugccacugggaugagaaacgugccagagaagcagacaaggggaauuuucggcgcuaucgccggcuuuauugaaaaugggugggagggaauggucgaugguugguauggcuuccggcaccagaacucagaggggcguggacaagcagcugaccugaaaaguacccaggccgcgauagaucagaucaauggcaaguugaaccgccucauugguaaaacgaacgaaaaguuccaccagaucgagaaggaauuuagcgagguugaagggagaauccaagaccuggagaaauacguggaggauaccaagauugacuuaugguccuauaaugccgaacugcucguagcacuugagaaccagcauacaauagaucugacugacucugaaaugaauaaauuguucgagaagaccaaaaagcagcuaagggaaaacgcugaggauaugggcaauggaugcuuuaagaucuaccacaaaugugacaacgccugcauuggcagcauccggaaugggacauaugaucaugacguguaccgagacgaggcucugaacaaucgcuuccagauuaagggagucgaacucaaaucagguuacaaggauuggauccuguggauaaguuuugccaucuccugcuuccuucuguguguggcauugcucggcuuuauuaugugggccugccaaaaagggaacaucagauguaauauuugcaucuga

SEQ ID NO: 134861 - RNA, 1701 nt, Artificial Sequence
  derived and/or modified sequence opt3 from hemagglutinin__InfluenzaA__AJJ98873
augaagaccaucauugcccugagcuacucccucugccuuguguucgcucagaaacugcccggcaacgacaauucuacagcaacuuuguguuuagggcaccaugccgucccuaacggaacgauaguuaagaccaucacaaaugaucaaauugaggugacuaacgcgaccgaacugguacagucaaguagcacaggugagaucugcgacuccccacaccagauucuagauggcgaaaauuguacccucaucgacgcucugcuuggggauccgcagugcgacggauuucaaaacaaaaagugggaucuguucguggagagaucuaaagccuauucgaauuguuaccccuaugacgucccugauuacgcaucauugaggagccucguggccaguuccggcacucuggaauuuaacaaugagucuuucaacuggacagguguuacccagaaugggacgagcuccgcuugcauacggaagucaaacaauagcuuuuucagucgccugaacuggcucacucauuuaaaguuuaaauauccagcacugaaugugaccaugcccaacaacgagcaguucgacaaguuguacaucuggggaguccaccauccuggcacagauaaugaccagauuuuucuuuaugcccaggcuucuggccgaaucacuguguccaccaaacguucacaacagacaguaauuccaaacaucgggagcagacccaggguucggaauauaccuagucgcauuucuaucuacuggaccauugugaagccaggagauauccugcuaaucaacuccacggguaaucucauugccccgagaggcuacuucaaaauaaggagcgggaagucgucuaucaugcgguccgacgcgcccauuggaaaguguaacucagaaugcaucacuccuaauggcaguauaccaaacgacaaacccuuucagaaugucaaccgcauuacauauggugcauguccucgauacgugaagcaaaauacccugaaacuugccacugggaugagaaacgugccagagaagcagacaaggggaaucuucggcgcuaucgccggcuuuauugaaaaugggugggagggaauggucgaugguugguauggcuuccggcaccagaacagcgaggggcguggacaagcagcugaccugaaauccacccaggccgcgaucgaucagauuaauggcaaguugaaccgccucauagguaaaacgaacgaaaaguuccaccagaucgagaaggaauuuucugagguugaagggaggauucaagaccuggagaaauacguggaggauaccaagaucgacuuauggagcuauaaugccgaacugcucguagcacuugagaaccagcauacaaucgaucugacugacucagaaaugaauaaauuguucgagaagaccaaaaagcagcuaagagaaaacgcugaggauaugggcaauggaugcuuuaagauuuaccacaaaugugacaacgccugcauaggcaguauccggaaugggacauaugaucaugacguguaccgagacgaggcucugaacaaucgcuuccagauuaagggagucgaacucaaauccgguuacaaggauuggauccuguggauuagcuuugccaucucuugcuuccuucuguguguggcauugcucggcuuuauaaugugggccugccaaaaagggaacaucagauguaauauuugcaucuga

SEQ ID NO: 134862 - RNA, 1701 nt, Artificial Sequence
  derived and/or modified sequence opt3 from hemagglutinin__InfluenzaA__AJJ98885
augaagaccaucauugcccugagcaacauacucugccuuguguucgcucagaaacugcccggcaaugacaacuccacagcaacuuuguguuuagggcaccaugccgucccuaauggaacgaucguuaagaccauuacaaacgaucaaaucgaggugacuaaugcgaccgaacugguacagucuucaaguacaggugagauuugcgacagcccacaccagauccuagauggcgaaaacuguacccucauagacgcucugcuuggggauccgcagugcgacggauuucaaaauaaaaagugggaucuguucguggagagauccaaagccuacucuaacuguuaucccuacgacgucccugauuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucauuuaaaguuuaaguacccagcacugaacgugaccaugcccaacaaagagaaguucgacaaacuuuauauuuggggaguccaccauccuggcacagauaaugaccagaucuuuuuguacgcccaggcuagcggccguauuacugugucuaccaagagaucccaacagacaguaaucccaaacauagggucaaggccccggguucgcaauauuccuagcagaaucaguauuuauuggaccaucgugaaaccaggagauauccugcuaauuaacucuacggguaaucucauagccccgaggggcuacuucaagauccgguccggaaagagcucgauuaugcgcucugacgcgcccaucgggaaauguaacuccgaaugcauaacuccuaauggcucaauuccaaacgacaagcccuuucagaaugucaaccgaaucacauacggugcauguccuagauaugugaaacagaauacccugaagcuggccacugggaugaggaacgugccagagaaacaaacacggggaaucuucggcgcuauugccggcuuuaucgaaaaugggugggagggaauggucgaugguugguacggcuuccgucaccagaacagugaggggauuggacaggcagcugaccuuaagagcacccaagccgcgauagaucagaucaauggcaaauugaaccgccucauugguaagacgaacgaaaaguuccaccagaucgagaaagaauuuuccgagguugaagggagaauccaggaccuggagaaguauguggaggauaccaaaauugacuuauggucuuacaaugccgaacugcucguagcacuugagaaccaacauacaauagaucugacugacagcgaaaugaauaaguuguucgagaaaaccaagaagcagcuaagggaaaacgcugaggauaugggcaauggaugcuuuaaaaucuaucacaagugugacaacgccugcauuggcucaauccggaaugggacauacgaucaugacguguaucgagacgaggcucugaacaaucgcuuccagauuaaaggagucgaacucaagagugguuacaaagauuggauccuguggauauccuuugccaucagcugcuuccuucuguguguggcauugcucggcuuuauuaugugggccugccagaaggggaacaucagauguaauauuugcaucuga

SEQ ID NO: 134863 - RNA, 1701 nt, Artificial Sequence
  derived and/or modified sequence opt3 from hemagglutinin__InfluenzaA__AJJ98897
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacucaaguuucuuuagccgacugaauuggcucacucauuuaaaguuuaaguauccagcacugaacgugaccaugcccaauaacgagaaauucgacaaacuuuacauuuggggaguccaccauccuggcacagauaacgaccagaucuuuuuguaugcccaggcuucuggccguauuacuguguccaccaagagaucacaacagacaguaaucccaaauauagggagcaggccccggguucgcaacauuccuaguagaaucucuauuuacuggaccaucgugaagccaggagauauccugcuaauuaauuccacggguaaccucauagccccgaggggcuacuucaaaauccggagcgggaagucgucuauuaugcgcuccgacgcgcccaucggaaaguguaauucagaaugcauaacuccuaacggcaguauuccaaaugacaaacccuuucagaacgucaaucgaaucacauauggugcauguccuagauacgugaagcagaacacccugaaacuugccacugggaugaggaaugugccagagaagcaaacacggggaaucuucggcgcuauugccggcuuuaucgaaaacgggugggagggaauggucgaugguugguauggcuuccgucaccagaauagcgaggggauuggacaggcagcugaccugaaauccacccaagccgcgauagaucagaucaacggcaaguugaaucgccucauugguaaaacgaacgaaaaguuccaccagaucgagaaggaauuuucugagguugaagggagaauccaggaccuggagaaauacguggaggauaccaagguagacuuauggagcuauaacgccgaacugcucguggcacuugagaaucaacauacaauugaucugacugacucagaaaugaacaaauuguucgagaagaccaaaaagcagcuaagggaaaaugcugaggauaugggcaacggaugcuuuaagauauaccacaaaugugacaaugccugcaucggcaguauucggaacgggacauaugaucaugacgucuaccgagacgaggcucugaauaaccgcuuccagaucaagggaguggaacucaaauccgguuacaaggauuggauucuguggaucagcuuugccauaucuugcuuccuucuguguguugcauugcucggcuuuaucaugugggccugccagaaagggaauauuagauguaacaucugcauuuga

SEQ ID NO: 134864 - RNA, 1701 nt, Artificial Sequence; identical to SEQ ID NO: 133786
  derived and/or modified sequence opt3 from hemagglutinin__InfluenzaA__AJJ98909

SEQ ID NO: 134865 - RNA, 1701 nt, Artificial Sequence
  derived and/or modified sequence opt3 from hemagglutinin__InfluenzaA__AJJ98921
augaagaccaucauugcccugagcuacauacucugccuuguguucgcucagaaacugcccggcaaggacaacuccacagcaacuuuguguuuagggcaccaugccgucccuaauggaacgaucguuaaaaccauuacaaacgaucaaaucgaggugacuaaugcgaccgaacugguacagucuucaaguacaggugagauuugcaacagcccacaccagauccuagacggcgaaaauuguacccucauagaugcucugcuuggggacccgcagugcgauggauuucaaaacaagaaaugggaccuguucguggagagauccaaggccuauucuaauuguuaccccuaugaugucccugacuacgcaucguugaggucacucguggccagcaguggcacucuggaauuuaacaaugaguccuucaacuggacagguguuaagcagaaugggaccucuagcgcuugcauccggcgcuccaacucaaguuucuuuagccgacugaauuggcucacgcauuuaaacuuuaaauauccagcacugaaugugacuaugcccaacaacgagcaguucgauaagcuguacauuuggggaguccaccauccuggcaccgacaaagaucagaucuuuuuguaugcccaaucuuccggccguauuacagugucaacuaagagaagccagcaggcuguaaucccaaauauagggaguaggccccggauucgcaacaucccuucuagaauuuccaucuacuggaccaucguuaaaccaggagacauucugcuaauaaauagcacagguaaccucaucgccccgaggggcuacuucaagauucggucggggaagucuuccaucaugcgcucagaugcgcccauaggaaaauguaauagugaaugcauuaccccuaacggcagcaucccaaaugacaagcccuuucagaacgugaaucgaaucacguauggugcauguccuagauacgucaaacaauccacucugaaacuugccacagggaugaggaacgugccagagaagcagacccggggaauuuucggcgcuaucgccggcuuuauugaaaaugggugggagggaaugguggacgguugguauggcuuccgucaccagaacucugaggggcgcggacaagcagcugaucuuaagagcacucaggccgcgauagaccagaucaauggcaaauugaacagacucauugguaagacaaaugaaaaguuccaccagaucgagaaagaauuuucagaggucgaagggaggauccaagaucuggagaaguacguugaggacaccaaaauugauuuauggaguuauaacgccgaacugcucguggcacuugagaaccagcauacgauagaccugaccgauuccgaaaugaauaaguuguucgagaaaacaaagaagcagcuacgggaaaacgcugaggacaugggcaauggaugcuuuaaaaucuaccacaagugugauaacgccugcauuggcagcauccgaaaugggacuuauaaccaugacguauaccgcgaugaggcucugaauaacagauuccagauuaaaggaguggaacucaagucugguuacaaagacuggauccuguggauaucauuugccaucaguugcuuccuucugugugucgcauugcucggcuuuauuaugugggccugccaaaaggggaauaucagguguaacauuugcaucuga

SEQ ID NO: 134866 - RNA, 1701 nt, Artificial Sequence; identical to SEQ ID NO: 131469
  derived and/or modified sequence opt3 from hemagglutinin__InfluenzaA__AJJ98933

SEQ ID NO: 134867 - RNA, 1701 nt, Artificial Sequence; identical to SEQ ID NO: 128998
  derived and/or modified sequence opt3 from hemagglutinin__InfluenzaA__AJJ98945

SEQ ID NO: 134868 - RNA, 1701 nt, Artificial Sequence
  derived and/or modified sequence opt3 from hemagglutinin__InfluenzaA__AJJ98957
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauagcaaguuuaaguauccagcauuaaaugugaccaugcccaacaacgagcaguucgacaaacuguacauuuggggaguccaccauccuggcacagauaaugaccagaucuuucuuuaugcccaggcuucuggccguauuacuguguccaccaagagaucacaacagacaguaaucccaaacauagggagcaggccccggguucgcaauauuccuaguagaaucucuauuuacuggaccaucgugaaaccaggagauaucuugcugauuaacuccacggguaaucuaauagccccgaggggcuacuucaagauccggagcgggaaaucgucuauuaugcgcuccgacgcgcccaucggaaaguguaacucagaaugcauaacuccuaauggcaguauuccaaacgacaagcccuuucagaaugucaaccgaaucacauauggugcauguccuagauacgugaaacaaaauacccucaagcuggccacugggaugaggaacgugccagagaaacagacacggggaaucuucggcgcuauugccggcuuuaucgaaaaugggugggagggaauggucgaugguugguauggcuuccgucaccagaacagcgaggggcgcggacaagcagcugaccuuaaguccacccaggccgcgauugaucagauaaauggcaaacugaacagauugaucgguaagacgaacgaaaaauuccaccagauugagaaggaauuuucugagguugaagggaggauccaagaccucgagaaguacguggaggauaccaaaaucgaccuguggagcuauaaugccgaauuacugguagcacucgagaaccagcauacaauugaucuuacugacucagaaaugaauaagcuguucgagaaaaccaagaaacaguugcgggaaaacgcugaggauaugggcaauggaugcuuuaagauauaccacaagugugacaacgccugcaucggcaguauucgaaaugggacauaugaucaugacguguaccgcgacgaggcucuaaacaauagauuccagaucaaaggagucgaacugaaguccgguuacaaagauuggauucucuggaucagcuuugccauaucuugcuuccugcuuuguguggcacuguugggcuuuaucaugugggccugccaaaaggggaacauuagguguaauaucugcauuuga

SEQ ID NO: 134869 - RNA, 1701 nt, Artificial Sequence; identical to SEQ ID NO: 124450
  derived and/or modified sequence opt3 from hemagglutinin__InfluenzaA__AJJ98969

SEQ ID NO: 134870 - RNA, 1701 nt, Artificial Sequence
  derived and/or modified sequence opt3 from hemagglutinin__InfluenzaA__AJJ98981
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccauauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacagaacgggaccuccucugcuugcauucgccgaagcaauuccucauuuuucagucgucugaacuggcucacgcacuuaaauuuuaaguauccagcacugaacgugacuaugcccaacaaugagcaauucgacaaacuuuacaucuggggaguccaucacccuggcaccgauaaagaccagaucuuuuuguaugcccagagcucuggcagaauuacaguguccacuaagaggucacagcaagcuguaauaccaaacauugggagccggccccgcaucagaaauguuccuaguaggauuucuaucuacuggaccaucgugaaaccaggagauauucugcuaauaaacuccacagguaaucucaucgccccgcggggcuacuucaagauucgcagcgggaaaucgucuaucaugcgauccgacgcgcccauaggaaaguguaagucagaaugcauuaccccuaacggcaguaucccaaaugacaaacccuuucagaacgucaauagaaucacguauggugcauguccuagguacgugaagcagagcacucugaaacuugccacagggaugcggaacgugccagagaagcagacccguggaauuuucggcgcuaucgccggcuuuauugaaaaugggugggagggaauggucgaugguugguauggcuuccgccaccaaaacuccgaggggagaggacaggcagcugaccugaaaucuacucaggccgcgauagaucaaaucaauggcaaguugaacaggcucauugguaaaacaaaugaaaaguuccaucagaucgagaaggaauuuagcgagguugaagggcggauccaggaccuggagaaauacguggaggauaccaagauugacuuauggucauauaacgccgaacugcucguagcacuugagaaccagcacacgauagaucugaccgacagugaaaugaauaaauuguucgagaagacaaagaagcaacuacgagaaaacgcugaggauaugggcaauggaugcuuuaagaucuaccauaaaugugacaacgccugcauuggcuccauccgcaaugggacuuaugaucacaacguguacagagacgaggcucugaauaacagguuccagauuaagggagucgaacucaaaagcgguuacaaggacuggauccuguggauaucuuuugccaucucaugcuuccuucuguguguggcauugcucggcuuuauuaugugggccugccagaaagggaauauccgguguaacauuugcaucuga

SEQ ID NO: 134871 - RNA, 1701 nt, Artificial Sequence
  derived and/or modified sequence opt3 from hemagglutinin__InfluenzaA__AJJ98993
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagaauagcucaauuggugagaucugcgacaacccacaccagauacuagauggcgaaaauuguacacucaucgacgcucugcuuggggauccgcagugcgacggauuucaaaacaaaaagugggaucuguucguggagagaaguaaagccuauagcaauuguuaccccuaugacgucccugauuacgcauccuugaggucucucguggccucgucaggcacccuggaauuuaacaaugagagcuucaacuggacugguguuacacagaaugggaccaguuccgcuugcaugcggcgcucuaacagcuccuuuuucucacgacugaauuggcucacgcauuuaaacuuuaaguauccagcacugaacgugacuaugcccaauaacgagcaguucgacaaacuuuacauuuggggaguccaccauccuggcaccgauaaggaccagaucuuuuuguaugcccaaaguagcggccguauuacagugucuacuaagagaucccagcaggcuguaaucccaaauauagggucaaggccccggauucgcaacaucccuagcagaauuaguaucuacuggaccaucguuaaaccaggagauauucugcuaauaaauucuacagguaaccucaucgccccgaggggcuacuucaagauucgguccgggaaaagcucgaucaugcgcucugacgcgcccauaggaaaguguaauuccgaaugcauuaccccuaacggcucaaucccaaaugacaagcccuuucagaacgugaaucgaaucacguauggugcauguccuagauacgucaaacaaaguacucugaaacuugccacagggaugaggaacgugccagagaagcagacccggggaauuuucggcgcuaucgccggcuuuauugaaaaugggugggagggaaugguggaugguugguauggcuuccgucaccagaacagcgaggggcgcggacaagcagcugaccugaaguccacucaggccgcgauagaucagaucaauggcaaauugaacagacucauugguaagacaaacgaaaaauuccaccagaucgagaaggaauuuucugaggucgaagggaggauccaagaccuggagaaguacguugaggauaccaaaauugacuuauggagcuauaaugccgaacugcucguggcacuugagaaccagcauacgauagaucugaccgacucagaaaugaauaaguuguucgagaaaacaaagaaacagcuacgggaaaacgcugaggauaugggcaauggaugcuuuaagaucuaccacaagugugacaacgccugcauuggcaguauccgaaaugggacuuaugaucaugacguauaccgcgacgaggcucugaacaauagauuccagauuaaaggaguggaacucaaguccgguuacaaagauuggauccuguggauaucuuuugccaucucuugcuuccuucugugugucgcauugcucggcuuuauuaugugggccugccaaaaggggaacaucagguguaauauuugcaucuga

SEQ ID NO: 134872 - RNA, 1701 nt, Artificial Sequence
  derived and/or modified sequence opt3 from hemagglutinin__InfluenzaA__AJJ99005
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggaucgguguuacacagaacgggaccucuagcgcuugcauucggcgcuccaauaacucauuuuucagucgacugaauuggcucacgcacuuaaacuuuaaguacccagcacugaacgugacuaugcccaauaacgagcaguucgauaagcuguauaucuggggaguccaucacccuggcaccgacaaagaucagaucuuuuuguacgcccaagcuagcggccguauuacagugucuacuaagagaucccagcaggccguaauaccaaauauugggucaaggccccggguucgcaacaucccuagcagagugaguauuuauuggaccaucgucaaaccaggagacauccugcuaauuaauucuacagguaaccucauagcgccgaggggcuacuucaagauccgguccgggaaaagcucgauuaugcgcucugaugcacccaucggaaaguguaauuccgccugcauaaccccuaacggcucaauuccaaaugacaagcccuuucagaacgugaaucgaaucacguacggugcuuguccuagauaugugaaacaaaacacucugaaacuugccacagggaugaggaaugucccagaaaaacagacccggggaaucuucggcgcaauugcuggcuuuaucgagaacgggugggaaggaaugguugacgguugguacggcuuccgucaccagaauagugaggggcgcggacaagccgcggaucuuaagagcacucaggccgcaauugaccagauaaacggcaaauugaacagacucaucgguaagacaaaugagaaauuccaucagauugaaaaggaguuuuccgaaguggaggggaggauccaagaucuggaaaaguauguagaggacaccaaaaucgauuuauggucuuacaacgcugagcugcucguggcccuugaaaaucagcacacgauugaccugaccgauagcgagaugaacaaguuguucgaaaagacaaagaaacagcuacgggagaaugcugaagacaugggcaacggaugcuuuaagauauaucauaagugugauaaugccugcaucggcucaauucgaaacgggacuuacgaccacgaugucuaucgcgacgaggcacugaauaacagauuccagaucaaaggaguggagcucaagagugguuacaaagacuggauucuguggaucuccuuugccauaagcugcuuccuucuguguguugcuuugcucggcuuuaucaugugggcgugccaaaaggggaauauuagguguaacaucugcauuuga

SEQ ID NO: 134873 - RNA, 1701 nt, Artificial Sequence; identical to SEQ ID NO: 125427
  derived and/or modified sequence opt3 from hemagglutinin__InfluenzaA__AJJ99017

SEQ ID NO: 134874 - RNA, 1701 nt, Artificial Sequence
  derived and/or modified sequence opt3 from hemagglutinin__InfluenzaA__AJJ99029
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucaucgagagauccaaagccuauucuaauuguuaccccuaugacgugccugauuacgcaucguugaggucacucgucgccagcaguggcacucuggaauuuaacaaugaguccuucaacuggacaggugugacccagaaugggacgucuagcuccugcauucggcgcucaaacaauagcuuuuucagccgacugaacuggcucacucauuuaaaguuuaaguauccagcucugaauguuaccaugcccaacaacgagcaguucgacaaacuuuacaucuggggagugcaccauccuggcacagauaaugaccagauuuuucuuuaugcacaagccucuggccguaucacugucuccaccaagagaucacagcagacagugauaccaaacauugggagcaggccccggguacgcaauaucccuaguagaauuucuaucuacuggaccaucguuaaaccaggagauauucugcuaauaaacuccacggguaaucucaucgcuccgaggggcuacuucaagauucggagcgggaaaucgucuaucaugcgcuccgacgcccccauaggaaaguguaacucagaaugcauuacuccuaauggcaguaucccaaacgacaagcccuuucagaaugugaaccgaaucacauauggugcguguccuagauacgucaaacaaaauacccugaaguuggcaacugggaugaggaacgugccagagaaacagacacggggaauuuucggcgccaucgcuggcuuuauugaaaaugggugggagggaaugguggaugguugguauggcuuccgucaccagaacagcgaggggcgcggacaagccgcagaccugaaguccacccaggcugccauagaucagaucaauggcaaauugaacagacucauugguaagacgaacgaaaaauuccaccagaucgagaaggaauuuucugaggucgaagggaggauccaagaccuggagaaguacguugaggauaccaaaauugacuuauggagcuauaaugcggaacugcucguggcccuugagaaccagcauacaauagaucugacugacucagaaaugaauaaguuguucgagaaaaccaagaaacagcuacgggaaaacgcagaggauaugggcaauggaugcuuuaagaucuaccacaagugugacaacgcuugcauuggcaguauccgaaaugggacauaugaucauaacguauaccgcgacgaggcccugaauaacagauuccagauuaaaggaguggaacucaaguccgguuacaaagacuggauccuguggauaaguuuugcuaucucuugcuuccuucugugugucgccuugcucggcuuuauuaugugggcaugccaaaaggggaauaucagguguaacauuugcaucuga

SEQ ID NO: 134875 - RNA, 1701 nt, Artificial Sequence
  derived and/or modified sequence opt3 from hemagglutinin__InfluenzaA__AJJ99041
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcaagcggggauccgacaacucauuuuucagucgccugaauuggcucacucauuuaaaguuuaaauauccagcacugaacgugaccaugcccaauaacgagaaguucgauaaacuuuacaucuggggcguccaccauccuggcacagacaacgaucagauuuuuccauaugcccaggcuagcgggcgaaucacugugucuaccaagcguucccaacagacaguaauucccaauaucggaucaagaccuaggguucggaacauaccaagccgcauuaguaucuacuggaccauugugaaaccgggugacaucuugcugaucaauucuacgggcaaccuaauugcccccagaggguacuucaagauaagguccggaaagagcucgaucaugcggucugacgcgccuauuggcaaauguaauuccgguugcaucacuccaaacgggucaauacccaaugauaagccuuuucagaacgucaaucgcauuacauauggagcauguccacgauacgugaaacagaguacccucaagcuggccacuggcaugagaaacgugcccgaaaaacaaacaaggggcaucuucggggcuaucgccggauuuauugagaaugguugggaaggcauggucgacgggugguauggauuccggcaccagaacagcgagggcaucggucaggcagcugaucuuaaguccacccaagccgcgauuaaucagauaaacgggaaacugaaucguuugaucggcaagacgaacgagaaguuccaccagauugaaaaagaguuuucugaaguugagggacgcauccaggaccucgaaaaguacguggaggauaccaaaaucgaccuguggagcuauaacgccgaguuacugguagcacucgaaaaucaacauacaauugaucuuacugacucagagaugaacaagcuguucgaaagaaccaaaaagcaguugagggagaaugcugaagauaugggcaacgggugcuuuaagauauaccacaaaugugacaaugccugcaucggaaguauucggaacgguacauaugaucaugacguguaccgagacgaggcucuaaauaaccgcuuccagaucaagggcgucgagcugaaauccggguacaaggauuggauucucuggaucagcuuugccauaucuugcuuccugcuuuguguggcacuguugggauuuaucaugugggccugccagaaaggcaauauuagauguaacaucugcauuuga

SEQ ID NO: 134876 - RNA, 1701 nt, Artificial Sequence; identical to SEQ ID NO: 131874
  derived and/or modified sequence opt3 from hemagglutinin__InfluenzaA__AJJ99053

SEQ ID NO: 134877 - RNA, 1701 nt, Artificial Sequence; identical to SEQ ID NO: 131874
  derived and/or modified sequence opt3 from hemagglutinin__InfluenzaA__AJJ99065

SEQ ID NO: 134878 - RNA, 1701 nt, Artificial Sequence
  derived and/or modified sequence opt3 from hemagglutinin__InfluenzaA__AJJ99089
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggaacaaagccuauagcaauuguuaccccuaugacgucccugauuacgcauccuugcggucucucguggccucgucaggcacccuggaauuuaacaaugagagcuucaacuggacugguguuacacaaaaugggaccaguuccgcuugcauucgccgaucuaacagcuccuuuuucucacgucugaauuggcucacgcauuuaaacuuuaaguauccagcacugaacgugacuaugcccaauaacgagcaguucgacaaacuuuacaucuggggaguccaccauccuggcaccgauaaagaccagaucuuuuuguaugcccagaguagcggcagaauuacagugucuacuaagaggucccaacaggcuguaauaccaaauauugggucacggccccgcaucagaaacauuccuagcaggaucaguaucuacuggaccauuguuaaaccaggagauauacugcuaaucaauucuacagguaaccucauugccccgcggggcuacuucaagauccgcuccgggaaaagcucgauaaugcgaucugacgcgcccauuggaaaguguaaguccgaaugcaucaccccuaauggcucaaucccaaacgacaaacccuuucagaaugugaacagaauuacguauggugcauguccuagguacgucaagcagaguacucugaaacuugccacagggaugcggaaugugccagagaagcaaacccguggaaucuucggcgcuauugccggcuuuauagaaaacgggugggagggaaugguggaugguugguauggcuuccgccaccagaauagcgaggggagaggacaggcagcugaccugaaauccacucaagccgcgaucgaucagauuaacggcaaguugaauaggcucaucgguaaaacaaacgaaaaguuccaccagaucgagaaggaauuuucugaggucgaagggcggauucaggaccuggagaaauacguugaggauaccaagauagacuuauggagcuauaacgccgaacugcucguggcacuugagaaucaacauacgaucgaucugaccgacucagaaaugaacaaauuguucgagaagacaaagaagcagcuacgagaaaaugcugaggauaugggcaacggaugcuuuaagauuuaccacaaaugugacaaugccugcaucggcaguauucgcaacgggacuuaugaucaugacguauacagagacgaggcucugaauaacagguuccagaucaagggaguggaacucaaauccgguuacaaggauuggauacuguggaucagcuuugccauuucuugcuuccuucugugugucgcauugcucggcuuuaucaugugggccugccagaaagggaauauucgguguaacaucugcauauga

SEQ ID NO: 134879 - RNA, 1701 nt, Artificial Sequence; identical to SEQ ID NO: 131564
  derived and/or modified sequence opt3 from hemagglutinin__InfluenzaA__AJJ99101

SEQ ID NO: 134880 - RNA, 1701 nt, Artificial Sequence; identical to SEQ ID NO: 131469
  derived and/or modified sequence opt3 from hemagglutinin__InfluenzaA__AJJ99113

SEQ ID NO: 134881 - RNA, 1701 nt, Artificial Sequence
  derived and/or modified sequence opt3 from hemagglutinin__InfluenzaA__AJJ99125
augaagaccaucauugcccugagcuacauacucugcaugguguucgcucagaaacuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacaggugagauuugcaauagcccacaccagauccuggacggcgaaaacuguacccuaauagaugcucuccugggggacccgcagugcgauggauuucaaaauaaaaagugggaccuuuucguggagagauccaaagcccauucuaacuguuaucccuacgaugucccugacuaugcaucgcugaggucauugguggccagcaguggcacucucgaauuuaauaacgaguccuucaauuggacagguguuacccagaacgggacgucuagcgcuugcauccggcgcuccucaaauagcuuuuucagucgacugaacuggcugacucaccucaauuuuaaguacccagcauuaaacgugaccaugcccaacaaugagcaguucgauaagcuguauauuuggggaguccaucacccuggcacagacaaagaucagaucuuucuuuacgcccaggcuucuggccguauuacuguguccaccaagagaucacaacaggccguaaucccaaacauagggagcaggccccggguucgcaauauuccuaguagagugucuaucuauuggacaauugucaaaccaggagacaucuugcugaucaacuccaccgguaaucuaauugcgccgaggggcuacuucaagauacggagcgggaaaucgucuaucaugcgcuccgaugcacccauuggaaaguguaacucagccugcaucacgccuaauggcaguauaccaaacgacaagcccuuucagaaugugaaccgaauuacuuacggugcuuguccuagauaugugaaacaaaauacacucaagcuggccaccgggaugaggaacgucccagaaaaacagacucggggaaucuucggcgcaaucgcuggcuuuauugagaaugggugggaaggaaugguugacgguugguacggcuuccgucaccagaacagcgaggggcgcggacaagccgcggaucuuaaguccacacaggccgcaaucgaccagauuaauggcaaacugaacagauugauagguaagaccaacgagaaauuccaucagaucgaaaaggaguuuucugaaguggaggggaggauucaagaucucgaaaaguauguagaggacacgaaaaucgaucuguggagcuacaaugcugaguuacugguggcccucgaaaaccagcacaccaucgaccuuacagauucagagaugaauaagcuguucgagaaaacuaagaaacaguugcgggaaaacgcugaagacaugggcaauggaugcuuuaagauuuaucauaagugugauaacgccugcauaggcaguauccgaaaugggaccuacgaccacgaugucuaucgcgacgaggcacuaaacaauagauuccagauuaaaggaguggagcugaaguccgguuacaaagacuggauccucuggauuagcuuugccaucucuugcuuccugcuuuguguugcucuguugggcuuuauaaugugggcgugccaaaaggggaacaucagguguaauauuugcaucuga

SEQ ID NO: 134882 - RNA, 1701 nt, Artificial Sequence
  derived and/or modified sequence opt3 from hemagglutinin__InfluenzaA__AJJ99137
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuggcacagacaaagaucagaucuuuuuguacgcccaagcuagcggccguauuacugugucuaccaagagaucccagcaggccguaaucccaaauauagggucaaggccccggguucgcaacauuccuagcagagugaguaucuauuggacaauugucaaaccaggagacauccugcuaaucaauucuaccgguaaccucauugcgccgaggggcuacuucaagauacgguccgggaaaagcucgaucaugcgcucugaugcacccauuggaaaguguaauuccgccugcaucacgccuaacggcucaauaccaaaugacaagcccuuucagaacgugaaucgaauuacuuacggugcuuguccuagauaugugaaacaaaacacacugaaacuugccaccgggaugaggaaugucccagaaaaacagacucggggaaucuucggcgcaaucgcuggcuuuauugagaacgggugggaaggaaugguugacgguugguacggcuuccgucaccagaauagugaggggcgcggacaagccgcggaucuuaagagcacacaggccgcaaucgaccagauuaacggcaaauugaacagacucauagguaagaccaaugagaaauuccaucagaucgaaaaggaguuuuccgaaguggaggggaggauucaagaucuggaaaaguauguagaggacacgaaaaucgauuuauggucuuacaacgcugagcugcucguggcccuugaaaaucagcacaccaucgaccugacagauagcgagaugaacaaguuguucgaaaagacuaagaaacagcuacgggagaaugcugaagacaugggcaacggaugcuuuaagauuuaucauaagugugauaaugccugcauagucucaauccgaaacggcaccuacgaccacgauguguaucgcgacgaggcacugaauaacagauuccagauuaaagggguugagcucaagaguggauacaaagacuggauccuguggauuuccuuugccaucagcugcuuccuucuguguguggcuuugcucgguuuuauaaugugggcgugccaaaagggcaauaucagguguaacauuugcaucuga

SEQ ID NO: 134883 - RNA, 1701 nt, Artificial Sequence
  derived and/or modified sequence opt3 from hemagglutinin__InfluenzaA__AJJ99149
augaagaccaucauugcccugagcuacauacucugccuuguguucgcucagaaauuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacaggugagauuugcgacagcccacaccagauccuggauggcaaaaauuguacccuaauagacgcucuccugggggauccgcagugcgacggauuccaaaacaagaaaugggaucuuuuuguggaaagauccaaggccuauucuaauuguuaccccuaugacaugccugauuacgcaucgcugaggucauuggucgccagcaguggcacucucgaguucaacaaugaauccuuuaacuggacaggugugacccagaaugggacgucuagcgcuugcauccggcgcuccaacucaaguuucuuuagccgacugaauuggcugacucaucucaacuucaaguaucaggcauuaaauguuaccaugccaaacaacgagcaguuugacaaacuguacauuuggggagugcaccaucccggcacagauaaggaccaaaucuuccuuuaugcccaggcuucuggccguauuacugucuccaccaaaagaucacagcagacagugaucccuaauauagggagcaggccacggguacgcaacauucccaguagaaucucuauuuacuggaccaucguuaagccuggagauaucuugcugauuaauuccacggguaaccuaauagccccaaggggcuacuuuaaaauccaaagcgggaagucgucuauuaugcgguccgacgcgccgaucggaaaguguaauucagagugcauaacucccaacggcaguauuccuaaugacaaaccauuccagaacgugaaucgcaucacauauggugcauguccccgauacgucaagcagaacacccucaaacuggccacugggaugagaaaugugccugaaaagcaaacaaggggaaucuuuggcgcuauugccggcuucaucgagaacgggugggaaggaaugguggaugguugguauggcuuccggcaccagaauagcgaggggcguggacaggcagcugaccuuaaauccacccaggccgcgauugaucaaauaaacggcaagcugaaucgcuugaucgguaaaacgaacgagaaguuucaccagauugaaaaggaguucucugaagucgaggggagaauccaggaccucgaaaaauacguugaggauaccaagaucgaccuguggagcuauaacgccgaguuacugguggcacucgaaaaucagcauacaauugaucuuacugacucagagaugaacaaacuguuugaaaagaccaaaaagcaauugagggagaaugcugaagauaugggcaacggaugcuucaagauauaccacaaaugugacaaugccugcaucggcaguauucggaacgggacauaugaucaugacguauaccgagacgaggcucuaaauaaccgcuuucagaucaagggaguggagcugaaauccgguuacaaggauuggauucucuggaucagcuucgccauaucuugcuuucugcuuugugucgcacuguugggcuucaucaugugggccugccagaaagggaauauuagauguaacaucugcauuuga

SEQ ID NO: 134884 - RNA, 1701 nt, Artificial Sequence
  derived and/or modified sequence opt3 from hemagglutinin__InfluenzaA__AJJ99161
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcgauauuccuagcagaaucaguauuuacuggaccaucgugaaaccaggagacauccugcuaauuaauucuacggguaaccucauagccccgaggggcuacuucaagauccgguccgggaaaagcucgauuaugcgcucugacgcgcccaucggaaaguguaauuccgaaugcauaacuccuaacggcucaauuccaaaugauaagcccuuucagaacgucaaucgaaucacauauggugcauguccuagauacgugaaacaaaacacccugaagcuggccacugggaugaggaaugugccagagaaacagacacggggaaucuucggcgcuauugccggcuuuaucgaaaacgggugggagggaauggucgacgguugguauggcuuccgucaccagaauagugaggggcgcggacaagcagcugaucuuaagagcacccaggccgcgauugaccagauaaacggcaaauugaauagacucaucgguaagacgaacgaaaaauuccaccagauugagaaggaauuuuccgagguugaagggaggauccaagaucuggagaaguacguggaggacaccaaaaucgauuuauggucuuauaacgccgaacugcucguagcacuugagaaucagcauacaauugaccugacugauagcgaaaugaacaaguuguucgagaaaaccaagaaacagcuacgggaaaaugcugaggacaugggcaacggaugcuuuaagauauaccacaagugugauaaugccugcaucggcucaauucgaaacgggacauaugaccaugacguguaccgcgaugaggcucugaauaacagauuccagaucaaaggagucgaacucaagagugguuacaaagacuggauucuguggaucuccuuugccauaagcugcuuccuucuguguguggcauugcucggcuuuaucaugugggccugccaaaaggggaauauuagguguaacaucugcauuuga

SEQ ID NO: 134885 - RNA, 1701 nt, Artificial Sequence
  derived and/or modified sequence opt3 from hemagglutinin__InfluenzaA__AJJ99173
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagccuauucuaacuguuaccccuaugaugucccugacuacgcaucguugaggucacucguggccagcaguggcacucuggaauuuaauaacgaguccuucaauuggacagguguuacccagaacgggacgucuagcgcuugcauccggcgcuccaauucaaguuucuuuagccgacugaacuggcucacucauuuaaaguuuaaguauccagcacugaaugugaccaugcccaacaacgagcaguucgauaaacuuuacauuuggggaguccaccauccuggcacagacaaugaucagaucuuuuuguaugcccaggcuucuggccguauuacuguguccaccaagagaucacaacagacaguaaucccaaacauagggagcaggccccggguucgcaauauuccuaguagaaucucuauuuacuggaccaucgugaaaccaggagacauccugcuaauuaacuccacggguaaucucauagccccgaggggcuacuucaagauccggagcgggaaaucgucuauuaugcgcuccgaugcgcccaucggaaaguguaacucagaaugcauaacuccuaauggcaguauuccaaacgacaagcccuuucagaaugucaaccgaaucacauauggugcauguccuagauacgugaaacaaaauacccugaaacuugccacugggaugaggaacgugccagagaagcagacacggggaaucuucggcgcuauugccggcuuuaucgaaaaugggugggagggaauggucgacgguugguauggcuuccgucaccagaacagcgaggggcgcggacaagcagcugaucugaaguccacccaggccgcgauugaccagauaaauggcaaauugaacagacucaucgguaagacgaacgaaaaauuccaccagauugagaaggaauuuucugagguugaagggaggauccaagaucuggagaaguacguggaggacaccaaaaucgauuuauggagcuauaaugccgaacugcucguagcacuugagaaccagcauacaauugaccugacugauucagaaaugaauaaguuguucgagaaaaccaagaaacagcuacgggaaaacgcugaggacaugggcaauggaugcuuucgaauauaccacaagugugauaacgccugcaucggcaguauucgcaaugggacauaugaccaugauguguacagagacgaggcucugaacaauagguuccagaucaagggagucgaacucaaauccgguuacaaggacuggauucuguggaucagcuuugccauaucuugcuuccuucuguguguggcauugcucggcuuuaucaugugggccugccaaaaagggaacauucgguguaauaucugcauuuga

SEQ ID NO: 134886 - RNA, 1701 nt, Artificial Sequence
  derived and/or modified sequence opt3 from hemagglutinin__InfluenzaA__AJJ99185
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggaaguccaacaauucauuuuucagucgccugaacuggcucacucauuuaaaguuuaaauauccagcacugaaugugaccaugcccaacaacgagcaguucgacaaacuuuacauuuggggaguccaccauccuggcacagauaaugaccagaucuuuuuguaugcccaagcuagcggccgaauuacugugucuaccaagcguucccagcagacaguaaucccaaacauagggucaagacccaggguucggaauauuccuagccgcaucaguauuuacuggaccaucgugaagccaggagauauccugcuaauuaacucuacggguaaucucauagccccgagaggcuacuucaaaaucagguccggaaagagcucgauuaugcgggcggacgcacccaucgggaaguguaacucugaaugcauaacuccuaauggcuccauuccaaacgacaaacccuuucagaaugucaaccgcaucacauauggugccuguccucgauacgugaagcaaaauacccugaaacuugcuacugggaugagaaacgugccagagaagcagacaaggggaaucuucggcgccauugcaggcuuuaucgaaaaugggugggagggaauggucgaugguugguauggcuuccggcaccagaacucagaggggcguggacaagcugccgaccugaaaaguacccaggcggccauugaucagauaaauggcaaguugaaccgccucaucgguaaaacgaacgaaaaguuccaccagauugagaaggaauuuagcgagguugaagggagaauccaagaccuggagaaauacguggaggauaccaagaucgacuuaugguccuauaaugcagaacugcucguagcucuugagaaccagcauacaauugaucugacugacucugaaaugaauaaauuguucgagaagaccaaaaagcagcuaagggaaaacgccgaggauaugggcaauggaugcuuuaagauauaccacaaaugugacaacgcuugcaucggcagcauucggaaugggacauaugaucaugacguguaccgagacgaggcccugaacaaucgcuuccagaucaagggagucgaacucaaaucagguuacaaggauuggauucuguggaucaguuuugcaauauccugcuuccuucuguguguggccuugcucggcuuuaucaugugggcuugccaaaaagggaacauuagauguaauaucugcauuuga

SEQ ID NO: 134887 - RNA, 1701 nt, Artificial Sequence; identical to SEQ ID NO: 130824
  derived and/or modified sequence opt3 from hemagglutinin__InfluenzaA__AJJ99197

SEQ ID NO: 134888 - RNA, 1701 nt, Artificial Sequence
  derived and/or modified sequence opt3 from hemagglutinin__InfluenzaA__AJJ99209
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggaaguccgacaacucauuuuucagucgccugaauuggcucacucauuuaaaauuuaaguauccagcacugaacgugaccaugcccaauaacgaggaguucgauaaacuuuacaucuggggcguccaccauccuggcacagacaacgaucagauuuuucuuuaugcccaggcuagcgggcgaaucacugugucuaccaagcguucccaacagacaguaauuccaaauaucggaucaagacccaggguucggaacauaccuagccgcauuaguaucuacuggaccauugugaaaccaggugacauccugcuaaucaauucuacgggcaaccucauugccccgagaggguacuucaagauaagguccggaaagagcucgaucaugcggucugacgcgcccauuggcaaauguaauuccgaaugcaucacuccuaacgguucaauaccaaaugauaagcccuuucagaacgucaaucgcauuacauauggggcauguccucgauacgugaaacagaguacccugaaguuggccacuggaaugagaaacgugccagagaaacaaacaaggggcaucuucggcgcuaucgccggguuuauugaaaauggaugggaggguauggucgacggcugguauggguuccggcaccagaacagcgagggaaucggccaggcagcugaucugaaguccacccaagccgcgauuaaucagauaaacgguaaauugaaucgucucaucgggaagacgaacgaaaaguuccaccagauugagaaagaauuuucugagguugaaggccgcauccaggaccuggagaaguacguggaggauaccaaaaucgacuuauggagcuauaacgccgaacugcucguagcacuugagaaucaacauacaauugaucugacugacucagaaaugaacaaguuguucgagagaaccaaaaagcagcuaagggaaaaugcugaggauaugggaaacggcugcuuuaagauauaccacaaaugugacaaugccugcaucgggaguauucggaacggaacauaugaucaugacguguaccgagacgaggcucugaauaaccgcuuccagaucaagggugucgaacucaaauccggcuacaaggauuggauucuguggaucagcuuugccaugucuugcuuccuucuguguguggcauugcucggguuuauaaugugggccugccagaaaggaaauaucagauguaacauuugcaucuga

SEQ ID NO: 134889 - RNA, 1701 nt, Artificial Sequence
  derived and/or modified sequence opt3 from hemagglutinin__InfluenzaA__AJJ99221
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacucaaguuucuuuagccgacugaauuggcucacucauuuaaaguuuaaguauccagcacugaacgugaccaugcccaauaacgagaaauucgacaaacuuuacauuuggggaguccaccauccuggcacagauaacgaccagaucuuuuuguaugcccaggcuucuggccguauuacuguguccaccaagagaucacaacagacaguaaucccaaauauagggagcaggccccggguucgcaacauuccuaguagaaucucuauuuacuggaccaucgugaagccaggagauauccugcuaauuaauuccacggguaaccucauagccccgaggggcuacuucaaaauccagagcgggaagucgucuauuaugcgguccgacgcgcccaucggaaaguguaauucagaaugcauaacuccuaacggcaguauuccaaaugacaaacccuuucagaacgucaaucgcaucacauauggugcauguccucgauacgugaagcaaaacacccugaaacuugccacugggaugagaaaugugccagagaagcagacaaggggaaucuucggcgcuauugccggcuuuaucgaaaacgggugggagggaauggucgaugguugguauggcuuccggcaccagaauagcgaggggauuggacaagcagcugaccugaaauccacccaggccgcgauagaucagaucaacggcaaguugaaucgucucauugguaaaacgaacgaaaaguuccaccagaucgagaaggaauuuucugagguugaagggcgcauccaagaccuggagaaauacguggaggauaccaagauugacuuauggagcuauaacgccgaacugcucguagcacuugagaaucagcauacaauagaucugacugacucagaaaugaacaaauuguucgagaagaccaaaaagcagcuaagagaaaaugcugaggauaugggcaacggaugcuuuaagaucuaccacaaaugugacaaugccugcauuggcaguaucaggaacgggacauaugaucaugacguguaccgggacgaggcucugaauaaccgauuccagauuaagggagucgaacucaaauccgguuacaaggauuggauccuguggaucagcuuugccauaucuugcuuccuucuguguguggcauugcucggcuuuauuaugugggccugccaaaaagggaauauccgcuguaacauuugcaucuga

SEQ ID NO: 134890 - RNA, 1701 nt, Artificial Sequence; identical to SEQ ID NO: 123931
  derived and/or modified sequence opt3 from hemagglutinin__InfluenzaA__AJJ99233

SEQ ID NO: 134891 - RNA, 1701 nt, Artificial Sequence
  derived and/or modified sequence opt3 from hemagglutinin__InfluenzaA__AJJ99244
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuggaucggacaacggcacuugcuauccaggugauuuuaucgacuacgaagaguugagggagcagcucucaagcgugaguuccuucgaacgguuugagauuuucccgaagacaucuagcuggcccaaucacgauuccaacaagggggucaccgccgcuuguccucaugcaggagccaaaggcuuuuauaagaaucugaucuggcuggugaaaaagggcaacucauacccaaaacucaguaagagcuauauaaaugacaaggggaaagaaguauuaguucuguggggaauccaccaccccucuacgacugcugaucaacagucccuuuaccagaacgccgacaccuacguguucgucgguacaucacgcuauagcaagaaauuuaagccugagauugcgauccgaccaaaagugcgugaucaggagggcagaaugaauuacuauuggacuuugguggaacccggggacaagauuaccuucgaggcaacaggaaaccuggucguuccuagguacgccuuugcuauggaacggaacgccggcagugguaucauaauuucugauaccccagugcaugacugcaauacgacuugucaaacaccgaaaggggcaaucaacaccucccuacccuuccagaauauucacccuaucacuaucggaaagugcccaaaguauguaaaaagcacaaagcuccgccuggcuaccggccuuagaaacgugcccucgauucagucuaggggccuguuuggggccauagcgggauucaucgaggguggcuggacggggauggucgacggaugguacggcuaucaucaccagaaugaacaagguuccggguacgccgcagauuugaaaucaacccagaacgcuauugacaagaucacaaauaaagugaacaguguuauagagaagaugaauacucaguuuaccgccgugggcaaggaguucaaccaccucgaaaaacggauugagaaucugaacaagaaagucgaugacggauucuuagauaucuggacauacaaugcugaacugcucgugcuucuggagaacgaacgcacuuuggacuaucaugauagcaauguaaagaaccuauacgagaaaguucgaaaccagcugaagaauaacgccaaggagaucggcaauggguguuuugaguucuaucacaaaugcgacaacaccuguauggaauccgugaagaauggaacauacgauuauccuaaauacucugaagaggcaaagcucaacagagaagagauugacggugucaaacuggagagcaccaggaucuaucaaauucuugccauauacucaacuguggcuaguucccuggucuuggugguuagccucggcgcgaucucuuuuuggaugugcucaaaugggagucugcagugccggauuuguaucuga

SEQ ID NO: 134892 - RNA, 1701 nt, Artificial Sequence
  derived and/or modified sequence opt3 from hemagglutinin__InfluenzaA__AJJ99255
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaaucacaacgggaagcuauguaaacucagaggaguggcuccccugcaucuugguaagugcaauauagccggcuggauccuggggaacccugagugugaaucuuugucaacagcaaguagcugguccuacauuguugagaccucuucgucagacaauggaacuugcuauccaggcgauuuuaucaacuacgaagaacucagggagcagcugagcaguguguccucuuucgaacgguuugagauuuucccgaaaacaagcuccuggcccaaucacgacucaaacaagggugucaccgccgcuuguccucgcgcaggggccaagaguuuuuauaaaaaucugaucuggcucgugaagaaaggaaacagcuacccaaaguuaucuaaauccuauauaaaugauaagggcaaggaaguacugguuauguggggcauccaucaccccucaacgacugcugaccaacagagccuuuaccagaacgccgaugcguacguguucgucgggaccagucgauauucuaaagaguuuaagccugagauugcaauccguccaaaagugagagaccaggaaggaaggaugaacuacuauuggacauugguggagcccggugauaagauuacuuucgaagccaccggcaaucugcuagucccucgguacgcuuuugccauggagcgcaacgcaggguccggaaucauaauuagcgacacaccaguucacgauugcaauaccacgugucaaacuccgaaaggcgcuaucaacacaucgcuccccuuccagaauauucauccuaucaccaucgguaagugcccaaaauaugugaagucuacuaagcugagacuugccacagggcugaggaacguacccuccauucagucacggggauuguuuggcgcgauagccggcuucaucgaagggggauggaccgguaugguggacggcugguacggguaucaccaucagaaugagcaaggaaguggcuacgcagcugaccucaaaagcacgcagaacgccauugauaagaucaccaauaaagucaacuccgugauagagaagaugaauacacaguuuacugcuguugguaaagaguucaaccaccuggagaagcgcauugaaaauuuaaacaagaaaguggacgauggguuccuggacaucuggaccuacaaugccgagcuccuuguccuguuggaaaacgagcgaacacuagauuaucacgacucuaacgugaagaaucuguacgagaaaguaagaaaccagcucaagaauaacgcaaaagaaaucggcaauggauguuuugaguucuaucauaagugcgauaacacuuguauggaaagcguuaagaauggcaccuacgacuauccuaaauacucagaggaagccaagcugaacagggaggagauugauggggugaaacuugaaaguacacggaucuaucaaauucuggcuauauacuccaccgucgcgagcucuuuggugcucgucgugucacugggagcaaucaguuuuuggaugugcagcaaugguuccuuacagugccguauuuguaucuga

SEQ ID NO: 134893 - RNA, 1698 nt, Artificial Sequence
  derived and/or modified sequence opt3 from hemagglutinin__InfluenzaA__AJJ99267
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacuaucacaggugucucugccagcugcucccauaauggggaaucaaguuuuuaucggaacuuacuguggcuuaccggcaaaaauggauuguaccccaaccugagcaagucuuaugcaaauaacaaagagaaggaagugcuaguacucuggggcguucaccacccuccaaacauaggggaccagaaagcccuguaccauacggagaaugcuuacguguccgucgugucaagccacuauagucgcaaguucacucccgaaaucgcaaagcgaccuaaagugcgugaucaggagggaagaauuaacuacuauuggacccuucuggagccaggugacacaaucauuuuugaagccaauggcaacuugaucgcuccgagguacgccuucgcgcucucucggggguuuggauccggcauaauuaauagcaacgcacccauggauaagugugacgccaaaugccagacuccucaaggugcuaucaauucgucucugccauuccagaacguccaucccguuaccauuggggaguguccuaaguaugugcgcuccgccaaauuaagaaugguaacaggacugaggaauaucccaucaauccagagucggggccucuuuggcgcaauugcuggguucauagaaggagguuggaccggcaugguggaugggugguacggauaucaccaccagaacgagcaaggcagcgguuacgccgcggaccagaaguccacgcagaaugccaucaacgggauuacuaauaaagucaacucugugaucgaaaagaugaauacacaguuuaccgcaguuggcaaggaguucaacaaacuugagcgccgaauggaaaaccugaauaagaaaguggaugacggauucauagauauuuggacuuacaacgcugaguugcuaguccugcucgaaaaugagagaacacuggacuuucaugacagcaacgugaagaaucuuuaugaaaaaguaaagucacaacugaagaacaaugccaaagagaucggcaacgggugcuucgaguuuuaccacaaguguaaugaugaaugcauggagaguguuaaaaacggaaccuaugacuaccccaaguauuccgaagagagcaaauugaauagggagaagaucgauggugugaagcucgaaucuaugggcgucuaccagauucuggcuaucuauucaacgguggccaguagcuuaguccugcuagugucccucggggcaguuucuuucuggaugugcucgaacggaagccugcagugucgggugugcauuuga

SEQ ID NO: 134894 - RNA, 1701 nt, Artificial Sequence; identical to SEQ ID NO: 129066
  derived and/or modified sequence opt3 from hemagglutinin__InfluenzaA__AJJ99278

SEQ ID NO: 134895 - RNA, 1701 nt, Artificial Sequence; identical to SEQ ID NO: 129069
  derived and/or modified sequence opt3 from hemagglutinin__InfluenzaA__AJJ99289

SEQ ID NO: 134896 - RNA, 1698 nt, Artificial Sequence
  derived and/or modified sequence opt3 from hemagglutinin__InfluenzaA__AJJ99301
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaaagucucauuagcaaagaguccuggucuuacaucguugaaaagccaaacccggagaauggaaccuguuaucccggccauuuugcugauuacgaggaacugagagagcaacugucgucagugagcaguuucgaaagguuugagauuuucccuaaggaguccucuuggccaaaccacacugucacaggugugagcgccuccugcucacauaauggggaaaguagcuuuuaucggaaccucuuauggcugaccggcaaaaauggacuuuaccccaacuugucuaaguccuaugcaaauaacaaagagaaggaaguacugguucuauggggcgugcaccacccuccaaacaucggggaccagaaagcccucuaccauacggagaaugcuuacgucucaguggugagcagucacuauucucgcaaguucacucccgaaauagcaaagcgaccuaaaguccgugaucaggagggaagaaucaacuacuauuggacccugcuugagccaggugacacaauuaucuuugaagccaauggcaaccugauugcuccgagguacgccuucgcguugucccggggguuuggaagcggcaucauaaauucgaacgcacccauggauaagugugacgccaaaugccagacuccucaaggugcuauuaauucuucccucccauuccagaacguucaucccgugaccaucggggaguguccuaaguauguacgcucagccaaacugagaauggugacaggauuaaggaauauuccaaguauccagagccggggccuguuuggcgcaaucgcuggguucauugaaggagguuggaccggcauggucgaugggugguacggauaucaccaccagaacgagcaaggcuccgguuacgccgcggaccagaagucuacgcagaaugccauaaacgggaucacuaauaaagugaacagcguuauugaaaagaugaauacacaguuuaccgcagugggcaaggaguucaacaaacucgagcgccgaauggaaaaccuuaauaagaaagucgaugacggauucaucgauauauggacuuacaacgcugagcuguuggugcuacuggaaaaugagagaacacucgacuuucaugacucaaacguaaagaaucuguaugaaaaaguuaagagucaacuuaagaacaaugccaaagagauuggcaacgggugcuucgaguuuuaccacaaguguaaugaugaaugcauggaguccgugaaaaacggaaccuaugacuaccccaaguauagcgaagagucuaaacugaauagggagaagaucgauggugucaaguuggaaucaaugggcguguaccagauccucgcuauuuauaguacggucgccagcucccugguguuacugguuucucuaggggcaaucucguucuggaugugcagcaacggaucccuccagugucggauuugcauauga

SEQ ID NO: 134897 - RNA, 1698 nt, Artificial Sequence
  derived and/or modified sequence opt3 from hemagglutinin__InfluenzaA__AJJ99324
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaaacucauuuuaucggaauuuacuguggcuuaccggaaaaaguggcuuguaccccaaccugagcaagucuuaugcaaauaacaaagagaaggaaguucuaguacucuggggcgugcaccacccuccaaacaucgccgaccagaaaacgcuguaccauacugagaaugcuuacgucuccguggugucaagccacuauagucgcaaguucacccccgaaauagcaaagcgaccuaaaguccgugaucaggaggggagaaucaacuacuauuggacacuucuggagccaggagacacuauuaucuuugaagccaaugguaacuugauugcuccgagguacgccuucgcgcucucucggggcuuuggguccggaaucauaaauagcaacgcacccauggauaagugugacgccaaaugccagaccccucaaggcgcuauuaauucgucucugccauuccagaacguucaucccgugacaaucggugaguguccuaaguauguacgcuccgccaaauuaagaauggugaccgggcugaggaauauuccaucaauccagagucggggacucuuuggcgcaaucgcuggcuucauugaagggggauggacggguauggucgauggcugguacggguaucaccaccagaacgagcaaggaagcggcuacgccgcggaccagaaguccacucagaaugccauaaacgguaucacaaauaaagugaacucuguuauugaaaagaugaauacccaguuuacugcaguggggaaggaguucaacaaacuugagcgccgaauggaaaaccugaauaagaaagucgaugacggcuucaucgauauauggacauacaacgcugaguugcuagugcugcucgaaaaugagagaacccuggacuuucaugacagcaacguaaagaaucuuuaugaaaaaguuaagucacaacugaagaacaaugccaaagagauuggaaacggcugcuucgaguuuuaccacaaguguaaugaugaaugcauggagagugugaaaaacgggacguaugacuaccccaaguauuccgaagagagcaaauugaauagggagaagaucgauggagucaagcucgaaucuauggguguguaccagauccuggcuauuuauucaaccgucgccaguagcuuagugcugcuaguuucccucggcgcaaucucuuucuggaugugcucgaacgggagccugcagugucggauuugcauauga

SEQ ID NO: 134898 - RNA, 1701 nt, Artificial Sequence
  derived and/or modified sequence opt3 from hemagglutinin__InfluenzaA__AJJ99335
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucaaacaauggaacuugcuauccaggcgacuuuaucgauuacgaggagcucagggaacagcugagcaguguguccucuuucgagcgguuugaaauuuucccgaaaacaagcuccuggcccaaccacgacucaaauaagggugucaccgccgcuuguccucaugcaggggccaagaguuuuuauaaaaaccugaucuggcucgugaagaaaggaaauagcuacccaaaguuaucuaaauccuauauaaacgauaagggcaaggagguacugguucuuuggggcauccaccaccccucaacgagcgcugaccaacagaguuuguaccagaaugccgaugcguacguguucgucgggucuucccgcuauagcaaaaaguuuaaaccugagauugcaauccgaccaaaggugcgugaccaggaaggaagaaugaacuacuauuggacucugguggagcccggugauaaaauuaccuucgaagccacaggcaaccuagucguuccuagguacgcuuuugccauggagcggaaugcagggucgggaaucauaauuucugacacuccagugcaugauugcaacaccacaugucaaaccccgaauggcgcuaucaacacgucccuccccuuccacaauauucauccuaucacuaucgguaagugcccaaaauauguaaagucaacaaagcugcgccuugccaccgggcugagaaacgugcccaguauucagagcaggggauuguuuggcgcgauagccggcuucaucgaagggggauggacugguauggucgacggcugguacggguaucaccaccagaaugagcagggauccggcuacgcagcugaccucaaaucuacacaaaacgccauugaugagaucaccaauaaggugaacagcguuauagaaaagaugaauacgcaguuuaccgcuguggguaaggaguucaaccaucuggaaaaacggauugagaauuuaaacaagaaggucgacgauggguuccuggacaucuggacauacaaugccgaacuccuugugcuguuggagaacgagcgcacucuagauuaucacgacucaaacguuaaaaaucuguacgaaaagguacgaagucagcucaaaaacaaugcaaaggagaucggcaacggauguuuugaguucuaucauaaaugcgauaauaccuguauggaauccgugaagaacggcacauacgacuauccuaaguacagcgaagaggccaaacugaauagagaggaaauugauggggucaaacuugagucuacuaggaucuaucagauucuggcuauauacucaaccguggcgaguagcuugguccucgugguuucccugggagcaaucucuuuuuggaugugcucgaacgguagcuuacaaugccggauuuguaucuga

SEQ ID NO: 134899 - RNA, 1701 nt, Artificial Sequence; identical to SEQ ID NO: 126801
  derived and/or modified sequence opt3 from hemagglutinin__InfluenzaA__AJJ99357

SEQ ID NO: 134900 - RNA, 1701 nt, Artificial Sequence; identical to SEQ ID NO: 128840
  derived and/or modified sequence opt3 from hemagglutinin__InfluenzaA__AJJ99368

SEQ ID NO: 134901 - RNA, 1701 nt, Artificial Sequence; identical to SEQ ID NO: 128451
  derived and/or modified sequence opt3 from hemagglutinin__InfluenzaA__AJJ99379

SEQ ID NO: 134902 - RNA, 1701 nt, Artificial Sequence
  derived and/or modified sequence opt3 from hemagglutinin__InfluenzaA__AJJ99390
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcaugacugcaauaccacaugucaaaccccgaagggcgcuaucaacacgucccuccccuuccacaauauucauccuaucacuaucgguaaaugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaccaccagaaugagcagggauccggcuacgcagcugaucucaagucuacacaaaacgccauugacaaaaucaccaauaaggugaacagcguuauagagaaaaugaauacgcaguuuaccgcuguggguaaggaguucaaccaucuggaaaagcggauugaaaauuuaaacaaaaaggucgaugacggguuccuggauaucuggacauacaaugccgagcuccuugugcuguuggaaaacgagcgcacucuagacuaucacgauucaaauguaaagaaccuguacgagaagguucgaagucagcucaaaaacaaugcaaaggaaaucggcaacggauguuuugaguucuaucauaagugcgacaauaccuguauggaauccgugaaaaacggcacauacgauuauccuaaguacagcgaggaagccaaacugaauagagaggagauugacggggucaaacuugaaucuacuaggaucuaucagauucuggcuauauacucaaccguggcgaguagcuugguccucgugguuucccugggagcaaucucuuuuuggaugugcucgaacgguagcuuacaaugccggauuuguaucuga

SEQ ID NO: 134903 - RNA, 1701 nt, Artificial Sequence; identical to SEQ ID NO: 126801
  derived and/or modified sequence opt3 from hemagglutinin__InfluenzaA__AJJ99401

SEQ ID NO: 134904 - RNA, 1698 nt, Artificial Sequence
  derived and/or modified sequence opt3 from hemagglutinin__InfluenzaA__AJJ99413
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaaacucauuuuaucggaauuuacuguggcuuaccggcaaaaacggauuguaccccaaucugaguaagagcuaugcaaacaacaaagagaaggaagugcuaguucucuggggcgugcaccacccuccaaauaucgccgaccagaaaacgcuguaccauacugagaacgcuuacgucucugugguguccucacacuauagccgcaaguucacccccgaaauagcaaagcgaccuaaaguccgugaucaggaggggagaaucaauuacuauuggacacuucuggagccaggagacacuauuaucuuugaagccaacgguaauuugauugcuccgagguacgccuucgcgcucagucggggcuuugggucuggaaucauaaacuccaaugcaagcauggauaagugugacgccaaaugccagacaccccaaggcgcuauuaacucgucucugccuuuccagaauguucauccagugaccaucggugagugucccaaguauguacgcuccgccaaauuaagaauggugaccgggcugaggaacauuccuucaauccagagucggggacucuuuggcgcaaucgcuggcuucauugaagggggauggacggguauggucgauggcugguacggguaucaccaccagaaugagcaaggaagcggcuacgccgcggaccagaaguccacucagaacgccauaaaugguaucacaaacaaaguaaauucuguuauugaaaagaugaacacccaguuuacugcaguggggaaggaguucaacaaacuugagcgccgaauggaaaaucugaacaagaaagucgaugacggcuucaucgauauauggacauacaaugcugaguugcuagugcugcucgaaaacgagagaacccuggacuuucaugacagcaauguaaagaaccuuuaugaaaaaguuaagucacaacugaagaauaacgccaaagagauuggaaauggcugcuucgaguuuuaccacaaguguaacgaugaaugcauggagagugugaaaaaugggacguaugacuacccaaaguauuccgaagagagcaaauugaacagggagaagaucgauggagucaagcucgaaucuauggguguguaccagauccuggcuauuuauucaaccgucgccaguagcuuagugcugcuaguuucccucggcgcaaucucuuucuggaugugcucgaaugggagccugcagugucggauuugcauauga

SEQ ID NO: 134905 - RNA, 1698 nt, Artificial Sequence; identical to SEQ ID NO: 125642
  derived and/or modified sequence opt3 from hemagglutinin__InfluenzaA__AJJ99425

SEQ ID NO: 134906 - RNA, 1698 nt, Artificial Sequence
  derived and/or modified sequence opt3 from hemagglutinin__InfluenzaA__AJJ99437
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaaacucauuuuaucggaauuuacuguggcuuaccggcaaaaacggauuguaccccagucugagcaagucuuaugcaaauaacaaagagaaggaaguucuaguacucuggggcgugcaccacccuccaaacaucgccgaccagaaaacgcuguaccauacugagaaugcuuacgucuccguggugucaagccacuauagucgcaaguucacccccgaaauagcaaagcgaccuaaaguccgugaucaggaggggagaaucaacuacuauuggacacuucuggagccaggagacacuauuaucuuugaagccaaugguaacuugauugcuccgagguacgccuucgcgcucucucggggcuuuggguccggaaucauaaauagcaacgcacccauggauaagugugacgccaaaugccagaccccucaaggcgcuauuaauucgucucugccauuccagaacguucaucccgugacaaucggugaguguccuaaguauguacgcuccgccaaauuaagaauggugaccgggcugaggaauauuccaucaauccagagucggggacucuuuggcgcaaucgcuggcuucauugaagggggauggacggguauggucgauggcugguacggguaucaccaccagaacgagcaaggaagcggcuacgccgcggaccagaaguccacucagaaugccauaaacgguaucacaaauaaagugaacucuguuauugaaaagaugaauacccaguuuacugcaguggggaaggaguucaacaaacuugagcgccgaauggaaaaccugaauaagaaagucgaugacggcuucaucgauauauggacauacaacgcugaguugcuagugcugcucgaaaaugagagaacccuggacuuucaugacagcaacguaaagaaucuuuaugaaaaaguuaagucacaacugaagaacaaugccaaagagauuggaaacggcugcuucgaguuuuaccacaaguguaaugaugaaugcauggagagugugaaaaacgggacguaugacuaccccaaguauuccgaagagagcaaauugaauagggagaagaucgauggagucaagcucgaaucuauggguguguaccagauccuggcuauuuauucaaccgucgccaguagcuuagugcugcuaguuucccucggcgcaaucucuuucuggaugugcucgaacgggagccugcagugucggauuugcauauga

SEQ ID NO: 134907 - RNA, 1698 nt, Artificial Sequence
  derived and/or modified sequence opt3 from hemagglutinin__InfluenzaA__AJJ99449
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaagcccuguaccauacggagaaugcuuacgucuccguggugucaagccacuauagucgcaaguucacucccgaaauagcaaagcgaccuaaaguccgugaucaggagggaagaaucaacuacuauuggacccuucuggagccaggugacacaauuaucuuugaagccaauggcaacuugauugcuccgagguacgccuucgcgcucucucggggguuuggauccggcaucauaaauagcaacgcacccauggguaagugugaugccaaaugccagacuccucaaggggcuauuaauucgucucugccauuccagaacguucaucccgugaccaucggagaguguccuaaguauguacgcuccgccaaauuaagaauggugacaggccugaggaauauuccaucaauccagagucggggccucuuuggggcaaucgcuggauucauugaagguggcuggaccgggauggucgacggaugguacggcuaucaccaccagaacgagcaagguagcggguacgccgcggaucagaaguccacgcagaaugccauaaacggcaucacuaauaaagugaacucuguuauugaaaagaugaauacacaguuuaccgcagugggaaaggaguucaacaaacuugagcgccgaauggaaaaccugaauaagaaagucgacgauggcuucaucgacauauggacuuacaacgcugaguugcuagugcugcucgaaaaugagagaacacuggauuuucaugacagcaacguaaagaaucuuuaugaaaaaguuaagucacaacugaagaacaaugccaaagagauugggaacggaugcuucgaguuuuaccacaaguguaaugacgaaugcauggagagugugaaaaacgguaccuaugauuaccccaaguauuccaaagaaagcaaguugaauagggagaagaucgacggcgucaaacucgagucuauggggguguaccagauccuggcuauuuauucaacggucgccaguagcuuagugcugcuaguuucccucggagcaaucucuuucuggaugugcucgaacggcagccugcagugucggauuugcauauga

SEQ ID NO: 134908 - RNA, 1698 nt, Artificial Sequence; identical to SEQ ID NO: 124504
  derived and/or modified sequence opt3 from hemagglutinin__InfluenzaA__AJJ99461

SEQ ID NO: 134909 - RNA, 1701 nt, Artificial Sequence
  derived and/or modified sequence opt3 from hemagglutinin__InfluenzaA__AJJ99483
augaaggccauccugcucgugcuucuguacaccuucgcuacagcaaacgccgacacuuugugcauuggcuaucacgcgaauaacagcacggauaccgucgacacaguuuuagagaaaaaugugacuguaacccauuccgugaaccugcuagaagauaagcacaaugggaaacucuguaagcugagaggagucgcuccccuucaucuggguaaaugcaacauagccggcuggaucuuggggaauccugagugugaaucucucucaacagcaaguagcugguccuacauuguggagaccucuucgucagacaacggaacuugcuauccaggcgauuuuaucaauuacgaggagcugagggagcagcugagcaguguuuccucuuucgaacgguuugagauuuucccgaagacaagcuccuggcccaaccacgacucaaauaagggugugaccgccgcuuguccucgcgcaggggccaaaaguuuuuauaagaaccucaucugguuagucaaaaagggaaauagcuacccaaaacugucuaaguccuauauaaacgauaagggcaaagaagugcuuguauuguggggcauccaucaccccucaacgacugcugaccaacagagccuguaccagaaugccgaugcguacguuuucguggggaccagucgauauucuaagaaauuuaagccugagauugcaauccguccaaaagucagagaccaggagggaaggaugaacuacuauuggacucuaguggaacccggugauaagauuacauucgaggccaccggcaaccuccuggugccucgguacgcuuuugccauggaacgcaaugcaggguccggaaucauaauuagcgacacaccaguccacgauugcaacaccacgugucaaacuccgaaaggcgcuaucaauacaucgcuucccuuccagaacauucauccuaucaccaucgguaagugcccaaaguauguuaaaucuacuaagcugagauuggccacagggcucaggaaugugcccuccauucagucacggggacuguuuggcgcgauagccggcuucaucgaagggggauggaccgguaugguagacggcugguacggguaucaccaucagaacgaacaaggaaguggcuacgcagcugacuuaaaaagcacgcagaaugccauugauaagaucaccaacaaagucaauuccgugauagagaagaugaacacacaguuuacugcuguggguaaggaguucaaucaccuggaaaaacgcauugagaaccucaauaagaaaguugacgauggguuccuugacaucuggaccuacaacgccgaacuguuggugcuacuggagaaugaacgaacacucgauuaucacgacucuaacgucaagaaccuguacgagaaagugagaaaucagcuuaagaacaaugcaaaggagaucggcaacggauguuuugaguucuaucauaaaugcgauaauacuuguauggaaagcguaaagaacggcaccuacgacuauccuaaauacucagaagaggccaagcugaauagggaagagauugaugggguuaaauuggagaguacacggaucuaucaaauucucgcuauauacuccaccguggcgagcucucuggucuuaguggucucacugggagcaaucaguuuuuggaugugcagcaacgguucccuacagugccguauuuguaucuga

SEQ ID NO: 134910 - RNA, 1701 nt, Artificial Sequence; identical to SEQ ID NO: 129069
  derived and/or modified sequence opt3 from hemagglutinin__InfluenzaA__AJJ99494

SEQ ID NO: 134911 - RNA, 1701 nt, Artificial Sequence
  derived and/or modified sequence opt3 from hemagglutinin__InfluenzaA__AJJ99505
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucuaaguauuccaaaaaguuuaaaccugagauugcagugcgcccaaaggugcgagaccaggagggacguaugaacuacuauuggacccuggucgaacccggugauaaaaucacauucgaggccacuggcaaccuacucguuccuagauacgcuuuugccauggaaaggaaugcagggagcggaauuaucauaucggacaccccagugcaugauugcaacacaaccugucaaacgccgaagggcgcuauuaauacuucucugcccuuccagaacauccacccuauuacaaucgguaagugcccaaaauauguaaaguccaccaaacuucggcuggccacuggguugcgcaaugugcccucaauccagaguagaggacucuuuggcgcgauugccggcuucauagaagggggauggacagguauggucgacggcugguacggguaucaucaccagaacgaacaaggaagcggcuacgcagcugaccugaaguccacccagaaugccaucgauaaaauuacgaacaagguaaauucuguuaucgagaagaugaacacccaguuuacagcuguggguaaaggguucaaucacuuagagaagaggauagaaaaccugaauaaaaaggucgacgauggcuuccucgacauuuggacuuacaacgccgagcuucugguguugcuagaaaaugagcggacccuggauuaucaugacagcaacgugaaaaaccucuacgaaaagguucgcucacagcugaagaauaacgcaaaagagaucggaaauggcuguuuugaguucuaucacaagugcgauaacacauguauggaaagugugaaaaaugggacuuacgacuauccuaaguacuccgaggaagccaaacuuaaccgagaggaaaucgauggagucaagcuggagagcaccagaauuuaucaaaucuuggcuauuuacucuacaguggcgucaagucucguccuggugguuagcuuaggugcaauauccuuuuggaugugcucuaauggcucgcugcagugcaggaucuguauuuga

SEQ ID NO: 134912 - RNA, 1701 nt, Artificial Sequence; identical to SEQ ID NO: 124927
  derived and/or modified sequence opt3 from hemagglutinin__InfluenzaA__AJJ99516

SEQ ID NO: 134913 - RNA, 1701 nt, Artificial Sequence
  derived and/or modified sequence opt3 from hemagglutinin__InfluenzaA__AJJ99527
augaaggccauccugcucgugcuucuguacaccuucgcuacagcaaacgccgacacuuugugcauuggcuaucacgcgaauaacagcacggauaccgucgacacaguuuuagagaaaaaugugacuguaacccauuccgugaaccugcuagaagauaagcacaaugggaaacucuguaagcugagaggagucgcuccccuucaucuggguaaaugcaacauagccggcuggaucuuggggaauccugagugugaaucucucucaacagcaaguagcugguccuacauuguggagaccucuucgucagacaacggaacuugcuauccaggcgauuuuaucaauuacgaggagcugagggagcagcugagcaguguuuccucuuucgaacgguuugagauuuucccgaagacaagcuccuggcccaaccacgacucaaauaagggugugaccgccgcuuguccucgcgcaggggccaaaaguuuuuauaagaaccucaucugguuagucaaaaagggaaauagcuacccaaaacugucuaaguccuauauaaacgauaagggcaaagaagugcuuguauuguggggcauccaucaccccucaacgacugcugaccaacagagccuguaccagaaugccgaugcguacguuuucguggggaccagucgauauucuaagaaauuuaagccugagauugcaauccguccaaaagucagagaccaggagggaaggaugaacuacuauuggacucuaguggaacccggugauaagauuacauucgaggccaccggcaaccuccuggugccucgguacgcuuuugccauggaacgcaaugcaggguccggaaucauaauuagcgacacaccaguccacgauugcaacaccacgugucaaacuccgaaaggcgcuaucaauacaucgcuucccuuccagaacauucauccuaucaccaucgguaagugcccaaaguauguuaaaucuacuaagcugagauuggccacagggcucaggaaugugcccuccauucagucacggggacuguuuggcgcgauagccggcuucaucgaagggggauggaccgguaugguagacggcugguacggguaucaccaucagaacgaacaaggaaguggcuacgcagcugacuuaaaaagcacgcagaaugugauugauaagaucaccaacaaagucaauuccgugauagagaagaugaacacacaguuuacugccguugguaaggaguucaaucaccuggaaaaacgcauugagaaccucaauaagaaaguggacgauggguuccuugacaucuggaccuacaacgcugaacuguugguccuacuggagaaugaacgaacacucgauuaucacgacucuaacgugaagaaccuguacgagaaaguaagaaaucagcuuaagaacaaugccaaggagaucggcaacggauguuuugaguucuaucauaaaugcgauaauacuuguauggaaagcguuaagaacggcaccuacgacuauccuaaauacucagaagaggcaaagcugaauagggaagagauugauggggugaaauuggagaguacacggaucuaucaaauucucgccauauacuccaccgucgcuagcucucugguguuagucgugucacugggagcgaucaguuuuuggaugugcagcaacgguucccuacagugccguauuuguaucuga

SEQ ID NO: 134914 - RNA, 1701 nt, Artificial Sequence
  derived and/or modified sequence opt3 from hemagglutinin__InfluenzaA__AJJ99538
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagagcuuguaccagaacgccgacaccuacguguucgucgggacaagucgcuauucuaagaaauuuaagccugagauugcgauccgaccaaaagugcgugaucaggagggaagaaugaauuacuauuggacucugguggaacccggugacaagauuaccuucgaggcaacaggcaaccuagucguuccuagguacgccuuugcuauggaacggaacgccggguccggaaucauaauuagcgauaccccagugcaugacugcaauacgacuugucaaacaccgaaaggcgcaaucaacaccucgcuccccuuccagaauauucacccuaucacuaucgguaagugcccaaaguauguaaaaucuacaaagcugcgccuugcuaccgggcugagaaacgugcccuccauucagucaaggggauuguuuggcgccauagcgggcuucaucgaagggggauggacggguauggucgacggcugguacggguaucaucaccagaaugaacaaggaaguggcuacgccgcagaucucaaaagcacccagaacgcuauugacaagaucacaaauaaagugaacuccguuauagagaagaugaauacucaguuuaccgccguggguaaggaguucaaccaccuggaaaaacggauugagaauuuaaacaagaaagucgaugacggguuccuggauaucuggacauacaaugcugaacuccuugugcuguuggagaacgaacgcacucuagacuaucaugauucuaauguaaagaaccuguacgagaaaguucgaaaccagcucaagaauaacgccaaggagaccggcaauggauguuuugaguucuaucacaaaugcgacaacacauguauggaaagcgugaagaauggcaccuacgauuauccuaaauacucagaagaggcaaagcugaacagagaaaagaucgacggggucaaacuugagaguacuaggauuuaucaaauccuggccauuuacuccacgguggcuagcucuuugguccucgugguuucacugggagcgauaaguuuuuggaugugcagcaaugguuccuuacagugccggaucuguauuuga

SEQ ID NO: 134915 - RNA, 1701 nt, Artificial Sequence
  derived and/or modified sequence opt3 from hemagglutinin__InfluenzaA__AJJ99549
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugaucaggaggguagaaugaauuacuauuggacucugguggaacccggcgacaagauuaccuucgaggcaacagggaaccuagucguuccuagguacgccuuugcuauggaacggaacgccggaucuggcaucauaauuuccgauaccccagugcaugacugcaauacgacuugucaaacaccgaaaggugcaaucaacaccagccuccccuuccagaauauucacccuaucacuaucgggaagugcccaaaguauguaaaaucgacaaagcugcgccuugcuaccggacugagaaacgugcccucuauucaguccaggggcuuguuuggcgccauagcgggguucaucgagggagguuggacgggcauggucgacgggugguacggauaucaucaccagaaugaacaaggcucagguuacgccgcagaucucaaaaguacccagaacgcuauugacaagaucacaaauaaagugaacagcguuauagagaagaugaauacucaguuuaccgccguggggaaggaguucaaccaccuggaaaaacggauugagaauuuaaacaagaaagucgaugacggcuuccuggauaucuggacauacaaugcugaacuccuugugcuguuggagaacgaacgcacucuagacuaucaugauuccaauguaaagaaccuguacgagaaaguucgaaaccagcucaagaauaacgccaaggagaucggaaauggcuguuuugaguucuaucacaaaugcgacaacauguguauggagucugugaagaaugggaccuacgauuauccuaaauacagcgaagaggcaaagcugaacagagaagagauugacggagucaaacuugagucaacaaggaucuaucaaauucuggccauauacaguaccgcugcguccagcuuggugcucgucgugucucugggugcaaucucauuuuggaugugcaguaauggcagcuuacagugccggauuuguaucuga

SEQ ID NO: 134916 - RNA, 1701 nt, Artificial Sequence; identical to SEQ ID NO: 129105
  derived and/or modified sequence opt3 from hemagglutinin__InfluenzaA__AJJ99560

SEQ ID NO: 134917 - RNA, 1701 nt, Artificial Sequence
  derived and/or modified sequence opt3 from hemagglutinin__InfluenzaA__AJJ99571
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagagcuuguaccagaacgccgacaccuacguguucgucgggacaagucgcuauucuaagaaauuuaagccugagauugcgauccgaccaaaagugcgugaucaggagggaagaaugaauuacuauuggacucugguggaacccggugacaagauuaccuucgaggcaacaggcaaccuagucguuccuagguacgccuuugcuauggaacggaacgccggguccggaaucauaauuagcgauaccccagugcaugacugcaauacgacuugucaaacaccgaaaggcgcaaucaacaccucgcuccccuuccagaauauucacccuaucacuaucgguaagugcccaaaguauguaaaaucuacaaagcugcgccuugcuaccgggcugagaaacgugcccuccauucagucaaggggauuguuuggcgccauagcgggcuucaucgaagggggauggacggguauggucgacggcugguacggguaucaucaccagaaugaacaaggaaguggcuacgccgcagaucucaaaagcacccagaacgcuauugacaagaucacaaauaaagugaacuccguuauagagaagaugaauauucaguuuacugccguggguaaggaguucaaccaccuggaaaaacggaucgagaauuuaaacaagaaagucgaugacggguuccuggauaucuggaccuacaaugcugaacuccuugugcuguuggagaacgaacgcacacuagacuaucaugauucuaauguaaagaaccuguacgagaaaguucgaaaccagcucaagaauaacgccaaggagauuggcaauggauguuuugaguucuaucacaaaugcgacaacacuuguauggaaagcgugaagaauggcaccuacgauuauccuaaauacucagaagaggcaaagcugaacagagaagagaucgacggggucaaacuugagaguacaaggauuuaucaaauacuggccaucuacuccaccguggcuagcucuuugguccucgugguuucacugggagcgauuaguuuuuggaugugcagcaaugguuccuuacagugccggaucuguaucuga

SEQ ID NO: 134918 - RNA, 1701 nt, Artificial Sequence
  derived and/or modified sequence opt3 from hemagglutinin__InfluenzaA__AJJ99582
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaacggcgcuaucaauacuucucuccccuuccagaacauucacccuaucacaaucgguaaaugcccaaaguauguaaaguccaccaaacugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaucucaaguccacccagaaugccauugacaaaaucacgaacaagguaaauucuguuauagagaaaaugaacacccaguuuacagcuguggguaaggaguucaaucaccuggaaaagcggauugagaacuuaaauaaaaaggucgaugacggguuccuggauaucuggacuuacaacgccgaacuccuugugcuguuggagaaugaacgcacccuagacuaucaugauagcaacgugaaaaaccuguacgagaagguucgaucacagcucaaaaauaacgcaaaggagaucggcaauggauguuuugaguucuaucacaagugcgacaacacauguauggaaagugugaaaaauggcacuuacgauuauccuaaguacuccgaagaggccaaacugaacagagaagagauugacggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 134919 - RNA, 1701 nt, Artificial Sequence; identical to SEQ ID NO: 124927
  derived and/or modified sequence opt3 from hemagglutinin__InfluenzaA__AJJ99593

SEQ ID NO: 134920 - RNA, 1701 nt, Artificial Sequence
  derived and/or modified sequence opt3 from hemagglutinin__InfluenzaA__AJJ99604
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccacgugugagagaucaggagggaaggaugaauuacuauuggacccugguggaacccggugacaaaauuacauucgaggccacuggcaaccuagucguuccucgguacgcuuuugccauggaacgcgaugcagggagcggaaucauaauuucggacaccccagugcaugacugcaacacaaccugucaaacgccgaagggcgcuaucaauacuucucuccccuuccagaacauucacccuaucacaaucgguaaaugcccaaaguauguaaaguccaccaaacugagacuugccacugggcugaggaaugugcccucaauucagagucggggauuguuuggcgcgauagccggcuucaucgaagggggauggacagguauggucgauggcugguacggguaucaucaccagaacgaacaaggaagcggcuacgcagcugaccucaaguccacccagaaugccauugaugagaucacgaacaaaguuaauucugugauagagaagaugaacacccaguuuacagcuguggguaaagaguucaaucaccuggaaaagcgcauugaaaacuuaaauaagaaaaucgacgauggguuccuggacaucuggacuuacaacgccgagcuccuuguccuguuggaaaaugagcgaacccuagauuaucaugacagcaacgugaagaaucuguacgagaaaguaagaucacagcucaagaacaacgcaaaagaaauuggcaauggauguuuugaguucuaucacaagugcgauaacacauguauggaaaguguuaagaauggcacuuacgacuauccuaaauacuccgaggaagccaagcugaacagggaggagaucgauggggugaaacuugaaagcacccggauuuaucaaauacuggcuaucuacucuacagucgcgucaaguuuggugcucgucgugagccugggagcaauuuccuuuuggaugugcucuaaugguucguuacagugccguaucuguaucuga

SEQ ID NO: 134921 - RNA, 1698 nt, Artificial Sequence
  derived and/or modified sequence opt3 from hemagglutinin__InfluenzaA__AJJ99616
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaaacucauuuuaucggaauuuacuguggcuuaccggaaagaacggcuuguaccccaaucugaguaagagcuaugcaaacaacaaagagaaggaaguacuuguucucuggggcgugcaccacccuccaaauaucgccaaccagaaaacgcuguaccauacugagaaugcuuacgucucugugguguccucacacuauagccgcaagcuaacccccgaaauagcaaagcgaccuaaaguccgugaccaggaggggagaaucaacuacuauuggacacuguuggagccaggagauacuauuaucuucgaagccaaugguaaccucauugcuccgagguacgccuuugcgcugagucggggcuucgggucuggaaucauaaauuccaacgcacccauggacaagugugaugccaaaugccagaccccucaaggcgcuauuaauagcucguuaccauuucagaacguucaucccgugacaaucggugaguguccuaaguauguacgcucugccaaacugagaauggugaccgggcucaggaauauuccauccauccagucacggggacuuuucggcgcaaucgcuggcuuuauugaagggggauggacggguauggucgacggcugguacggguaucaccaccagaacgagcaaggaaguggcuacgccgcggaucagaaaagcacucagaaugccauaaacgguaucacaaauaaagugaacuccguuauugaaaagaugaacacccaguucacugcaguggggaaggaguuuaauaaacuggagcgccgaauggaaaacuugaauaagaaagucgacgauggcuucaucgacauauggacauacaacgcugagcuacuggugcuccuggaaaaugagagaacccuugauuuccaugacucuaacguaaagaaucuguaugaaaaaguuaagagccaauugaagaacaaugccaaagagauuggaaacggcugcuuugaguucuaccacaaguguaaugacgaaugcauggagucagugaaaaacgggacguaugauuaccccaaguauagugaagaguccaaacucaauagggagaagaucgacggagucaagcuggaaagcauggguguguaccagaucuuagcuauuuauucuaccgucgccucaagucuggugcuacucguuagccugggcgcaaucuccuuuuggaugugcucuaacgggucgcuucagugucggauuugcauauga

SEQ ID NO: 134922 - RNA, 1698 nt, Artificial Sequence; identical to SEQ ID NO: 125642
  derived and/or modified sequence opt3 from hemagglutinin__InfluenzaA__AJJ99628

SEQ ID NO: 134923 - RNA, 1698 nt, Artificial Sequence
  derived and/or modified sequence opt3 from hemagglutinin__InfluenzaA__AJJ99640
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaaacucauuuuaucggaauuuacuguggcuuaccggaaagaacggcuuguaccccaaucugaguaagagcuaugcaaacaacaaagagaaggaagugcuaguucucuggggcgugcaccacccuccaaauaucgccaaccagaaaacgcuguaccauacugagaaugcuuacgucucugugguguccucacacuauagccgcaaguucacccccgaaauagcaaagcgaccuaaaguccgugaccaggaggggagaaucaacuacuauuggacacuucuggagccaggagauacuauuaucuuugaagccaaugguaacuugauugcuccgagguacgccuucgcgcucagucggggcuuugggucuggaaucauaaauuccaacgcacccauggacaagugugaugccaaaugccagaccccucaaggcgcuauuaauagcucgcugccauuccagaacguucaucccgugacaaucggugaguguccuaaguauguacgcucugccaaauuaagaauggugaccgggcugaggaauauuccauccauccagucacggggacucuuuggcgcagucgcuggcuucaucgaagggggauggacggguaugguggacggcugguacggguaucaccaccagaacgagcaaggaaguggcuacgccgcggaucagaaaagcacucagaaugccauuaacgguauaacaaauaaaguuaacuccgugaucgaaaagaugaacacccaguuuacugcagucgggaaggaguucaauaaacuugagcgccgaauggaaaaccugaauaagaaaguggacgauggcuucauugacaucuggacauacaacgcugaguugcuaguacugcucgaaaaugagagaacccuggauuuucaugacucuaacguuaagaaucuuuaugaaaaaguaaagagccaacugaagaacaaugccaaagagauaggaaacggcugcuucgaguuuuaccacaaguguaaugacgaaugcauggagucagucaaaaacgggacguaugauuaccccaaguauagugaagaguccaaauugaauagggagaagauugacggagugaagcucgaaagcaugggugucuaccagauccuggcuaucuauucuaccguggccucaaguuuaguucugcuagugagccucggcgcaauuuccuucuggaugugcucuaacgggucgcugcagugucggaucugcauuuga

SEQ ID NO: 134924 - RNA, 1698 nt, Artificial Sequence; identical to SEQ ID NO: 125642
  derived and/or modified sequence opt3 from hemagglutinin__InfluenzaA__AJJ99652

SEQ ID NO: 134925 - RNA, 1698 nt, Artificial Sequence
  derived and/or modified sequence opt3 from hemagglutinin__InfluenzaA__AJJ99664
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaaaacucucacaaugggaaacuaugccuccugaagggaauagcgccccuucagcuggguaacuguucaaucgcuggcuggauuuuggggaauccugagugcgaacuccugaucaguaaagagagcugguccuacauugucgaaaagccaaacccggagaauggaaccuguuaucccggccauuuugccgauuacgaggaacugagagagcaacucucuucggugagcucauucgaaagguuugagaucuucccuaaggagaguuccuggccaaaccacacuguuacaggugugucugcaagcugcucccauaauggggaaucaaguuuuuaucggaacuuacuguggcuuaccggcaaaaauggauuguaccccaaccugagcaagucuuaugccaauaacaaagagaaggaaguccuagugcucuggggcguacaccacccuccaaacauaggggaccagaaagcucuguaccauacggagaaugcauacguuuccguggucucaagccacuauagucgcaaguucacucccgaaaucgccaagcgaccuaaagugcgugaucaggagggaagaauuaacuacuauuggacccuucuggagccaggugacacaaucauuuuugaagcuaauggcaacuugaucgccccgagguacgcguucgcacucucucggggguuuggauccggcauaauuaauagcaacgcccccauggauaagugugacgcuaaaugccagacuccucaaggugccaucaauucgucucugccauuccagaacgugcaucccgucaccauuggggaguguccuaaguauguucgcuccgcaaaauuaagaauggugacaggacugaggaauaucccaucaauccagagucggggccucuuuggcgcuauugccggguucauagaaggagguuggaccggcaugguagaugggugguacggauaucaccaccagaacgagcaaggcagcgguuacgcggccgaccagaaguccacgcagaaugcaaucaacgggauuacuaauaaagugaacucugucaucgaaaagaugaauacacaguuuaccgcugugggcaaggaguucaacaaacuugagcgccgaauggaaaaccugaauaagaaaguugaugacggauucauagauauuuggacuuacaacgccgaguugcuagugcugcucgaaaaugagagaacacuggacuuucaugacagcaacgucaagaaucuuuaugaaaaagugaagucacaacugaagaacaaugcuaaagagaucggcaacgggugcuucgaguuuuaccacaaguguaaugaugaaugcauggagaguguuaaaaacggaaccuaugacuaccccaaguauuccgaagagagcaaauugaauagggagaagaucgaugguguaaagcucgaaucuaugggcguguaccagauucuggccaucuauucaacggucgcaaguagcuuagugcugcuagucucccucggggccauuucuuucuggaugugcucgaacggaagccugcagugucggauaugcaucuga

SEQ ID NO: 134926 - RNA, 1701 nt, Artificial Sequence
  derived and/or modified sequence opt3 from hemagglutinin__InfluenzaA__AJJ99675
augaaggccauccugcucgugcuucuguacaccuucgcuacagcaaaagccgacacuuugugcauuggcuaucacgcgaacaauagcacggauaccgucgacacaguuuuagagaagaacgugacuguaacccauuccgugaaucugcuagaagauaaacacaacgggaagcucuguaaacugagaggagucgcuccccuucaucuggguaagugcaauauagccggcuggaucuuggggaacccugagugugaaucucucucaacagcaaguagcugguccuacauuguggagaccucuucgucagacaauggaacuugcuauccaggcgauuuuaucaacuacgaggagcugagggagcagcugagcaguguuuccucuuucgaacgguuugagauuuucccgaagacaagcuccuggcccaaucacgacucaaacaaaggugugaccgccgcuuguccucgcgcaggggccaagaguuuuuauaaaaaucucaucugguuagucaagaaaggaaacagcuacccaaagcugucuaaguccuauauaaaugauaaaggcaaggaagugcuuguauuguggggcauccaucaccccucaacgacugcugaccaacagagccuguaccagaacgccgaugcguacguuuucguggggaccagucgauauucuaaaaaguuuaaaccugagauugcaauccguccaaaggucagagaccaggagggaaggaugaauuacuauuggacucuaguggaacccggugauaaaauuacauucgaggccaccggcaaccuccuggugccucgguacgcuuuugccauggaacgcaacgcaggguccggaaucauaauuagcgacacaccaguccacgauugcaauaccacgugucaaacuccgaagggcgcuaucaacacaucgcuucccuuccagaauauucauccuaucaccaucgguaagugcccaaaauauguuaagucuacuaaacugagauuggccacagggcucaggaacgugcccuccauucagucacggggacuguuuggcgcgauagccggcuucaucgaagggggauggaccgguaugguagacggcugguacggguaucaccaucagaaugaacaaggaaguggcuacgcagcugacuuaaagagcacgcagaacgccauugauaaaaucaccgacaagguaaauuccgucauagagaagaugaacacacaguuuacugcuguggguaaagaguucaaucaccuggaaaagcgcauugagaaccucaauaaaaagguugaugacggguuccuugauaucuggaccuacaacgccgaacuguuggugcuacuggagaaugaacgaacacucgacuaucacgauucuaacgucaaaaaucuguacgagaaggugagaaaccagcuuaagaacaaugcaaaagagaucggcaacggauguuuugaguucuaucauaagugcgacaauacuuguauggaaagcgugaaaaacggcaccuacgauuauccuaaguacucagaagaggccaaacugaauagggaagagauugacgggguuaaguuggagaguacacggaucuaucaaauucucgcuauauacuccaccguggcgagcucucuggucuuaguggucucacugggagcaaucaguuuuuggaugugcagcaacgguucccuacagugccguauuuguaucuga

SEQ ID NO: 134927 - RNA, 1701 nt, Artificial Sequence
  derived and/or modified sequence opt3 from hemagglutinin__InfluenzaA__AJJ99686
augaccgccauccugcucgugcuucuguacacauucgcuacugcaaacgccgacacguugugcauuggcuaucacgcgaauaacagcaccgauacagucgacacuguuuuagagaagaaugugaccguaacacauuccgugaaccugcuagaagauaaacacaaugggaagcucuguaaacugagaggagucgcuccccuucaucuggguaagugcaacauagccggcuggaucuuggggaauccugagugugaaucucucucaaccgcaaguagcugguccuacauuguggagacuucuucgucagacaacggaacaugcuauccaggcgauuuuaucaauuacgaggagcugagggagcagcugagcaguguuuccucuuucgaacgguuugagauuuucccgaaaaccagcuccuggcccaaccacgacucaaauaagggugugacggccgcuuguccucgcgcaggggccaagaguuuuuauaaaaaccucaucugguuagucaagaaaggaaauagcuacccaaagcugucuaaauccuauauaaacgauaagggcaaggaagugcuuguauuguggggcauccaucaccccucaacuaccgcugaccaacagagccuguaccagaaugccgaugcguacguuuucguggggacaagucgauauucuaaaaaguuuaaaccugagauugcaauccguccaaaggucagagaccaggagggaaggaugaacuacuauuggacucuaguggaacccggugauaaaauuaccuucgaggccacaggcaaccuccuggugccucgguacgcuuuugccauggaacgcaaugcaggguccggaaucauaauuagcgacaccccaguccacgauugcaacacgacuugucaaacaccgaagggcgcuaucaauaccucgcuucccuuccagaacauucauccuaucacuaucgguaaaugcccaaaguauguuaagucuacaaaacugagauuggccaccgggcucaggaaugugcccuccauucagucacggggacuguuuggcgcgauagccggcuucaucgaagggggauggacggguaugguagacggcugguacggguaucaccaucagaacgaacaaggaaguggcuacgcagcugacuuaaagagcacccagaaugccauugauaaaaucacaaacaagguaaauuccgucauagagaaaaugaacacucaguuuaccgcuguggguaaggaguucaaucaccuggaaaagcgcauugagaaccucaauaaaaagguugacgauggguuccuugacaucuggacauacaacgccgaacuguuggugcuacuggagaaugaacgaacucucgauuaucacgacucuaacgucaaaaaccuguacgagaaggugagaaaucagcuuaaaaacaaugcaaaggagaucggcaacggauguuuugaguucuaucauaagugcgauaauaccuguauggaaagcgugaaaaacggcacauacgacuauccuaaguacucagaagaggccaaacugaauagggaagagauugaugggguuaaguuggagaguacccggaucuaucaaauucucgcuauauacuccacuguggcgagcucucuggucuuaguggucucacugggagcaaucaguuuuuggaugugcagcaacgguucccuacagugccguauuuguaucuga

SEQ ID NO: 134928 - RNA, 1701 nt, Artificial Sequence
  derived and/or modified sequence opt3 from hemagglutinin__InfluenzaA__AJJ99697
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagagcuuguaccagaacgccgacaccuacguguucgucgggacaagucgcuauucuaagaaauuuaagccugagauugcgauccgaccaaaagugcgugaucaggagggaagaaugaauuacuauuggacucugguggaacccggugacaagauuaccuucgaggcaacaggcaaccuagucguuccuagguacgccuuugugauggaacggaacgcuggguccggaaucauaauuagcgauaccccaguacaugacugcaauacgacuugucaaacaccgaaaggcgccaucaacaccucgcuccccuuccagaauauucacccuaucacuaucgguaagugcccaaaguaugugaaaucuacaaagcugcgccuugcaaccgggcugagaaacguccccuccauucagucaaggggauuguuuggcgcuauagccggcuucaucgaagggggauggacggguaugguggacggcugguacggguaucaucaccagaaugaacaaggaaguggcuacgcggccgaucucaaaagcacccagaacgcaauugacaagaucacaaauaaaguuaacuccgugauagagaagaugaauacucaguuuaccgcugucgguaaggaguucaaccaccuggaaaaacggauugagaauuuaaacaagaaaguggaugacggguuccuggauaucuggacauacaaugccgaacuccuuguacuguuggagaacgaacgcacucuagacuaucaugauucuaauguuaagaaccuguacgagaaagugcgaaaccagcucaagaauaacgcuaaggagaccggcaauggauguuuugaguucuaucacaaaugcgacaacacauguauggaaagcgucaagaauggcaccuacgauuauccuaaauacucagaagaggccaagcugaacagagaaaagaucgacggggugaaacuugagaguacuaggauuuaucaaauccuggcaauuuacuccacggucgccagcucuuuggugcucguugugucacugggagcuauaaguuuuuggaugugcagcaaugguuccuuacagugccggaucuguauuuga

SEQ ID NO: 134929 - RNA, 1701 nt, Artificial Sequence
  derived and/or modified sequence opt3 from hemagglutinin__InfluenzaA__AJJ99708
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccgaucacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgauaccuacguguucgucgggacaagucgcuauucuaagaaauuuaagccugagauugcgauccgaccaaaagugcgugaccaggagggaagaaugaacuacuauuggacucugguggaacccggugauaagauuaccuucgaggcaacaggcaaucuagucguuccuagguacgccuuugugauggaacggaacgcuggguccggaaucauaauuagcgacaccccaguacaugacugcaacacgacuugucaaacaccgaaaggcgccaucaauaccucgcuccccuuccagaacauucacccuaucacuaucgguaagugcccaaaguaugugaaaucuacaaagcugcgccuugcaaccgggcugagaaauguccccuccauucagucaaggggauuguuuggcgcuauagccggcuucaucgaagggggauggacggguaugguggauggcugguacggguaucaucaccagaacgaacaaggaaguggcuacgcggccgaccucaaaagcacccagaaugcaauugauaagaucacaaacaaaguuaauuccgugauagagaagaugaacacucaguuuaccgcugucgguaaggaguucaaucaccuggaaaaacggauugagaacuuaaauaagaaaguggacgauggguuccuggacaucuggacauacaacgccgaacuccuuguacuguuggagaaugaacgcacucuagauuaucaugacucuaacguuaagaaucuguacgagaaagugcgaaaccagcucaagaacaaugcuaaggagaccggcaacggauguuuugaguucuaucacaaaugcgauaauacauguauggaaagcgucaagaacggcaccuacgacuauccuaaauacucagaagaggccaagcugaauagagaaaagaucgauggggugaaacuugagaguacuaggauuuaucaaauccuggcaauuuacuccacggucgccagcucuuuggugcucguugugucacugggagcuauaaguuuuuggaugugcagcaacgguuccuuacagugccggaucuguauuuga

SEQ ID NO: 134930 - RNA, 1701 nt, Artificial Sequence
  derived and/or modified sequence opt3 from hemagglutinin__InfluenzaA__AJJ99719
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugagggagcagcucagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcuggugaaaaagggcaacaguuacccaaaacucagcaagucuuauauaaaugacaagggcaaagaaguauuaguucugugggggauccaccaccccuccacgacugcugaucaacagucacuuuaccagaacgccgacaccuacguguucgucggaacaagccgcuauaguaagaaauuuaagccugagauugcgauccgaccaaaagugcgugaucaggaggguagaaugaauuacuauuggacuuugguggaacccggcgacaagauuaccuucgaggcaacagggaaccuggucguuccuagguacgccuuugcuauggaacggaacgccggaucuggcaucauaauuuccgauaccccagugcaugacugcaauacgacuugucaaacaccgaaaggugcaaucaacaccagccuacccuuccagaauauucacccuaucacuaucgggaagugcccaaaguauguaaaaucgacaaagcuccgccuggcuaccggacuuagaaacgugcccucuauucaguccaggggccuguuuggcgccauagcgggguucaucgagggagguuggacgggcauggucgacgggugguacggauaucaucaccagaaugaacaaggcucagguuacgccgcagauuugaaaaguacccagaacgcuauugacaagaucacaaauaaagugaacagcguuauagagaagaugaauacucaguuuaccgccguggggaaggaguucaaccaccucgaaaaacggauugagaaucugaacaagaaagucgaugacggcuucuuagauaucuggacauacaaugcugaacugcucgugcuucuggagaacgaacgcacuuuggacuaucaugauuccaauguaaagaaccuauacgagaaaguucgaaaccagcugaagaauaacgccaaggagaucggaaauggcuguuuugaguucuaucacaaaugcgacaacaccuguauggaaucugugaagaaugggacauacgauuauccuaaauacagcgaagaggcaaagcucaacagagaagagauugagggagucaaacuggaaucaaccaggaucuaucaaauucuugccauauacaguacuguggcuuccagccuggucuuggugguuucucucggugcgaucucauuuuggaugugcaguaauggcagccugcagugccggauuuguaucuga

SEQ ID NO: 134931 - RNA, 1701 nt, Artificial Sequence
  derived and/or modified sequence opt3 from hemagglutinin__InfluenzaA__AJJ99730
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugagggagcagcucagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcuggugaaaaagggcaacaguuacccaaaacucagcaagucuuauauaaaugacaagggcaaagaaguauuaguucugugggggauccaccaccccuccacgacugcugaucaacagucacuuuaccagaacgccgacaccuacguguucgucggaacaagccgcuauaguaagaaauuuaagccugagauugcgauccgaccaaaagugcgugaucaggaggguagaaugaauuacuauuggacuuugauugaacccggcgacaagaucaccuucgaggcaacagggaaccugguggucccuagguacgccuuugcuauggaacggaacgccggaucuggcauaauuaucuccgauaccccaguucaugacugcaauacgacuugucaaacaccgaaaggugcaauuaacaccagccuacccuuccagaauauccacccuaucacuauugggaagugcccaaaguaugugaaaucgacaaagcuccgccuggcuaccggacuuagaaacguacccucuauacaguccaggggccuguuuggcgccaucgcgggguucauugagggagguuggacgggcaugguggacgggugguacggauaucaucaccagaaugaacaaggcucagguuacgccgcagauuugaaaaguacccagaacgcuaucgacaagauaacaaauaaagucaacagcgugauugagaagaugaauacucaguuuaccgccguugggaaggaguucaaccaccucgaaaaacggaucgagaaucugaacaagaaaguggaugacggcuucuuagauaucuggacauacaaugcugaacugcucguccuucuggagaacgaacgcacuuuggacuaucaugauuccaaugugaagaaccuauacgagaaaguacgaaaccagcugaagaauaacgccaaggagauuggaaauggcuguuuugaguuccaccauaaaugcgacaacaccuguauggaaucuguuaagaaugggacauaugauuacccuaaauauagcgaagaggcaaagcucaacagagaagagaucgacggagugaaacuggagucaaccaggauuuaccaaauacuugccaucuauaguacugucgcuuccagccugguguuggucgugucucucggugcgauuucauuuuggaugugcaguaauggcagccugcagugccggaucuguaucuga

SEQ ID NO: 134932 - RNA, 1701 nt, Artificial Sequence; identical to SEQ ID NO: 129058
  derived and/or modified sequence opt3 from hemagglutinin__InfluenzaA__AJJ99741

SEQ ID NO: 134933 - RNA, 1701 nt, Artificial Sequence; identical to SEQ ID NO: 125849
  derived and/or modified sequence opt3 from hemagglutinin__InfluenzaA__AJJ99752

SEQ ID NO: 134934 - RNA, 1701 nt, Artificial Sequence; identical to SEQ ID NO: 124685
  derived and/or modified sequence opt3 from hemagglutinin__InfluenzaA__AJJ99763

SEQ ID NO: 134935 - RNA, 1698 nt, Artificial Sequence
  derived and/or modified sequence opt3 from hemagglutinin__InfluenzaA__AJJ99775
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaaacucauuuuaucggaauuuacuguggcuuaccggaaagaacggcuuguaccccaaucugaguaagagcuaugcaaacaacaaagagaaggaagugcuaguucucuggggcgugcaccacccuccaaauaucgccgaccagaaaacgcuguaccauacugagaacgcuuacgucucugugguguccucacacuauagccgcaaguucacccccgaaauagcaaagcgaccuaaaguccgugaucaggaggggagaaucaauuacuauuggacacuucuggagccaggagacacuauuaucuuugaagccaacgguaauuugauugcuccgagguacgccuucgcgcucagucggggcuuugggucuggaaucauaaacuccaaugcacccaccgauaagugugacgccaaaugccagacaccucaaggcgcuauuaacagcucgcugccauuccagaauguucaucccgugaccaucggugaguguccuaaguauguacgcucugccaaauuaagaauggugacggggcugaggaacauuccauccauccagucacggggacucuuuggcgcaaucgcuggcuucauugaagggggauggacugguauggucgauggcugguacggguaucaccaccagaaugagcaaggaaguggcuacgccgcggaccagaaaagcacacagaacgccauaaaugguaucaccaacaaaguaaauuccguuauugaaaagaugaacacucaguuuacagcaguggggaaggaguucaacaaacuugagcgccgaauggaaaaucugaacaagaaagucgaugacggcuucaucgauauauggaccuacaaugcugaguugcuagugcugcucgaaaacgagagaacgcuggacuuucaugacucuaauguaaagaaccuuuaugaaaaaguuaagagccaacugaagaauaacgccaaagagauuggaaauggcugcuucgaguuuuaccacaaguguaacgaugaaugcauggagucagugaaaaaugggaccuaugacuaccccaaguauagugaagaguccaaauugaacagggagaagaucgauggagucaagcucgaaagcauggguguguaccagauccuggcuauuuauucuacagucgccucaaguuuagugcugcuaguuagccucggcgcaaucuccuucuggaugugcucuaaugggucgcugcagugucggauuugcauauga

SEQ ID NO: 134936 - RNA, 1701 nt, Artificial Sequence
  derived and/or modified sequence opt3 from hemagglutinin__InfluenzaA__AJJ99786
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacgggaugcagggagcggaaucauaauuucggacaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaauauucccucaauacagaguaggggauuguuuggcgcgaucgccggcuucauugaagggggauggacagguaugguggauggcugguacggguaucaucaccagaacgaacaaggaagcggcuacgcagcugaccucaaauccacccagaaugccaucgaugagauaacgaacaaggucaauucugugauugagaaaaugaacacccaguuuacagcuguugguaaggaguucaaucaccuggaaaagcggaucgaaaacuuaaauaaaaagaucgacgauggguuccuggacauuuggacuuacaacgccgagcuccuugugcuguuggaaaaugagcgcacccuagauuaucaugacagcaacgucaaaaaucuguacgagaaggugcgaucacagcucaaaaacaacgcaaaggaaaucggcaauggauguuuugaguucuaucacaagugcgauaacacauguauggaaaguguaaagaauggcacuuacgacuauccuaaguacuccgaggaagccaaacugaacagagaggagauugaugggguuaaacuugaaagcaccaggauauaucaaauccuggcuauuuacucugcgguggcaucaaguuugguccucguggucagccugggagccaucuccuuuuggaugugcucuaaugguucguuacagugccggaucuguauuuga

SEQ ID NO: 134937 - RNA, 1698 nt, Artificial Sequence
  derived and/or modified sequence opt3 from hemagglutinin__InfluenzaA__AJJ99798
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaagaccaaacccggagaauggaaccuguuaucccggccauuuugcugauuacgaggaacugagggagcaacucucuucggugagcucauucgaacgguuugagauuuucccuaaggagaguuccuggccaaaccacacugucacaggugugucugccagcugcucccauaauggggaaaacucauuuuaucgcaauuuacuguggcuuaccggaaagaacggcuuguaccccaaucugaguaaaagcuaugcaaacaacaaggagaaagaaguucuaguacucuggggcgugcaccacccuccaaauaucgccaaccagaagacgcuguaccauacugagaaugcuuacgucucugugguguccucacacuauagccgaaaauucacccccgaaauagcaaagcguccuaaggucagagaccaggaggggaggaucaacuacuauuggacacuucuggagccaggagauacuauuauguuugaagccaaugguaacuugaucgcuccgcgguacgccuucgcgcucagucgcggcuuugggucuggaauuaucaauuccaacgcacccauggacaaaugugaugccaagugccagaccccucaaggcgcuauaaauagcucgcugccauuccagaacguucaucccgugacaauuggugaguguccuaaauauguaagaucugccaaguuaaggauggugaccgggcugcggaauaucccauccauucagucacgcggacucuuuggcgcaaucgcuggcuucaucgaagggggauggacggguauggucgacggcugguacggguaucaccaccagaacgagcaaggaaguggcuacgccgcggaucagaaaagcacucagaaugccauuaacgguauaacaaauaaggugaacuccguuaucgaaaagaugaacacccaguuuacugcaguggggaaggaguucaauaaacuugagcgaagaauggaaaaccugaauaaaaaggucgacgauggcuucauugacaucuggacauacaacgcugaguugcuagugcugcucgaaaaugagaggacccuggauuuucaugacucuaacguuaaaaaucuuuaugaaaagguaaaaagccaacugaagaacaaugccaaggagauaggaaacggcugcuucgaguuuuaccacaaauguaaugacgaaugcauggagucagugaagaacgggacguaugauuaccccaaauauagugaagaguccaaguugaaucgggagaaaauugacggagucaagcucgaaagcauggguguguaccagauccuggcuaucuauucuaccgucgccucaaguuuagugcugcuaguuagccucggcgcaauuuccuucuggaugugcucuaacgggucgcugcagugucguaucugcauuuga

SEQ ID NO: 134938 - RNA, 1698 nt, Artificial Sequence; identical to SEQ ID NO: 124504
  derived and/or modified sequence opt3 from hemagglutinin__InfluenzaA__AJJ99810

SEQ ID NO: 134939 - RNA, 1698 nt, Artificial Sequence
  derived and/or modified sequence opt3 from hemagglutinin__InfluenzaA__AJJ99822
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggaaagaauggcuuguaccccaaccugagcaagucuuaugcaaauaacaaagagaaggaaguucuaguacucuggggcgugcaccacccuccaaacaucggggaccagaaagcccuguaccauacggagaaugcuuacgucuccguggugucaagccacuauagucgcaaguucacucccgaaauagcaaagcgaccuaaaguccgugaucaggagggaagaaucaacuacuauuggacccuucuggagccaggugacacaauuaucuuugaagccaauggcaacuugauugcuccgagguacgccuucgcgcucucucggggguuuggauccggcaucauaaauagcaacgcacccauggauaagugugacgccaaaugccagacuccucaaggugcuauuaauucgucucugccauuccagaacguucaucccgugaccaucggggaguguccuaaguauguacgcuccgccaaauuaagaauggugacaggacugaggaauauuccauuuauccagucacggggccucuucggcgcaaucgcuggguuuauugaaggagguuggaccggcauggucgaugggugguacggauaucaccaccagaacgagcaaggcagugguuacgccgcggaccagaaaagcacgcagaaugccauaaacgggaucacuaauaaagugaacuccguuauugaaaagaugaauacacaguucaccgcagugggcaaggaguucaacaaacuugagcgccgaauggaaaaccugaauaagaaagucgaugacggauuuaucgauauauggacuuacaacgcugaguugcuagugcugcucgaaaaugagagaacacuggacuuccaugacucuaacguaaagaaucuuuaugaaaaaguuaagagccaacugaagaacaaugccaaagagauuggcaacgggugcuuugaguucuaccacaaguguaaugaugaaugcauggagucagugaaaaacggaaccuaugacuaccccaaguauagugaagaguccaaauugaauagggagaagaucgauggugucaagcucgaaagcaugggcguguaccagauccuggcuauuuauucuacggucgccucaaguuuagugcugcuaguuagccucggggcaaucuccuuuuggaugugcucuaacggaucgcugcagugucggauuugcauauga

SEQ ID NO: 134940 - RNA, 1701 nt, Artificial Sequence
  derived and/or modified sequence opt3 from hemagglutinin__InfluenzaA__AJJ99833
augaaggccauccugcucgugcuucuguacaccuucgcuacagcaaacgccgacacuuugugcauuggcuaucacgcgaauaacagcacggauaccgucgacacaguuuuagagaaaaaugugacuguaacccauuccgugaaccugcuagaagauaagcacaaugggaaacucuguaagcugagaggagucgcuccccuucaucuggguaaaugcaacauagccggcuggaucuuggggaauccugagugugaaucucucucaacagcaaguagcugguccuacauuguggagaccucuucgucagacaacggaacuugcuauccaggcgauuuuaucaauuacgaggagcugagggagcagcugagcaguguuuccucuuucgaacgguuugagauuuucccgaagacaagcuccuggcccaaccacgacucaaauaagggugugaccgccgcuuguccucgcgcaggggccaaaaguuuuuauaagaaccucaucugguuagucaaaaagggaaauagcuaccugaaacuuucuaaguccuauauaaacgauaagggcaaagaaguguugguacuguggggcauccaucacccaucaacgacugcugaccaacagagccuauaccagaaugccgaugcguacguuuucguggggaccagucgauauucuaagaaauuuaagcccgagauugcaauccguccuaaagucagagaccaggagggaaggaugaacuacuauuggacacucguggaaccaggugauaagauuacuuucgaggccaccggcaaccugcuugugccccgguacgcuuuugccauggaacgcaaugcaggguccggaaucauaauuagcgacacaccuguccacgauugcaacaccacgugucaaacuccaaaaggcgcuaucaauacaucgcugccguuccagaacauucaucccaucaccaucgguaagugcccuaaguauguuaaaucuacuaaguugagacucgccacagggcugaggaaugugccauccauucagucacggggauuauuuggcgcgauagccggcuucaucgaagggggauggaccgguaugguagacggcugguacggguaucaccaucagaacgaacaaggaaguggcuacgcagcugaccugaaaagcacgcagaaugccauugauaagaucaccaacaaagucaauuccgugauagagaagaugaacacacaguuuacugcuguggguaaggaguucaaucaccucgaaaaacgcauugagaaccuuaauaagaaaguugacgauggguuccuggacaucuggaccuacaacgccgaauugcuagugcugcucgagaaugaacgaacacuggauuaucacgacucuaacgucaagaaccuuuacgagaaagugagaaaucagcugaagaacaaugcaaaggagaucggcaacggauguuuugaguucuaucauaaaugcgauaauacuuguauggaaagcguaaagaacggcaccuacgacuaucccaaauacucagaagaggccaaguugaauagggaagagauugaugggguuaaacucgagaguacacggaucuaucaaauucuggcuauauacuccaccguggcgagcucuuuaguccugguggucucacuaggagcaaucaguuuuuggaugugcagcaacgguucccuccagugccguauuuguaucuga

SEQ ID NO: 134941 - RNA, 1701 nt, Artificial Sequence; identical to SEQ ID NO: 128840
  derived and/or modified sequence opt3 from hemagglutinin__InfluenzaA__AJJ99844

SEQ ID NO: 134942 - RNA, 1701 nt, Artificial Sequence
  derived and/or modified sequence opt3 from hemagglutinin__InfluenzaA__AJJ99855
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagagcuuguaccagaacgccgacaccuacguguucgucgggacaagucgcuauucuaagaaauuuaagccugagauugcgauccgaccaaaagugcgugaucaggagggaagaaugaauuacuauuggacucugguggaacccggugacaagauuaccuucgaggcaacaggcaaccuagucguuccuagguacgccuuugcuauggaacggaacgccggguccggaaucauaauuagcgauaccccagugcaugacugcaauacgacuugucaaacaccgaaaggcgcaaucaacaccucgcuccccuuccagaauauucacccuaucacuaucgguaagugcccaaaguauguaaaaucuacaaagcugcgccuugcuaccgggcugagaaacgugcccuccauucagucaaggggauuguuuggcgccauagcgggcuucaucgaagggggauggacggguauggucgacggcugguacggguaucaucaccagaaugaacaaggaaguggcuacgccgcagaucucaaaagcacccagaacgcuauugacaagaucacaaauaaagugaacuccguuauagagaagaugaauacucaguuuaccgccguggguaaggaguucaaccaccuggaaaaacggauugagaauuuaaacaagaaagucgaugacggguuccuggauaucuggacauacaaugcugaacuccuugugcuguuggagaacgaacgcacucuagacuaucaugauucuaauguaaagaaccuguacgagaaaguucgaaaccagcucaagaauaacgccaaggagaucggcaauggauguuuugaguucuaucacaaaugcgacagcaccuguauggaaucagugaagaacggcacauacgauuauccuaaauacagugaagaggcaaagcugaauagagaagagauugacggggucaaacuugaguccaccaggaucuaucaaauucuggccauauacagcacuguggcuucuucauugguccucgugguuagucugggagcgaucagcuuuuggaugugcuccaacgguucuuuacagugccggauuuguaucuga

SEQ ID NO: 134943 - RNA, 1701 nt, Artificial Sequence
  derived and/or modified sequence opt3 from hemagglutinin__InfluenzaA__AJJ99866
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucaaaggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagagagcagcugagcaguguguccucuuucgaaagguuugagauuuucccgaagacaagcuccuggcccaaucacgauucaaacaaaggugucaccgccgcuuguccucaugcaggggccaagaguuuuuauaaaaaucugaucuggcucgugaagaaaggaaacagcuacccaaaguuaucuaaguccuauauaaaugacaaaggcaaggaaguacugguucuuuggggcauccaccaccccucaacgagcgcugaucaacagaguuuguaccagaacgccgacgcguacguguucgucgggacuucucgguauuccaaaaaguuuaaaccugagauugcaauccgcccaaaggugcgagaucaggagggacguaugaauuacuauuggacccugguggaacccggugacaaaauuacauucgaggccacuggcaaccuagucguuccuagauacgcuuuugccauggaaaggaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcggcuugccacugggcugcgcaacgugcccucaauucagaguagaggauuguuuggcgcgauagccggcuucaucgaagggggauggacagguauggucgacggcugguacggguaucaucaccagaaugaacaaggaagcggcuacgcagcugaucucaaguccacccagaacgccauugacgagaucacgaauaaagugaacucuguuauagagaagaugaauacccaguuuacagcuguggguaaggaauuuaaccaccuggagaaaaggauugaaaauuuaaacaagaaagucgaugacggguuccuggauaucuggacuuacaaugccgagcuccuugugcuguuggaaaacgagcggacccuagacuaucaugauagcaauguaaagaaccuguacgagaaaguucgcucacagcucaagaacaaugcaaaggaaaucggcaacggauguuucgaguucuaucacaaaugcgacaauacauguauggaaagugugaagaacggcacuuacgauuauccuaaauacuccgaggaagccaagcugaaucgagaggagauugacggggucaaacuugaaagcaccagaaucuaucaaauucuggcuauauacucuacaguggcgucaaguuugguccucgugguuagccugggagcaaucuccuuuuggaugugcucuaacgguucguuacagugcaggauuuguaucuga

SEQ ID NO: 134944 - RNA, 1701 nt, Artificial Sequence
  derived and/or modified sequence opt3 from hemagglutinin__InfluenzaA__AJJ99877
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaagcacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuccagugcaugacugcaauaccacaugucaaaccccgaagggcgcuaucaacacgucccuccccuuccacaauauucauccuaucacuaucgguaaaugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaccaccagaaugagcagggauccggcuacgcagcugaucucaagucuacacaaaacgccauugacgagaucaccaauaaagugaacagcguuauagaaaagaugaauacgcaguuuaccgcuguggguaaagaguucaaccaucuggaaaagcggauugagaauuuaaacaagaaagucgaugacggguuccuggauaucuggacauacaaugccgaacuccuugugcuguuggagaacgagcgcacucuagacuaucacgauucaaauguacgaaaccuguacgaaaagguuagaagucagcucaaaaacaaugcaaaggagaucggcaacggauguuuugaguucuaucauaaaugcgacaauaccuguauggaauccgugaagaacggcacauacgauuauccuaaguacagcgaagaggccaaacugaauagggaggaaauugacggggucaaacuugagucuacucggaucuaucagauucuggcuauauacucaaccguggcgaguagcuugguccucgugguuucccugggagcaaucucuuuuuggaugugcucgaacgguagcuuacaaugccguauuuguaucuga

SEQ ID NO: 134945 - RNA, 1701 nt, Artificial Sequence
  derived and/or modified sequence opt3 from hemagglutinin__InfluenzaA__AJJ99888
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgucagcugaucaacagagcuuguaccagaacgccgacgcguacguguucgucggaacuucccgcuauucuaagaaauuuaagccugagauugcaauccgaccaaaagugcgugaucaggaggguagaaugaauuacuauuggacccugguggaacccggcgacaagauuacauucgaggccacugggaaccuagucguuccuagguacgcuuuugccauggaacgggaugcaggauccggcaucauaauuagcgacaccccagugcaugacugcaacacaaccugucaaacgccgaaaggugcuaucaauacuucgcuccccuuccagaacauucacccuaucacaaucgggaagugcccaaaguauguaaaaucuaccaagcugcgccuugccacuggacugagaaaugugcccuccauucagucaaggggcuuguuuggcgcgauagccggguucaucgagggagguuggacaggcauggucgaugggugguacggauaucaucaccagaacgaacaaggcagugguuacgcagcugaccucaaaagcacccagaaugccauugaugagaucacgaacaaggugaauaguguuauagagaaaaugaacacccaguuuacagcuguggggaaggaguucaaucaccuggagaagcggauugaaaacuuaaauaaaaagaucgacgauggcuuccuggacaucuggacuuacaacgccgagcuccuuguccuguuggaaaaugagcgcacccuagauuaucaugacucuaacgugaaaaaucuguacgagaagguacgaagccagcucaaaaacaacgcaaaggaaauuggaaauggcuguuuugaguucuaucacaagugcgauaacacauguauggaaucaguuaaaaaugggacuuacgacuauccuaaguacagugaggaagccaaacugaacagagaggagaucgauggagugaaacuugaauccaccaggauuuaucaaauacuggcuaucuacagcacagucgcgucuucauuggugcucgucgugagucugggugcaauuagcuuuuggaugugcuccaauggcucuuuacagugccggaucuguaucuga

SEQ ID NO: 134946 - RNA, 1701 nt, Artificial Sequence
  derived and/or modified sequence opt3 from hemagglutinin__InfluenzaA__AJJ99899
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucgcgcaggggccaaaaguuuuuauaagaaccugaucuggcucgugaaaaagggaaauagcuacccaaacuuaucuaaauccuauauaaaugauaagggcaaggaaguacugguucuuuggggcauccaucaccccucaacgacugcugaccaacagagcuuguaccagaacgccgaugcguacguguucgucgggaccagucgauauucuaaaaaguuuaaaccugagauugcaauccguccaaaggugagagaccaggagggaaggaugaacuacuauuggacacugcuagaacccggugauaaaauuacuuucgaggccaccggcaaucuccuggugccucgguacgcuuuugccauggaacgcaacgcaggguccggaaucauaauuagcgacacaccaguccacgauugcaauaccacgugucaaacuccgaagggcgcuaucaacacaucgcuucccuuccagaauauucauccuaucaccaucgguaaaugcccaaaguauguuaagucuacuaaacugagauuggccacagggcucaggaacgugcccuccauucagucacggggacuguuuggcgcgauagccggcuucaucgaagggggauggaccgguaugguagacggcugguacggguaucaccaucagaauggacaaggcagugguuacgcagcugacuuaaagagcacgcagaacgccguggauaaaauuaccaauaaggucaacuccgugaucgaaaagaugaauacacaguuuacugcuguugggaaagaguucaaccaccuggagaagcgcauagaaaaucucaacaaaaagguggacgauggcuuccuugacauuuggaccuacaaugccgagcuguugguccuacuggaaaacgagcgaacacucgauuaucacgacucuaacgugaaaaaucuguacgaaaagguaagaaaccagcuuaaaaauaacgcaaaggagaucggaaauggcuguuuugaguucuaucauaagugcgauaacacuuguauggaaagcguuaaaaaugggaccuacgacuauccuaaguacucagaggaagccaaacugaacagggaggaaaucgauggagugaaguuggagaguacacggauuuaucaaauccucgcuauuuacuccaccgucgcgagcucucugguguuagucgugucacugggugcaauaaguuuuuggaugugcagcaauggcucccuacagugccguaucuguauuuga

SEQ ID NO: 134947 - RNA, 1701 nt, Artificial Sequence
  derived and/or modified sequence opt3 from hemagglutinin__InfluenzaA__AJJ99910
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucagacaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgauaccuacguguucgucgggacaagucgcuauucuaagaaauuuaagccugagauugcgauccgaccaaaagugcgugaccaggagggaagaaugaacuacuauuggacucugguggaacccggugauaagauuaccuucgaggcaacaggcaaucuagucguuccuagguacgccuuugcuauggaacggaacgccggguccggaaucauaauuagcgacaccccagugcaugacugcaacacgacuugucaaacaccgaaaggcgcaaucaauaccucgcuccccuuccagaacauucacccuaucacuaucgguaagugcccaaaguauguaaaaucuacaaagcugcgccuugcuaccgggcugagaaaugugcccuccauucagucaaggggauuguuuggcgccauagcgggcuucaucgaagggggauggacggguauggucgauggcugguacggguaucaucaccagaacgaacaaggaaguggcuacgccgcagaccucaaaagcacccagaaugcuauugauaagaucacaaacaaaguuaauuccgugauagagaagaugaacacucaguuuaccgccguggguaaggaguucaaucaccuggaaaaacggauugagaacuuaaauaagaaagucgacgauggguuccuggacaucuggacauacaacgcugaacuccuugugcuguuggagaaugaacgcacucuagauuaucaugacucuaacguaaagaaucuguacgagaaaguucgaaaccagcucaagaacaaugccaaggagaccggcaacggauguuuugaguucuaucacaaaugcgauaauacauguauggaaagcgugaagaacggcaccuacgacuauccuaaauacucagaagaggcaaagcugaauagagaaaagaucgauggggucaaacuugagaguacuaggauuuaucaaauccuggccauuuacuccacgguggcuagcucuuugguccucgugguuucacugggagcgauaaguuuuuggaugugcagcaacgguuccuuacagugccggaucuguauuuga

SEQ ID NO: 134948 - RNA, 1701 nt, Artificial Sequence; identical to SEQ ID NO: 128840
  derived and/or modified sequence opt3 from hemagglutinin__InfluenzaA__AJJ99921

SEQ ID NO: 134949 - RNA, 1701 nt, Artificial Sequence
  derived and/or modified sequence opt3 from hemagglutinin__InfluenzaA__AJJ99932
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcgacauagccggcuggauccuggggaacccugagugugaaucuuugucaacagcaaguagcugguccuacauuguugagaccucuucgucagauaauggaacuugcuauccaggcgacuuuaucgauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcgugaccaggagggaagaaugaacuacuauuggacacugguggaacccggugauaagauuacuuucgaggccaccggcaaucuagucguuccuagguacgcuuuugccauggaacggaacgcaggguccggaaucauaauuagcgacacaccagugcaugacugcaacaccacgugucaaacuccgaaaggcgcuaucaauacaucgcuccccuuccagaacauucacccuaucaccaucgguaagugcccaaaguauguaaaaucuacuaagcugcgccuugccacagggcugagaaaugugcccuccauucagucaaggggauuguuuggcgcgauagccggcuucaucgaagggggauggaccgguauggucgauggcugguacggguaucaucaccagaacgaacaaggaaguggcuacgcagcugaccucaaaagcacgcagaaugccauugauaagaucaccaacaaaguuaauuccgugauagagaagaugaacacacaguuuacugcuguggguaaggaguucaaucaccuggaaaaacggauugagaacuuaaauaagaaagucgacgauggguuccuggacaucuggaccuacaacgccgaacuccuugugcuguuggagaaugaacgcacacuagauuaucaugacucuaacguaaagaaucuguacgagaaaguucgaaaccagcucaagaacaaugcaaaggagaucggcaacggauguuuugaguucuaucacaaaugcgauaauacuuguauggaaagcgugaagaacggcaccuacgacuauccuaaauacucagaagaggccaagcugaauagagaagagauugauggggucaaacuugagaguacaaggaucuaucaaauucuggcuauauacuccaccguggcgagcucuuugguccucgugguuucacugggagcaaucaguuuuuggaugugcagcaacgguuccuuacagugccggauuuguaucuga

SEQ ID NO: 134950 - RNA, 1701 nt, Artificial Sequence; identical to SEQ ID NO: 128470
  derived and/or modified sequence opt3 from hemagglutinin__InfluenzaA__AJJ99943

SEQ ID NO: 134951 - RNA, 1701 nt, Artificial Sequence
  derived and/or modified sequence opt3 from hemagglutinin__InfluenzaA__AJJ99954
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaaaaguuugagauuuucccgaagacaagcuccuggcccaaucacgauucaaacaaaggugucaccgccgcuuguccucaugcaggggccaagaguuuuuauaaaaaucugaucuggcucgugaagaaaggaaacagcuacccaaaguuaucuaaguccuauauaaaugacaaaggcaaggaaguacugguucuuuggggcauccaccaccccucaacgagcgcugaucaacagaguuuguaccagaacgccgacgcguacguguucgucgggacuucucgguauuccaaaaaguuuaaaccugagauugcaauccgcccaaaggugcgagaucaggagggacguaugaauuacuauuggacccugguggaacccggugacaaaauuacauucgaggccacuggcaaccuagucguuccuagauacgcuuuugccauggaaaggaacgcagggagcggaaucauaaccucggauacaccagugcaugacugcaauaccacgugucaaacuccgaagggcgcuauuaacacaucucuccccuuccagaauauccacccuauuaccaucgguaacugcccaaaguauguaaaauccacuaagcugcggcuugccacagggcugcgcaaugugcccucaauccagaguagaggauuguuuggcgcgauugccggcuucauagaagggggauggaccgguauggucgacggcugguacggguaucaucaccagaacgaacaaggaagcggcuacgcagcugaucucaaauccacgcagaaugccaucgacaagauuaccaacaaaguuaauucugugaucgagaagaugaacacacaguuuacugcuguggguaaggaguucaaucaccuggagaaaaggauagagaacuuaaauaagaaagucgaugacggguuccuggauauuuggaccuacaacgccgaacuccuugugcuguuggagaaugaacggacacuagacuaucaugauagcaacguaaagaaccuguacgagaaaguucgcucacagcucaagaauaacgcaaaggagaucggcaauggauguuuugaguucuaucacaaaugcgacaacacuuguauggagagugugaagaauggcaccuacgauuauccuaaauacuccgaagaggccaagcugaaccgagaagagaucgacggggucaaacuugagagcacaagaauuuaucaaauccuggcuauuuacucuaccguggcgucaaguuugguccucgugguuagccugggagcaauauccuuuuggaugugcucuaaugguucguuacagugcaggaucuguauuuga

SEQ ID NO: 134952 - RNA, 1701 nt, Artificial Sequence; identical to SEQ ID NO: 124927
  derived and/or modified sequence opt3 from hemagglutinin__InfluenzaA__AJJ99965

SEQ ID NO: 134953 - RNA, 1698 nt, Artificial Sequence
  derived and/or modified sequence opt3 from hemagglutinin__InfluenzaA__AJJ99989
augaaggugaaacugcucguccuucugugcaccuucacagccacuuacgcugacacgaucuguauuggcuaucacgcaaacaauagcaccgauacaguugacacuguguuggagagaaacguaaccgugacacauuccgucaauuuacuggaaaacucucacaaugggaagcuaugccuccugaaaggaauagcgccccuucagcuggguaacuguucaguggccggcuggaucuuggggaauccugagugcgaacuccugauuaguaaggagagcugguccuacaucguugaaaaaccaaacccggagaauggaaccuguuaucccggccauuuugcugauuacgaggaacugagggagcaacucucuucggugagcucauucgaacgguuugagauuuucccuaaggagaguuccuggccaaaccacacugucacaggugugucugccagcugcucccauaauggggaaucaaguuuuuaucgcaacuuacuguggcuuaccggaaagaauggcuuguaccccaaccugagcaaaucuuaugcaaauaacaaggagaaagaaguucuaguacucuggggcgugcaccacccuccaaacaucggggaccagaaggcccuguaccauacggagaaugcuuacgucuccguggugucaagccacuauaguaaaaaguucacucccgaaauagcaaagcgaccuaaaguccgugaucaggagggaagaaucaacuacuauuggacccuucuggagccaggugacacaauuaucuuugaagccaauggcaacuugauugcuccgagguacgccuucgcgcucucucggggguuuggauccggcaucauaaauagcaacgcacccauggauaagugugacgccaaaugccagacuccucaaggugcuauuaauucgucucugccauuccagaacguucaucccgugaccaucggggaguguccuaaguauguacgcuccgccaaauuaagaauggugacaggacugaggaauauuccaucaauccagagucggggccucuuuggcgcaaucgcuggguucauugaaggagguuggaccggcauggucgaugggugguacggauaucaccaccagaacgagcaaggcagcgguuacgccgcggaccagcgcuccacgcagaaugccauaaacgggaucacuaauaaggugaacucuguuauugaaaagaugaauacacaguuuaccgcagugggcaaggaguucaacaaacuugagcgaagaauggaaaaccugaauaaaaaggucgaugacggauucaucgauauauggacuuacaacgcugaguugcuagugcugcucgaaaaugagaggacacuggacuuucaugacagcaacguuaaaaaucuuuaugaaaagguaaaaucacaacugaagaacaaugccaaggagauuggcaacgggugcuucgaguuuuaccacaaauguaaugaugaaugcauggagagugugaagaacggaaccuaugacuaccccaaauauuccgaagagagcaaguugaaucgggagaaaaucgauggugucaagcucgaaucuaugggcguguaccagauccuggcuauuuauucaacggucgccaguagcuuagugcugcuaguuucccucggggcaaucucuuucuggaugugcucgaacggaagccugcagugucguauuugcauauga

SEQ ID NO: 134954 - RNA, 1701 nt, Artificial Sequence
  derived and/or modified sequence opt3 from hemagglutinin__InfluenzaA__AJK00001
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucgcgcaggggaaaagaguuuuuauaagaaccugaucuggcucgugaaaaagggaaauagcuacccaaaauuaucuaaguccuauauaaacgauaagggcaaagagguacugguucuuuggggcauccaucaccccucaacgacugccgaccaacagagcuuguaccagaaugcugaugccuacguguucgucgggaccagucgauauucuaagaaauuuaagccugagauugcgauccguccaaaagugagagaccaggaaggaaggaugaacuacuauuggacacugguggagcccggugauaagauuacuuucgaagcaaccggcaaccuacucgucccucgguacgccuuugcuauggagcgcaaugccggguccggaaucauaauuagcgacacaccaguucacgauugcaacaccacgugucaaacuccgaaaggcgcaaucaauacaucgcugcccuuccagaacauucauccuaucaccaucgguaagugcccaaaguaugugaaaucuacuaaacuuagacuggcuacaggguugaggaauguacccuccauucagucacggggacucuuuggcgccauagcgggcuucaucgaagggggauggaccgguaugguggacggcugguacggguaucaccaucagaacgagcaaggaaguggcuacgccgcagaccugaaaagcacgcagaaugcuauugauaagaucaccaacaaagucaauuccgugauagagaagaugaacacacaguuuacugccguugguaaggaguucaaucacuuagagaaacgcauugaaaaccugaauaagaaaguggacgauggguuccucgacaucuggaccuacaacgcugagcuucuggucuugcuagaaaaugagcgaacacuggauuaucacgacucuaacgugaagaaccucuacgagaaaguaagaaaucagcugaagaacaaugccaaggaaaucggcaacggauguuuugaguucuaucauaaaugcgauaauacuuguauggaaagcguuaagaacggcaccuacgacuauccuaaauacucagaggaagcaaaacuuaauagggagaagauugauggggugaagcuggagaguacacggaucuaucaaauuuuggccauauacuccaccgucgcuagcucucucgugcuggucgugucauuaggagcgaucaguuuuuggaugugcagcaacgguucccugcagugccguauuuguaucuga

SEQ ID NO: 134955 - RNA, 1701 nt, Artificial Sequence
  derived and/or modified sequence opt3 from hemagglutinin__InfluenzaA__AJK00012
augaaggccauccuggugguccuccuuugcaccuucgcuacagcaaacgccgacacucuguguauuggcuaccacgcgaauaacagcacggauaccguugacacaguguuggagaaaaauguaacugugacccauuccgucaacuuacuggaagauaagcacaaugggaaacuaugcaagcucagaggaguggcuccccugcaucuugguaaauguaacauagccggcuggauccuggggaauccugagugcgaaucuuugucaacagcaaguagcugguccuauauuguugagaccucuucgucagacaacggaacuuguuacccaggcgauuuuaucgacuaugaagaacucagggagcagcugagcaguguguccucuuucgaacgguuugagauuuucccgaagacaagcuccuggcccaaucacgauucaaacaagggugucaccgccgcuugcccucaugcaggggccaaaggauuuuacaagaaucugaucuggcucgugaaaaagggcaacaguuauccaaaauuaagcaagucuuacauaaaugacaagggcaaagaaguacugguucuuugggggauccaccaccccuccacgacugcugaucaacagucauuguaucagaacgccgacaccuacguguucgucggaacaagccgcuacaguaagaaauuuaagccugagauugcgauccgaccaaaagugcgugaucaggaggguagaaugaauuauuacuggacucugguggaacccggcgacaagauuaccuucgaggcaacagggaaccuagucguuccuagguaugccuuugcuauggaacggaacgccggaucuggcaucauaauuuccgauaccacggugcaugacuguaauacuacaugccaaaccccaaaaggugcaaucaacacuagccucccguuccagaauauucaccccaucacaaucgggaaguguccuaaguacguaaaaucgaccaagcugcgccuugcuacgggacugagaaacgugccaucuauucaguccaggggcuuguuuggcgccauagcgggguucaucgagggagguuggaccggcauggucgacgggugguauggauaccaucaccagaaugaacaaggcucagguuaugccgcagaucucaaaaguacacagaacgcuauugacaagaucacuaauaaagugaacagcguuauagagaagaugaauacccaguuuacagccguggggaaggaguucaaccaccuggaaaaacggauugagaauuuaaacaagaaagucgaugacggcuuccuggauaucuggacuuacaaugcugaacuccuugugcuguuggagaacgaacgcacccuagacuaccaugauuccaauguaaagaaccuguaugagaaaguucgaaaccagcucaagaauaacgccaaggagaucggagacggcugcuuugaguucuaccacaaaugugauaauacaugcauggagucugugaagaacgggaccuaugacuaccccaaauauagcgaagaggcaaagcugaauagagaaaagauugauggagucaaacuugagucaacuaggaucuaccaaauucuggccauauauaguacgguggcuuccagcuugguccucgugguuucucugggugcgaucucauuuuggaugugcaguaacggcagcuuacagugucggauuugcaucuga

SEQ ID NO: 134956 - RNA, 1701 nt, Artificial Sequence
  derived and/or modified sequence opt3 from hemagglutinin__InfluenzaA__AJK00023
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucgcgcaggggccaaaaguuuuuauaagaaccugaucuggcucgugaaaaagggaaauagcuacccaaaauuaucuaaguccuauauaaacgauaagggcaaagaaguacugguucuuuggggcauccaucaccccucaacgacugcugaccaacagagcuuguaccagaaugccgaugcguacguguucgucgggaccagucgauauucuaagaaauuuaagccugagauugcaauccguccaaaagugagagaccaggagggaaggaugaacuacuauuggacacugguggaacccggugauaagauuacuuucgaggccaccggcaaccuacucgucccucgguacgcuuuugccauggaacgcaaugcaggguccggaaucauaauuagcgacacaccaguucacgauugcaacaccacgugucaaacuccgaaaggcgcuaucaauacaucgcugcccuuccagaacauucauccuaucaccaucgguaagugcccaaaguaugugaaaucuacuaagcugagacuugccacaggguugaggaauguacccuccauucagucacggggacucuuuggcgcgauagccggcuucaucgaagggggauggaccgguaugguggacggcugguacggguaucaccaucagaacgaacaaggaaguggcuacgcagcugaccugaaaagcacgcagaaugccauugauaagaucaccaacaaagucaauuccgugauagagaagaugaacacacaguuuacugcuguugguaaggaguucaaucacuuagaaaaacgcauugagaaccugaauaagaaaguggacgauggguuccucgacaucuggaccuacaacgccgaacuucuggucuugcuagagaaugaacgaacacuggauuaucacgacucuaacgugaagaaccucuacgagaaaguaagaaaucagcugaagaacaaugcaaaggagaucggcaacggauguuuugaguucuaucauaaaugcgauaauacuuguauggaaagcguuaagaacggcaccuacgacuauccuaaauacucagaagaggccaaacuuaauagggaagagauugauggggugaagcuggagaguacacggaucuaucaaauuuuggcuauauacuccaccgucgcgagcucucucgugcuggucgugucauuaggagcaaucaguuuuuggaugugcagcaacgguucccugcagugccguauuuguaucuga

SEQ ID NO: 134957 - RNA, 1701 nt, Artificial Sequence; identical to SEQ ID NO: 128840
  derived and/or modified sequence opt3 from hemagglutinin__InfluenzaA__AJK00034

SEQ ID NO: 134958 - RNA, 1701 nt, Artificial Sequence; identical to SEQ ID NO: 129058
  derived and/or modified sequence opt3 from hemagglutinin__InfluenzaA__AJK00045

SEQ ID NO: 134959 - RNA, 1701 nt, Artificial Sequence; identical to SEQ ID NO: 129058
  derived and/or modified sequence opt3 from hemagglutinin__InfluenzaA__AJK00056

SEQ ID NO: 134960 - RNA, 1701 nt, Artificial Sequence; identical to SEQ ID NO: 124927
  derived and/or modified sequence opt3 from hemagglutinin__InfluenzaA__AJK00067

SEQ ID NO: 134961 - RNA, 1698 nt, Artificial Sequence
  derived and/or modified sequence opt3 from hemagglutinin__InfluenzaA__AJK00079
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcagcuucgaaagguuugagauuuucccuaaggagaguuccuggccaaaccacacugucacaggugugucugccagcugcucccauaauggggaaaacucauuuuaucggaauuuacuguggcuuacccgcaaaaacggauuguaccccaaucugaguaagagcuaugcaaacaacaaagagaaggaagugcuaguucucuggggcgugcaccacccuccaaauaucgccgaccagaaaacgcuguaccauacugagaacgcuuacgucucugugguguccucacacuauagccgaaaguucacccccgaaauagcaaagcguccuaaagucagagaucaggagggcaggaucaauuacuauuggacacuucuggagccaggggacacuauuaucuuugaagccaacggaaauuugauugcuccgcgguacgccuucgcgcucagucgcgguuuuggcucugggaucauaaacuccaaugcacccauggauaagugugacgccaaaugccagaccccucaaggagcuauuaacagcucgcugccauuccagaauguucaucccgugacaaucggcgaguguccuaaguauguaagaucugccaaauuaaggauggugaccggucugcggaacauuccauccauccagucacgcgggcucuuuggagcaaucgcuggcuucauugaaggcggguggacgggaauggucgaugguugguacggcuaucaccaccagaaugagcaagggaguggauacgccgcggaccagaagucaacucagaacgccauaaauggcaucacaaacaaaguaaauuccguuauugaaaagaugaacacccaguuuacugcaguggguaaggaguucaacaaacuugagcgaagaauggaaaaucugaacaagaaagucgaugacggguucaucgauauauggacauacaaugcugaguugcuagugcugcucgaaaacgagaggacccuggacuuucaugacucuaauguaaagaaccuuuaugaaaaaguuaagagccaacugaagaauaacgccaaagagauuggcaauggaugcuucgaguuuuaccacaaguguaacgaugaaugcauggagucagugaaaaauggcacguaugacuaccccaaguauagugaagaguccaaauugaaccgggagaagaucgauggggucaagcucgaaagcaugggaguguaccagauccuggcuauuuauucuaccgucgccucaaguuuagugcugcuaguuagccucggugcaaucuccuucuggaugugcucuaauggcucgcugcagugucguauuugcauauga

SEQ ID NO: 134962 - RNA, 1698 nt, Artificial Sequence
  derived and/or modified sequence opt3 from hemagglutinin__InfluenzaA__AJK00091
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacuaucacaggugucucugccagcugcucccauaauggggaaucaaguuuuuaucggaacuuacuguggcuuaccggcaaaaauggauuguaccccaaccugagcaagucuuaugcaaauaacaaagagaaggaagugcuaguacucuggggcguucaccacccuccaaacauaggggugcagaaagcccuguaccauacggagaaugcuuacgucuccguggugucaagccacuauagucgcaaguucacucccgaaaucgcaaagcgaccuaaaguccgugaccaggagggaagaauuaacuacuauuggacccuucuggagccaggugauacaaucauuuuugaagccaauggcaacuugaucgcuccgagguacgccuucgcgcucucucggggguuuggauccggcauaauuaauagcaacgcacccauggacaagugugaugccaaaugccagacuccucaaggugcuaucaauucgucucugccauuccagaacguucaucccgugaccauuggggaguguccuaaguauguacgcuccgccaaauuaagaauggugacaggacugaggaauaucccaucaauccagagucggggccucuuuggcgcaauugcuggguucauagaaggagguuggaccggcauggucgacgggugguacggauaucaccaccagaacgagcaaggcagcgguuacgccgcggaucagaaguccacgcagaaugccaucaacgggauuacuaauaaagugaacucuguuaucgaaaagaugaauacacaguuuaccgcagugggcaaggaguucaacaaacuugagcgccgaauggaaaaccugaauaagaaagucgacgauggauucauagacauuuggacuuacaacgcugaguugcuagugcugcucgaaaaugagagaacacuggauuuucaugacagcaacguaaagaaucuuuaugaaaaaguuaagucacaacugaagaacaaugccaaagagaucggcaacgggugcuucgaguuuuaccacaaguguaaugacgaaugcauggagagugugaaaaacggaaccuaugauuaccccaaguauuccgaagagagcaaauugaauagggagaagaucgacggugucaagcucgaaucuaugggcguguaccagauucuggcuaucuauucaacggucgccaguagcuuagugcugcuaguuucccucggggcagugucuuucuggaugugcucgaacggaagccugcagugucggguaugcauuuga

SEQ ID NO: 134963 - RNA, 1698 nt, Artificial Sequence; identical to SEQ ID NO: 124504
  derived and/or modified sequence opt3 from hemagglutinin__InfluenzaA__AJK00103

SEQ ID NO: 134964 - RNA, 1701 nt, Artificial Sequence; identical to SEQ ID NO: 128936
  derived and/or modified sequence opt3 from hemagglutinin__InfluenzaA__AJK00114

SEQ ID NO: 134965 - RNA, 1701 nt, Artificial Sequence
  derived and/or modified sequence opt3 from hemagglutinin__InfluenzaA__AJK00125
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagagagguggcuccccugcaucuuggaaaaugcaacauagccgguuggauccugggcaauccugaaugugagucuuugucaacagcaaguagcugguccuacauuguugaaaccucuucgucagacaacgggacuugcuauccaggagauuuuaucgacuacgaggagcucagggaacagcugagcaguguguccucuuucgagcgguuugaaauuuucccgaagacaaauagcuggcccaaccacgauuccaauaagggcgucaccgccgcuuguccucaugccggugcaaaaucauuuuauaagaaccugaucuggcucgugaaaaaggggaauaguuacccaaaauuaagcaagucuuauauaaacgacaagggaaaagagguacugguucuuuggggcauccaccaccccuccacgucagcugaucaacagagcuuguaccagaaugccgacgcguacguguucgucggcaccagucgcuauucuaagaaauuuaagccugagauugcaauccgaccaaaagugcgugaucaggaagggagaaugaacuacuauuggacucugguggagcccggagacaagauuacauucgaagccacugguaaccuagucguuccuagguacgcuuuugccauggagcggaaugcaggcuccgggaucauaauuagcgauaccccaguguaugacugcaacacaaccugucaaacgccgaaaggagcuaucaauacuucgcuccccuuccagaacauucauccuaucacaaucggcaagugcccaaaguacguaaaaucuaccaagcugcgccuugccacuggucugagaaaugugcccuccauucagucaaggggguuguuuggagcgauagccggcuucaucgaaggcggguggacaggaauggucgacgguugguauggcuaccaccaucagaacgagcaagggaguggauacgcagcugaucucaaaagcacccagaaugccauugacgagaucacgaacaagguaaauuccguuauagaaaagaugaacacccaguuuacagcugugggcaaagaguucaaucaccuggaaaagcggauugagaacuuaaauaaaaaggucgaugacgguuuccuggauaucuggacuuauaacgccgaacuccuugugcuguuggagaaugagcgcacccuagacuaccacgauucuaacgugaaaaaccuguaugaaaagguucgaagccagcucaaaaauaacgcaaaggagaucgggaauggcuguuuugaguucuaccauaagugcgacaacacauguauggaaucagugaaaaauggaacuuaugauuacccuaaguauagugaagaggccaaacugaacagagagaagauugacggcgucaaacuugaauccaccaggaucuaccaaauucuggcuauauacagcacaguggcgucuucauugguccucgugguuagucugggggcaaucagcuuuuggaugugcuccaauggaucuuuacagugccggauuuguaucuga

SEQ ID NO: 134966 - RNA, 1701 nt, Artificial Sequence; identical to SEQ ID NO: 124685
  derived and/or modified sequence opt3 from hemagglutinin__InfluenzaA__AJK00136

SEQ ID NO: 134967 - RNA, 1704 nt, Artificial Sequence
  derived and/or modified sequence opt3 from hemagglutinin__InfluenzaA__AJK00166
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucagagauugcucaguggccgguuggcugcuuggcaacccuaugugugacgaguucaucaauguuccagaauggaguuauauaguggagaaggcgaacccggcuaaugaucugugcuaccccgggaacuuuaaugacuaugaggaauugaagcaucuccugagcaggaucaaccacuucgagaaaauucagaucauuccuaaguccucuuggucggaucaugaagccucaagcggagucaguuccgcauguccauaccagggcaaacccagcuuuuuccggaaugugguauggcugaucaagaaaaacaauacauauccuacuauaaagcgcucuuacaacaauaccaaccaagaggaccucuuaauucugugggguauccaccacuccaacgaugccgcugagcagacaaaacuuuaucagaauccaaccacuuacauuucaguugggacaaguaccuugaaccagcgacuggugcccaaaaucgcaacgcguagcaaggucaauggacaaucuggcagaauggacuuuuucuggacuauccuaaaaccuaacgaugccauuaauuuugaauccaacggcaauuucauagcuccagaguacgccuauaagaucgugaaaaagggggacucagcgauuaugaaaagcgaaguggaguacggaaacugcaauaccaagugucagacaccgaucggugcaauaaacaguucuaugcccuuucauaauauucacccucucacuaucggcgaaugcccaaaguaugucaaauccaacaagcugguucuugccaccgggcugaggaauagccccuugcgggagcgcagaaggaaacggggacucuucggcgcuaucgccgguuuuauugaagggggauggcagggcaugguggacggcugguacggguaucaucacucgaacgaacagggaucugguuacgcagcugauaaggaguccacacaaaaagccaucgacggcguaaccaauaaggugaacucaauuauagauaagaugaacacgcaguucgaagcggucgggcgcgaguuuaauaaccuggaacgaagaaucgagaauuuaaacaaaaagauggaggacggauuccuggauguguggacuuauaaugccgaacuccuuguucugauggagaacgaaaggacauuggacuuccacgauaguaaugugaaaaaccuauacgacaagguccggcugcagcuccgugauaaugcaaaagagcugggcaacgguuguuuugaguucuaccauaagugcgacaaugaguguauggagagcgugcgcaacgggaccuaugauuacccucaauauuccgaagaggcuagacuuaagagggaagagauuucuggcguaaaacuggagagcaucggaacuuaccagaucuugucaauuuauaguacaguugccuccagccucgcucuggccauaaugguggcaggcuuaucucuguggaugugcucaaaugggagucuacagugccggaucuguauuuga

SEQ ID NO: 134968 - RNA, 1707 nt, Artificial Sequence
  derived and/or modified sequence opt3 from hemagglutinin__InfluenzaA__AJK00177
auggagaagaucgugcugcuccuugccgucguuagccuggugagauccgaccagauuugcauaggcuaccacgcuaacaauucuaccgaacaaguagauacaaucauggagaaaaacgugacugucacgcaugcacaggacauuuuggaaaagacccacaaugggaaauuaugugaucuggacggagugaagccccuaauccucagggauugcucaguugccgguuggcugcuuggcaacccuaugugugacgaguucauuaaugugccagaauggaguuauaucgucgagaaagcgaacccggcuaaugaucugugcuaccccgggaacuugaaugacuaugaggaacucaagcaucugcugagccggauaaaccacuuugagaagauccagauuaucccuaaauccucuuggucggaucaugaagccucacucggagugagcagugcauguccauaccagggcacacccuccuucuuucgcaauguaguuugguuaauuaagaaaaacaauacuuauccuaccaucaagcgaucuuacaacaauacaaaccaagaggaccugcuuauauugugggguauucaccacagcaacgaugaggccgaacagaucaaacuguaucagaauccaaccacuuacguguccgucgggacaucaacccuaaaccagcgucucgugcccaagauugcuacgagaaguaaggugaauggacaaagcggcaggauggacuucuuuuggacuauccugaaaccugaugacgcaaucaacuucgagucuaauggcaacuuuauugccccagaauacgcuuauaagauagucaaaaagggggacuccgccaucaugaaaucagagguugaauacggaaauugcaacaccaagugucagacaccgauuggugcgaucaauagcaguaugcccuuccauaacauacacccucuuacuauuggcgagugcccaaaauaugugaagucuaauaagcugguauuggcaaccgggcuccggaacagcccccugcgcgagaaaagaaggcggaagcgcggauuauuuggcgccaucgcugguuucaucgaagggggauggcagggcaugguggauggcugguacggguaucaucacuccaaugagcagggaucggguuacgccgcagacaaagaaucuacacaaaaggcuauugauggcgucaccaacaaaguuaauuccaucauugacaagaugaacacgcaguuugaggccguggggcgagaguucaacaaucuggaaagaaggauagagaaccucaauaagaaaauggaagauggauuucuugacguguggacuuauaacgcggagcuguugguccuaauggaaaaugagcggacacuggauuuccacgacucaaacgugaagaaucucuacgauaaaguacgucugcagcuucgcgacaacgccaaggaacugggcaaugguuguuucgaguuuuaccauaaaugcgauaacgaguguauggaaaguguuagaaaugggaccuaugacuacccucaauauagcgaggaagcaagguugaagcgggaggagaucuccggcgugaagcucgaaucuauuggaaucuaccagauccugagcauuuauucaacugucgcuaguuccuuagcccuggcuauaaugguggccggccuaagccucuggaugugcucuaacgggucacugcagugccgaaucuguauuuga

SEQ ID NO: 134969 - RNA, 1704 nt, Artificial Sequence
  derived and/or modified sequence opt3 from hemagglutinin__InfluenzaA__AJK00188
auggagaagaucgugcugcuccuugccgucguuagccuggugagauccgaccagauuugcauaggcuaccacgcuaacaauucuaccgaacaaguagauacaaucauggagaaaaacgugacugucacgcaugcacaggacauuuuggaaaagacccacaaugggaaauuaugugaucuggacggagugaagccccuaauccucagggauugcucaguugccgguuggcugcuuggcaacccuaugugugacgaguucauuaaugugccagaauggaguuauaucgucgagaaagcgaacccggcuaaugaucugugcuaccccgggaacuugaaugacuaugaggaacucaagcaucugcugagccggauaaaccacuuugagaagauccagauuaucccuaaauccucuuggucggaucaugaagccucacucggagugagcagugcauguccauaccagggcacacccuccuucuuucgcaauguaguuugguuaauuaagaaaaacaauacuuauccuaccaucaagcgaucuuacaacaauacaaaccaagaggaccugcuuauauugugggguauucaccacagcaacgaugaggccgaacagaucaaacuguaucagaauccaaccacuuacauuuccguggggacaucaacccuaaaccagcgucucguccccaagaucgcuacgagaaguaaggugaauggacaaagcggcaggauggacuucuuuuggacuauccugaaaccugaugacgcaauuaacuucgagucuaauggcaacuuuauagccccagaauacgcuuauaagaucgugaaaaagggggacuccgccauuaugaaaucagaggucgaauacggaaauugcaacaccaagugucagacaccgaucggugcgauaaauagcaguaugcccuuccauaacauucacccucuuacuaucggcgagugcccaaaauauguuaagucuaauaagcugguguuggcaaccgggcuccggaacagcccccugcgcgagaaaagaaggaagcggggauuauuuggcgccaucgcugguuucauugaagggggauggcagggcaugguagauggcugguacggguaucaucacuccaaugagcagggaucggguuacgccgcagacaaagaaucuacacaaaaggcuaucgauggcgugaccaacaaagucaauuccauuauagacaagaugaacacgcaguuugaggccguggggcgcgaguucaacaaucuggaacgaagaaucgagaaccucaauaagaaaauggaagauggauuucuugacguuuggacuuauaacgcggagcuguuggugcuaauggaaaaugagaggacacuggauuuccacgacucaaacgucaagaaucucuacgauaaagugcggcugcagcuucgugacaacgccaaggaacugggcaaugguuguuucgaguuuuaccauaaaugcgauaacgaguguauggaaaguguacgcaaugggaccuaugacuacccucaauauagcgaggaagcaagauugaagagggaggagauuuccggcguuaagcucgaaucuaucggaacuuaccagauccugagcauuuauucaacaguggcuaguuccuuagcccuggcuauaauggucgccggccuaagccucuggaugugcucuaacgggucacugcagugccggaucuguauuuga

SEQ ID NO: 134970 - RNA, 1704 nt, Artificial Sequence
  derived and/or modified sequence opt3 from hemagglutinin__InfluenzaA__AJK00207
auggagaagaucgugcugcuccuugccauugucagccugguuagauccgaccagauaugcaucggcuaccacgcuaacaauucuaccgaacaaguggauacaauuauggagaaaaacguaacugugacgcaugcacaggacaucuuggaaaagacccacaaugggaaauuaugugaucuggacggagucaagccccuaauucucagggauugcucaguggccgguuggcugcuuggcaacccuaugugugacgaguucaucaauguuccagaauggaguuauauaguggagaaagcgaacccggcuaaugaucugugcuaccccgggaacuuuaaugacuaugaggaauugaagcaucuccugagccggaucaaccacuucgagaagauucagaucauuccuaaauccucuuggucggaucaugaagccucaagcggagucaguuccgcauguccauaccagggcacacccagcuuuuuccgcaaugugguauggcugaucaagaaaaacaauacuuauccuaccauaaagcgaucuuacaacaauacaucccaagaggaccucuuaguucugugggguauucaccacucaaacgaugccaccgagcagaugaaacuuuaucagaacccaacuacauacgugagugucgggaccagcacguugaaucagcgucuggugcccaagaucgcuacuagaucuaaggugaacggacaauccggcaggauggacuuuuucuggaccauucuaaaaucaaaugaugcaaucaacuuugaaagcaauggcaacuucaucgccccugaguacgcuuauaagauugucaaaaagggggacagugccauaaugaaaucugaaguugaguacggaaauugcuccacaaagugucagacuccaaucggugcgauuaacagcucgaugccguuucauaauauccacccccucaccauaggcgaaugcccuaaauaugugaagucuaacaagcugguacuugcaacagggcugcgcaauuccccauugcgggagagaaggcggaaacgcggacucuucggcgccauugcugguuuuaucgaagggggauggcagggcaugguggacggcugguacggguaucaucacucaaacgaacagggaagugguuacgccgcagauaaggagagcacccaaaaagcuaucgacggcgucacgaauaaggugaacuccauuaucgauaaaaugaauacucaguucgaagccguugggcgagaguuuaacaaccuggaaagaaggauugagaauuuaaacaagaagauggaggacggauuccuggauguguggacauauaaugcggaacuccuuguccugauggagaacgaacggaccuuggacuuccacgauucuaaugugaaaaaccuauacgacaagguacgucugcagcuccgcgauaauacuaaagagcugggcaacgguuguuuugaguucuaccauaagugcgacaaugaguguauggagagcguuagaaacgggacauaugauuacccccaauauucagaagaggccaggcuuaaacgggaagagauaaguggcgugaagcuggaguccaucggaaccuaccagauuuugagcaucuauucuacggucgcaucaagucucgcucuggccaucaugguggcuggcuuaagccuguggaugugcuccaaugggucucuacagugccgaauuuguauauga

SEQ ID NO: 134971 - RNA, 1704 nt, Artificial Sequence
  derived and/or modified sequence opt3 from hemagglutinin__InfluenzaA__AJK00218
auggagaagaucgugcuguuccucgccauugucagccuuguuagauccgaccagauaugcaucggcuaccacgcuaacaauucuaccgaacaaguggauacaauuauggagaagaacguaacugugacgcaugcacaggacauccuggaaaagacccacaaugggaaauugugugauuuagacggagucaagccccugauucuaagggauugcucaguggccgguuggcuccugggcaacccuaugugugacgaguuuaucaauguuccagaauggaguuauauaguggagaaagcgaacccggcuaaugaucuuugcuaccccgggaacuucaaugacuaugaggaacugaagcauuugcucagccggaucaaccacuuugagaagauucgcaucauuccuaaauccucuuggccagaucaugaagccucgucaggagucagcagugcaugucccuaccagggcacaccuuccuucuuucgaaauaucguguggcugauaaagaaaaacaauacuuauccaaccauuaagcguucuuacaacaauacaagccaggaggaccugcucguauuaugggguauccaccacuccucagaugccaccgagcaaauuaaacuguaucagaaccccacuacauacguuaguguggggaccagcacgcuuaaccagagauuggucccuaagaucgcuacuaggucuaaggugaauggacaguccggccggauggacuucuuuuggaccauccugaaaucaaacgaugcaauuaauuucgaaagcaacggcaauuuuauagccccagaguacgcuuauaagaucgugaaaaagggggacagugccauuaugaaaucugaagucgaguacggaaacugcuccacaaagugucaaacuccgaucggugcgauaaauagcucgaugcccuuccauaacauucacccucuaaccaucggcgaaugcccaaaauauguuaagucuaauaagcucgugcuggcaacagggcuucgcaacucaccccugagagagaggcggcgcaaacgaggauuguuuggcgccaucgcugguuucauugaagggggauggcagggcaugguagacggcugguacggguaucaucacuccaaugagcagggaagugguuacgccgcagauaaggagagcacccagaaagcuaucgacggcgugacgaacaaggucaauuccauuauagauaaaaugaacacucaauuugaagccguggggagagaguucaauaaccucgaaaggcggaucgagaaccugaauaagaagauggaggacggauucuuagauguuuggacauauaacgcggaacugcucgugcuuauggagaaugaacguacccuggacuuucacgauucuaacgucaaaaauuuguacgacaaggugcgccuacagcugagagauaacgccaaagagcucggcaaugguuguuucgaauuuuaccauaagugcgacaacgaguguauggagagcguaaggaaugggacuuaugauuacccucaguauucagaagaggcacggcugaaacgagaagagauuaguggcguuaaacuugaguccaucggaacauaccaaauccugagcauuuauucuaccgcugccucaaguuuggcucucgccauaaugguggcaggccugagcuuauggaugugcuccaacgggucucugcagugccgcaucuguauuuga

SEQ ID NO: 134972 - RNA, 1704 nt, Artificial Sequence
  derived and/or modified sequence opt3 from hemagglutinin__InfluenzaA__AJK00239
auggagaagaucgugcugcuccuugccauugucagccugguuagauccgaccagauaugcaucggcuaccacgcuaacaauucuaccgaacaaguggauacaauuauggagaaaaacguaacugugacgcaugcacaggacaucuuggaaaagacccacaaugggaaauuaugugaucuggacggagucaagccccuaauucucagggauugcucaguggccgguuggcugcuuggcaacccuaugugugacgaguucaucaauguuccagaauggaguuauauaguggagaaagcgaacccggcuaaugaucugugcuaccccgggaacuuuaaugacuaugaggaauugaagcaucuccugagccggaucaaccacuucgagaagauucagaucauuccuaaauccucuuggucggaucaugaagccucaagcggagucaguuccgcauguccauaccagggcacacccagcuuuuuccgcaaugugguauggcugaucaagaaaaacaauacuuauccuaccauaaagcgaucuuacaacaauacaucccaagaggaccucuuaguucugugggguauucaccacucaaacgaugccaccgagcagaugaaacuuuaucagaacccaacuacauacgugagugucgggaccagcacguugaaucagcgucuggugcccaagaucgcuacuagaucuaaggugaacggacaauccggcaggauggacuuuuucuggaccauucuaaaaucaaaugaugcaaucaacuuugaaagcaauggcaacuucaucgccccugaguacgcuuauaagauugucaaaaagggggacagugccauaaugaaaucugaaguugaguacggaaauugcuccacaaagugucagacuccaaucggugcgauuaacagcucgaugccguuucauaauauccacccccucaccauaggcgaaugcccuaaauaugugaagucuaacaagcugguacuugcaacagggcugcgcaauuccccauugcgggagagaaggcggaaacgcggacucuucggcgccauugcugguuuuaucgaagggggauggcagggcaugguggacggcugguacggguaucaucacucaaacgaacagggaagugguuacgccgcagauaaggagagcacccaaaaagcuaucgacggcgucacgaauaaggugaacuccauuaucgauaaaaugaauacucaguucgaagccguugggcgagaguuuaacaaccuggaaagaaggauugagaauuuaaacaagaagauggaggacggauuccuggauguguggacauauaaugcggaacuccuuguccugauggagaacgaacggaccuuggacuuccacgauucuaaugugaaaaaccuauacgacaagguacgucugcagcuccgcgauaaugccaaagagcugggcaacgguuguuuugaguucuaccauaagugcgacaaugaguguauggagagcguuagaaacgggacuuaugauuacccccaauauucagaagaggcaaggcuuaaacgggaagagauaaguggcgugaagcuggaguccaucggaacauaccagauuuugagcaucuauucuaccgucgcuucaagucucgcccuggcuaucaugguggccggcuuaagccuguggaugugcuccaaugggucucuacagugccgaauuuguauauga

SEQ ID NO: 134973 - RNA, 1704 nt, Artificial Sequence
  derived and/or modified sequence opt3 from hemagglutinin__InfluenzaA__AJS18468
auggagaagaucgugcugcuccuugccgucguuagccuggugaaauccgaccagauuugcauaggcuaccacgcuaacaauucuaccgaacaaguagauacaaucauggagaagaacgugacugucacgcaugcacaggacauuuuggagaaaacccacaaugggagauuaugugaucugaacggagugaagccccuaauccucaaagacugcucaguugccgguuggcugcuuggcaauccuaugugugaugaguucauuagggugccagaauggaguuauaucgucgagcgggcgaacccggcuaaugaccugugcuaccccgggaacuugaaugauuaugaggaacucaagcaucugcugagccgcauaaaccacuuugagaagacacucaucauuccuaaauccucuuggccaaaucaugaaacuucguuaggagugucagccgcaugucccuaccagggcguaccuagcuucuuucgaaacguuguguggcugaccaagaaaaaugacgccuauccaacaaucaagaugaguuacaacaauaccaaccgugaggaucuuuugauucugugggguauccaccacuccaacaaugcugcagagcagacuaaccuauauaaaaaucccacaaccuacgucucuguggggacgagcacucucaaccaaagacuggugccuaagauagccaccaggucccaggucaauggacagcggggccgcauggacuucuuuuggacaauucuuaagccaaacgaugcuauccauuucgaaucaaauggcaacuuuauugccccggaguacgcguauaaaaucguuaagaaaggggacaguacuaucaugaaaagcgaaauggaguacggacacugcaauaccaagugucagacacccauuggugcaauaaacucuuccaugccuuuccauaauauccacccacugaccauuggcgaaugccccaaguaugugaaaucaaacaaguugguacucgccacggggcugagaaauagcccuuuaagggagcggcgccgaaagagaggacuguuuggcgcuaucgccgguuucauagaagggggauggcaaggcaugguggauggcugguacggguaucaccauaguaacgaacagggaucugguuacgcagcugacagggaguccacucagaaagccauugacggcgucacaaauaaggugaacagcaucaucgauaaaaugaacacccaguuugaagcgguugggcgggaguucaauaaccucgaacgucgcauugagaaucuuaacaagaaaauggaggacggauuucuggauguguggacuuauaaugccgaauugcuaguccugauggagaacgaaagaacacucgacuuccacgauucgaaugugaagaaccuguacgacaagguaaggcuucaacugcgggauaaugcaaaagaguugggcaacgguuguuucgaauuuuaccauaagugcgacaaugaguguauggagucuguucgaaacgggaccuaugauuacccacaguauuccgaagaggcucgccucaaaagagaagagaucucaggcgugaagcuggagaguauuggaacguaccagauauuaagcaucuauuccaccgucgccucuagccugacacuagcuauuaucguggccggccucucacuguggaugugcaguaaugggucccuucaaugcaggaucuguauuuga

SEQ ID NO: 134974 - RNA, 1704 nt, Artificial Sequence
  derived and/or modified sequence opt3 from hemagglutinin__InfluenzaA__AJS18479
auggagaagaucgugcugcuccuugccgucguuagccuggugaaauccgaccagauuugcauaggcuaccacgcuaacaauucuaccgaacaaguagauacaaucauggagaagaacgugacugucacgcaugcacaggacauuuuggagaaaacccacaaugggagauuaugugaucugaacggagugaagccccuaauccucaaagacugcucaguugccgguuggcugcuuggcaauccuaugugugaugaguucauuagggugccagaauggaguuauaucgucgagcgggcgaacccggcuaaugaccugugcuaccccgggaacuugaaugauuaugaggaacucaagcaucugcugagccgcauaaaccacuuugagaagacacucaucauuccuaaauccucuuggccaaaucaugaaacuucguuaggagugucagccgcaugucccuaccagggcaugccuagcuucuuucgaaacguaguuuggcugaccaagaaaaaugacacauauccaaccaucaagaugaguuacaacaauacuaaccgugaggaucuuuugauucugugggguauccaccacuccaacaaugccgcugagcagacaaaccuauauaaaaaucccaccacguacgugucugucgggacugcaacccucaaccaaagacuggugccuaagauagccacaaggagccaggugaauggacagcggggccgcauggacuucuuuuggacuauucuuaagccaaacgaugcuauccauuucgaauccaauggcaacuuuauugccccggaguacgcguauaaaaucgucaagaaaggggacucaaccaucaugaagagugaaauggaguacggacacugcaauacaaaaugucagacccccauuggugcaauaaacagcucuaugccuuuccauaauauccacccacugacgauuggcgaaugccccaaguauguuaaauccaacaaguuggugcucgccacugggcugagaaauucaccuuuaagggagcggcgccgaaagagaggacuguuuggcgcuaucgccgguuucauagaagggggauggcaaggcaugguagauggcugguacggguaucaccauagcaacgaacagggaagugguuacgcagcugacagggagucuacacagaaagccauugacggcgugaccaauaaggucaacuccaucaucgauaaaaugaacacucaguuugaagcgguggggcgggaguucaauaaccucgaacgucgcauugagaaucuuaacaagaaaauggaggacggauuucuggauguuuggacauauaaugccgaauugcuagugcugauggagaacgaaagaacccucgacuuccacgauagcaaugucaagaaccuguacgacaaggugaggcuucaacugcgggauaaugcaaaagaguugggcaacgguuguuucgaauuuuaccauaagugcgacaaugaguguauggagucgguacgaaacgggacguaugauuacccacaguauucugaagaggcucgccucaaaagagaagagaucuccggcguuaagcuggagucaauuggaaccuaccagauauuaaguaucuauagcacaguggccuccucucuggcucuagccauuaucgucgcaggccucagccuguggaugugcucaaaugggagucuucaaugcaggaucuguauuuga

SEQ ID NO: 134975 - RNA, 1704 nt, Artificial Sequence
  derived and/or modified sequence opt3 from hemagglutinin__InfluenzaA__AJY79339
auggagaagaucgugcugcuccuugccauugucagcauaguuaaauccgaccagaucugcauuggcuaccacgcuaacaauucuaccgaacaaguggauacaaucauggagaagaacguaacugugacgcaugcacaggacauucuggaaaagacccacaaugggaaauuguguaacuuagauggagucaaaccccugauccuaagagacugcucaguggccgguuggcuccugggcaauccuaugugugaugaguuccuuaacguuccagaauggaguuauauaguggagaagaucaauccggcgaacgaccugugcuaccccgggaauuugaacgauuaugaggaacucaagcaucugcugagcaggauuaaucacuuugagaaaauccagauuaucccuaaggacuccuggucugaucaugaggcuucgggagucucaagcgccuguccauaccagggccggaguuccuucuuucgcaacgugguauggcucacuaaaaagaaugacgcauaucccacaauuaaaaagucuuacaacaauaccaaccaagaagauuuacugguucuuugggguauacaccacccuaacgacgccgcugagcagacacgauuguaucagaauccaaccacuuacaucagcguggggacauccacccugaaccagcgucuaguccccaagauugcaacgagaucaaaagugaauggacaaaguggcaggauggaguucuuuuggacuauccucaagagcaacgaugccaucaauuucgaaucuaacggcaauuuuauugcuccugaaaacgccuacaaaauagugaagaaaggggacuccaccaucaugaagucagagcuggaauauagcaauugcaacacaaaaugucagacuccaauuggagcgaucaauaguucuaugccguuccauaacauacacccccuuaccauuggugagugcccuaaguacgucaaguccaaucggcugguuuuggcaacaggccuccgcaacagcccacagggggagaaaagaaggaagaaacggggacuguuuggcgccaucgcugguuucaucgaagggggauggcagggcaugguggacggcugguauggguaccaucacucgaaugagcaaggaucugguuaugccgcagauaaggaauccacccagcgcgcuauugacggcguaacgaacaaagugaacucaaucauugauaagaugaauacucaguuugaggccgucgggcgagaguucaacaauuuagaaagaaggauagagaaccugaauaagaaaauggaagacggauuucucgauguguggacauacaacgcggagcuucugguuuugauggaaaaugagcggacccuagacuuccacgauaguaacgugaagaaucuguaugacaaaguccgucuccaacugcgcgauaacgccaaggaacuuggcaaugguuguuucgaguuuuaccauagaugcgacaacgaguguauggaaagcgugaggaaugggacuuacgauuauccccaguacuccgaggaagcacggcugaaacgagaggagaucucuggcguaaaguuggaaagcauuggaacauaucagauccucucaaucuacaguaccguugcuuccagccuggccuuagcuauuaugguggccggccugucucuauggaugugcucaaacgggagucuccagugccgcauauguaucuga

SEQ ID NO: 134976 - RNA, 1704 nt, Artificial Sequence
  derived and/or modified sequence opt3 from hemagglutinin__InfluenzaA__AJY79341
auggagaagaucgugcugcuccuugccauugucagcauaguuaaauccgaccagaucugcauuggcuaccacgcuaacaauucuaccgaacaaguggauacaaucauggagaagaacguaacugugacgcaugcacaggacauucuggaaaagacccacaaugggaaauuguguaacuuagauggagucaaaccccugauccuaagagacugcucaguggccgguuggcuccugggcaauccuaugugugaugaguuccuuaacguuccagaauggaguuauauaguggagaagaucaauccggcgaacgaccugugcuaccccgggaauuuuaacgauuaugaggaauugaagcaucuccugagcaggauuaaucacuucgagaaaauccagauuaucccuaaggacuccuggucugaucaugaaacaucgggagucucaagcgcuuguccauaccagggccggaguuccuuuuuccgcaacgugguauggcugacuaaaaagaaugacgccuaucccaccauuaaaaagucuuacaacaauacaaaccaagaggaucucuuaguucugugggguauacaccacccuaacgacgcagccgagcagacccgacuuuaucagaauccaacuacauacaucagcguggggaccuccacguugaaccagcgucugguccccaagauugcuacuagaucaaaagugaauggacaaaacggcaggauggaauuuuucuggaccauccuaaagaguaaugaugcaaucaacuuugagagcaauggcaacuucauugccccugaaaaugcuuacaaaauagugaagaaaggggacucuacaaucaugcgguccgagcucgaauauucaaacugcaauacuaagugucagaccccaauuggagccaucaacagcaguaugccguuucauaauauacacccccugacaauuggugagugcccuaaauacgucaagucuaaccgccuuguucuggcgaccggcuugagaaauuccccacagggggagaagaggcggaaaaagcgcggacucuucggcgcaaucgccgguuuuaucgaagggggauggcagggcaugguggacggcugguauggguaccaucacagcaacgagcaaggaucggguuaugcugccgauaaagaaucuacgcagcgagcaauugacggcguaacuaacaaggucaauuccaucauugauaaaaugaacacacaguucgaggcuguggggagagaauuuaauaaccuggagaggcggauagagaauuuaaacaagaagauggaagacggauuccuggauguguggaccuacaaugccgagcuccuuguucugauggaaaacgagcguacuuuggacuuccacgauucaaaugugaaaaaccuauaugacaagguccgccugcaacucagagauaaugcgaaagaacugggcaacgguuguuuugaguucuaccauaggugcgacaaugaguguauggaaagugugcggaacgggacauacgauuauccccaguacagcgaggaagcccgacuuaagcgcgaggagaucuccggcguaaaacuggaaucuauuggaaccuaucagaucuugagcaucuacucaacgguugcaaguucccucgcucuggccauuaugguggcuggcuuaagccuguggaugugcucuaaugggucacuacagugcagaauauguaucuga

SEQ ID NO: 134977 - RNA, 1704 nt, Artificial Sequence
  derived and/or modified sequence opt3 from hemagglutinin__InfluenzaA__AJY79342
auggagaagaucgugcugcuccuugccauugucagcauaguuaaauccgaccagaucugcauuggcuaccacgcuaacaauucuaccgaacaaguggauacaaucauggagaagaacguaacugugacgcaugcacaggacauucuggaaaagacccacaaugggaaauuguguaacuuagauggagucaaaccccugauccuaagagacugcucaguggccgguuggcuccugggcaauccuaugugugaugaguuccuuaacguuccagaauggaguuauauaguggagaagaucaauccggcgaacgaccugugcuaccccgggaauuuuaacgauuaugaggaauugaagcaucuccugagcaggauuaaucacuucgagaaaauccagauuaucccuaaggacuccuggucugaucaugaggcuucgggagucucaagcgccuguccauaccagggccggaguuccuuuuuccgcaacgugguauggcugacuaaaaagaaugacgcauaucccacaauuaaaaagucuuacaacaauaccaaccaagaagaucucuuaguucugugggguauacaccacccuaacgacgccgcugagcagacacgacuuuaucagaauccaaccacuuacaucagcguggggacauccaccuugaaccagcgucugguccccaagauugcaacgagaucaaaagugaauggacaaaguggcaggauggaauuuuucuggacuauccuaaagagcaacgaugccaucaauuuugagucuaacggcaauuucauugcuccugaaaacgccuacaaaauagugaagaaaggggacuccaccaucaugaagucagagcucgaauauagcaauugcaacacaaaaugucagacuccaauuggagcgaucaauaguucuaugccguuucauaacauacacccccugaccauuggugagugcccuaaguacgucaaguccaaucggcuuguucuggcaacaggcuugcgcaacagcccacagggggagaaaagaaggaagaaacggggacucuucggcgccaucgcugguuuuaucgaagggggauggcagggcaugguggacggcugguauggguaccaucacucgaaugagcaaggaucugguuaugccgcagauaaggaauccacccagcgcgcuauugacggcguaacgaacaaagugaacucaaucauugauaagaugaauacucaguucgaggccgucgggcgagaauuuaacaaucuggagagaaggauagagaacuuaaauaagaaaauggaagacggauuccuggauguguggacauacaacgcggagcuccuuguucugauggaaaaugagcggaccuuggacuuccacgauaguaacgugaagaaucuauaugacaaaguccgucugcaacuccgcgauaacgccaaggaacugggcaaugguuguuuugaguucuaccauagaugcgacaacgaguguauggaaagcgugaggaaugggacuuacgauuauccccaguacuccgaggaagcacggcuuaaacgagaggagaucucuggcguaaagcuggaaagcauuggaacauaucagaucuugucaaucuacaguaccguugcuuccagccucgcccuggcuauuaugguggccggcuuaucucuguggaugugcucaaacgggagucuacagugccgcauauguaucuga

SEQ ID NO: 134978 - RNA, 1704 nt, Artificial Sequence
  derived and/or modified sequence opt3 from hemagglutinin__InfluenzaA__AJY79343
auggagaagaucgugcugcuccuugccauugucagcauaguuaaauccgaccagaucugcauuggcuaccacgcuaacaauucuaccgaacaaguggauacaaucauggagaagaacguaacugugacgcaugcacaggacauucuggaaaagacccacaaugggaaauuguguaacuuagauggagucaaaccccugauccuaagagacugcucaguggccgguuggcuccugggcaauccuaugugugaugaguuccuuaacguuccagaauggaguuauauaguggagaagaucaauccggcgaacgaccugugcuaccccgggaauuuuaacgauuaugaggaauugaagcaucuccugagcaggauuaaucacuucgagaaaauccagauuaucccuaaggacuccuggucugaucaugaggcuucgggagucucaagcgccuguccauaccagggccggaguuccuuuuuccgcaacgugguauggcugacuaaaaagaaugacgcauaucccacaauuaaaaagucuuacaacaauaccaaccaagaagaucucuuaguucugugggguauacaccacccuaacgacgccgcugagcagacacgacuuuaucagaauccaaccacuuacaucagcguggggacauccaccuugaaccagcgucugguccccaagauugcaacgagaucaaaagugaauggacaaaguggcaggauggaauuuuucuggacuauccuaaagagcaacgaugccaucaauuuugagucuaacggcaauuucauugcuccugaaaacgccuacaaaauagugaagaaaggggacuccaccaucaugaagucagagcucgaauauagcaauugcaacacaaaaugucagacuccaauuggagcgaucaauaguucuaugccguuucauaacauacacccccugaccauuggugagugcccuaaguacgucaaguccaaucggcuuguucuggcaacaggcuugcgcaacagcccacagggggagaaaagaaggaagaaacggggacucuucggcgccaucgcugguuuuaucgaagggggauggcagggcaugguggacggcugguauggguaccaucacucgaaugagcaaggaucugguuaugccgcagauaaggaauccacccagcgcgcuauugacggcguaacgaacaaagugaacucaaucauugauaagaugaauacucaguucgaggccgucgggcgagaauuuaacaaucuggagagaaggauagagaacuuaaauaagaaaauggaagacggauuccuggauguguggacauacaacgcggagcuccuuguucugauggaaaaugagcggaccuuggacuuccacgauaguaacgugaagaaucuauaugacaaaguccgucugcaacuccgcgauaacgccaaggaacugggcaaugguuguuuugaguucuaccauagaugcgacgaugaguguauggaaagcgugaggaacgggacuuacgacuauccccaguacuccgaggaagcacggcuuaaacgagaggagaucucuggcguaaagcuggaaagcauuggaacauaucagaucuugucaaucuacaguaccguugcuuccagccucgcccuggcuauuaugguggccggcuuaucucuguggaugugcucaaaugggagucuacagugccgcauauguaucuga

SEQ ID NO: 134979 - RNA, 1704 nt, Artificial Sequence
  derived and/or modified sequence opt3 from hemagglutinin__InfluenzaA__AJY79345
auggagaagaucgugcugcuccuugccauugucagcauaguuaaauccgaccagaucugcauuggcuaccacgcuaacaauucuaccgaacaaguggauacaaucauggagaagaacguaacugugacgagagcacaggacauucuggaaaagacccauaaugggaaauuguguaacuuagauggagucaaaccccugauccuaagggacugcucaguggccgguuggcuccugggcaauccuaugugugaugaguuccuuaacguuccagaauggaguuauauaguggagaagaucaauccggcgaacgaccugugcuaccccgggaauuuuaacgauuaugaggaauugaagcaccuccugagccggauuaaucauuucgagaaaauccagauuaucccuaaggacuccuggucugaucacgaggcuucgggagucucaagcgccuguccauaccagggccgcaguuccuuuuuccgaaacgugguauggcugacuaaaaagaaugacgcauaucccacaauuaaaaagucuuacaacaauaccaaccaagaagaucucuuaguucugugggguauacaucacccuaacgacgccgcugagcagacacgucuuuaucagaauccaaccacuuacaucagcguggggacauccaccuugaaccagagacugguccccaagauugcaacgaggucaaaagugaauggacaaaguggccggauggaauuuuucuggacuauccuaaagagcaacgaugccaucaauuuugagucuaacggcaauuucauugcuccugaaaacgccuacaaaauagugaagaaaggggacuccaccaucaugaagucagagcucgaauauagcaauugcaacacaaaaugucagacuccaauuggagcgaucaauaguucuaugccguuucacaacauacauccccugaccauuggugagugcccuaaguacgucaaguccaaucgccuuguucuggcaacaggcuugagaaacagcccacagggggagaaaaggcggaagaaacgcggacucuucggcgccaucgcugguuuuaucgaagggggauggcagggcaugguggacggcugguauggguaccaccauucgaaugagcaaggaucugguuaugccgcagauaaggaauccacccagcgagcuauugacggcguaacgaacaaagugaacucaaucauugauaagaugaauacucaguucgaggccgucgggagagaauuuaacaaucuggagaggcggauagagaacuuaaauaagaaaauggaagacggauuccuggauguguggacauacaacgcggagcuccuuguucugauggaaaaugagcguaccuuggacuuccacgauaguaacgugaagaaucuauaugacaaaguccgccugcaacucagagauaacgccaaggaacugggcaaugguuguuuugaguucuaccacaggugcgacaacgaguguauggaaagcgugcggaaugggacuuacgauuauccccaguacuccgaggaagcacgacuuaaacgcgaggagaucucuggcguaaagcuggaaagcauuggaacauaucagaucuugucaaucuacaguaccguugcuuccagccucgcccuggcuauuaugguggccggcuuaucucuguggaugugcucaaacgggagucuacagugcagaauauguaucuga

SEQ ID NO: 134980 - RNA, 1701 nt, Artificial Sequence; identical to SEQ ID NO: 134457
  derived and/or modified sequence opt3 from hemagglutinin__InfluenzaA__AKA54643

SEQ ID NO: 134981 - RNA, 1701 nt, Artificial Sequence
  derived and/or modified sequence opt3 from hemagglutinin__InfluenzaA__AKA54650
augaagaccaucauugcccugagcuacauacucugccuuguguucacacagaaaauccccggcaacgacaauuccacugcuacgcuguguuuggggcaccaugcagucccuaacggaaccauuguuaagacaaucacuaaugauagaauugaggugaccaacgccacagaauuaguacaaaauucuucaaucggugagauaugcgacaguccacaccagauccuggauggcgaaaacuguacccuaauugacgcgcuccugggggauccgcagugcgacggauuucagaauaaaaagugggaucuuuucguggagaggagcaaggcuuauuccaacuguuaccccuaugacgucccugauuacgccucucugcggucguugguggcaucaagcggcacucucgaauuuaauaacgagaguuucaauuggacagguguuacccaaaacgggacguccucugccugcauccgccgaagcuccucaaguuucuucagccgucugaauuggcugacucaucucaacuauaaauacccagcuuuaaaugugaccaugcccaacaacgagcaguuugacaagcuguauauuuggggaguccaccauccuggcacagauaaagaccagaucuuccuuuacgcacagucuuccggcagaauaacugugucaaccaagaggagccaacaggccguaauuccaaauaucgggagucggccccgcauuagagauaucccuucuaggaucuccauuuacuggacaauaguuaaaccaggagacaucuugcugauuaacagcaccgguaaucuaaucgcuccgcggggcuauuuuaagauacgcucggggaaaucuuccauuaugcgaucagacgcccccaucggaaaguguaagagugaaugcaucacgccuaacggcagcauuccaaaugauaaacccuuccagaacgugaauagaaucacuuacggugcguguccuagguaugucaagcacuccacacucaaacuggcaaccgggaugcggaacgugccagagaagcagacucguggaauuuuuggcgccauagcuggcuucaucgaaaaugggugggagggaaugguggacgguugguacggcuuucgccaccaaaacucugaggggagaggacaggccgcagaucuuaaaagcacacaggcugccauugaccaaaucaauggcaagcugaacagguugaucgguaaaaccaaugaaaaguuccaucagauugagaaggaauuuucagaggucgaagggcggauacaggaucucgagaaauauguugaggacacgaagaucgaucuguggaguuacaacgcggaauuacugguggcccucgagaaucagcacaccauugaccuuacagauuccgaaaugaacaaacuguuugagaagacuaaaaagcaauugcgagaaaacgcagaggacaugggcaauggaugcuucaagaucuaucauaaaugugauaacgcuugcauuggcagcauccgcaaugggaccuacgaccacaacguauacagagacgaggcccuaaauaacagguuucagauaaagggaguggaacugaaaucugguuauaaggauuggauccucuggauuucauucgcuaucaguugcuuucugcuuugugucgcccuguugggcuucauuaugugggcaugccagaaagggaauauccgguguaacauaugcauuuga

SEQ ID NO: 134982 - RNA, 1701 nt, Artificial Sequence
  derived and/or modified sequence opt3 from hemagglutinin__InfluenzaA__AKA54651
augaagaccaucauugccuucagcugcauacugugucagaucuccgcucaaaaacuccccggcucugacaacucaauggcaacacuuugccuggggcaccaugccgugccuaauggaacuuuggucaagacgauuaccgaugaccagaucgagguuacaaacgcgacugaauuagugcagaguaccagcaaaggugagauuuguuccucuccacaccagauccuggauggcaagaauugcacacuaauagacgcucuccugggggauccgcauugugacgauuuucaaaacaaaaagugggaccuuuucguagaaagaucgaccgccuacucaaauugcuaucccuacuaugugccugauuacgcaagccugaggaguuuggucgccuccucuggaacucucgaguuuacacaggagagcuucaacuggaccggcguggcucaggacggugcauccuauucaugucggcgcgaaagugagaauagcuuuuucucucgacugaacuggcuguacucccucaauuauaaguacccagccuuaaacguuacgaugcccaauaacgauaaauuugacaagcuguacaucuggggagugcaccauccugggacugauaaagaccagaccucacuuuauauucaagcuagcggccgugucacagugaguacuaaguggucucagcagaccguaaucccaaauauuggcuccagacccuggaucaggggaguuagcucgauaauuucuaucuacuggacaauugugaaaccuggggacaucuugcugaucaacuccaccgguaaucuaauugccccacggggcuauuucaagauacagucagggaagaguagcaucaugcgcuccgaugcgcacauuggaaacugcaacucugaauguaucacgccgaauggcagcauacccaacgacaaaccuuuucaaaaugucaacagaauuacuuacggugcaugcccaagguaugugaagcagaauacacucaaacuggccaccgggaugcggaacgugcccgagaagcagacucgcggaaucuucggcgcuaucgccggcuuuauugaaaaugggugggagggaauggucgaugguugguacggcuuccgacaccaaaacucagaggggacaggacaggcagcugaccuuaaaaguacccaggccgcgaucaaucagauuacgggcaagcugaacagaguuaucaaaaagaccaaugaaaaguuucaucaaauagagaaagaguucuccgaaguggaagguaggauucaggauuuggagcgguauguagaggacacaaagaucgaucucuggagcuacaacgccgaacuguuaguggcacuggagaaucagcacacuaucgaccucaccgauucugaaaugaacaaacuuuucgagcguacacgcaagcagcugagagaaaaugcugaggacauggggaacggcuguuuuaaaauuuaccauaagugcgauaacgccugcauaggaucaaucaggaauggcacuuaugaccacgacgucuaccgggaugaggcugugaacaaucgauuccaaauuaaggggguucaguugaaacuaggauauaaggacuggauccuguggauuaguuuugccaucagcuguuuccuccugugcgcagugcuucuggguuuuauaaugugggccugucagaaaggcaacauccgcugcaauauuuguaucuga

SEQ ID NO: 134983 - RNA, 1701 nt, Artificial Sequence
  derived and/or modified sequence opt3 from hemagglutinin__InfluenzaA__AKA59351
augaaggccauccuggugauucuccuuuacaccuucgcugcagccaacgcggacacaauaugcaucggcuaucacgcuaauaacagcacugauacggucgacaccguucuggagaaaaaugugacaguaacucauuccguggauuuguuagaagacaagcacaacgggagacuguguaaacuaaggggagucgcaccccuccaucuggguaagugcaauauugccggcuggauccuugggaacccugagugugaaucucugucaaccgccaguagcugguccuacauuguggagacaucuucgucagauaauggaaccugcuauccaggcgacuuuaucgauuacgaagaguugcgggagcagcucagcaguguuuccucuuucgaacgcuuugagauauucccgaaaacuagcuccuggcccaaccacgaaucaaauaagggugugacagcugcauguccucaagccggggcuaagaguuuuuauaaaaaccugaucuggcuggucaagaaagagaauagcuacccaaagcucucuaaauccuauauuaacgacaagggaaaggagguguuaguacuguggggcauccaucaccccucaaccagcgccgaucagcagagucuuuaccagaaugcggacgcauacguuuucgugggcacgucucgauauuccaaaaaguuuaaaccugaaauugccauccguccaaaggucagagaucaagaggggaggaugaacuacuauuggacuuugguggaacccggagacaaaauaaccuucgaggcuacagguaaucugguggucccucgguacgccuuugcaauggaacgcaacgcuggcagcgggauuaucauuucggauacuccaguucacgacugcaacaccacaugucagaccccgaagggagccaucaauacgucucuacccuuccagaacauccauccuauuacuauaggcaaaugcccaaaguaugugaaguccacaaaacucagacuggcgaccggucuuaggaauguacccucaauccagagucgggggcuguuuggagccauugcaggcuucaucgagggcggguggacuggaaugguggacgguugguacggcuaucaccaucaaaacgagcaggggagcggauacgcugccgauuugaaguccacacagaaugcuauagacgaaauuaccaacaaagucaauucugugaucgagaagaugaacacgcaguuuaccgccguuggcaaagaguucaaucaccucgaaaagcgcaucgaaaaccugaauaagaaaguggaugacgguuucuuagauauuuggacauacaacgcagagcugcucguccuucuggagaaugaacgaacuuuggacuaucacgauagcaacgugaagaaucuauacgagaaaguaagaucacaacugaagaacaacgccaaagaaaucgggaauggcuguuuugaguucuaucauaagugcgacaacaccuguauggaaaguguuaagaauggaacauacgauuauccuaaauacuccgaggaggcuaagcucaacagggaagagauugacggcgugaaacuggaaagcacucggauauaucagauccuugcgauuuacucuaccgucgcaucaagucugguguuggucgugagccucggggccaucuccuuuuggaugugcucuaauggaucgcugcagugccguaucuguauuuga

SEQ ID NO: 134984 - RNA, 1701 nt, Artificial Sequence
  derived and/or modified sequence opt3 from hemagglutinin__InfluenzaA__AKA59353
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuuggugagugcaacauagccggcuggauccuggggaauccugaaugugagucuuugucaacagcaaguagcugguccuacauuguugaaaccccaucuucgaacaauggaacuugcuauccgggcgacuuuaucgauuacgaggagcucagggaacagcugucaagcgugaguuccuucgagcgguuugaaauuuuccccaacacaucuagcuggccuaaucacgacuccucaaaaggugucaccgccgcuuguccacaugcaggggccaagaguuuuuauaagaaccugaucuggcucgugaaaaagggaaauagcuaccccaaauuaucuaaguccuauauaaacgauaaaggcaaggagguacugguucuuuggggcauccaccacccuucaacgagcgcugaccaacagaaguuguaccagaaugaggaugccuacguguucgucgggacuagccgcuauucuaaaaaguuuaaaccagaaauugcgauccgacccaaggugcgugaccaggagggaagaaugaacuacuauuggacccugguggaaccuggugauaaaauuacauucgaggcaacuggcaacaucgucguuccaagguacgccuuugcuauggaacggaaugccggguccggaauaauuaucagcgacaccccggugcauaacugcaauacaaccugucaaacgcccaagggcgcaauuaacacuucgcuaccuuuccagaauguacacccaaucacaaucgguaaaugccccaaguaugugaagucuaccaaacuccgccuggcuacugggcuuagaaacgucccuuccauucagucaaggggacuguuuggcgccauagcgggcuucaucgaagggggauggacagguaugguggauggcugguacggguaucaucaccagaaugagcaaggaaguggcuuugccgcagacuugaagaguacccagaacgcuauugacgguaucacgaauaaaguuaacuccgugauagagaagaugaauacccaguucacagccgucgggaaagaguucaaccaccucgaaaagcggauugagaaucugaaccgcaagaucgaugacggcuuuuuagauaucuggacuuacaaugcugaacugcucauucuucuggagaacgagcgaaccuuggacuaccaugauucuaacgugagaaaucuauaugaaaaaguaaggagccagcugaagaacaaugccaaagagaucggaaacggcuguuucgaauuuuaccacaagugcgacaauacauguauggagucaguuaaaaacgggacuuaugauuacccaaaguauagugaagaggcaaagcucaaucgggaggaaauugacggagugaaacuggaguccacccguauauaccaaauccuugccauuuauagcacagucgcuucuucacugguguugaucgucagucucggugcgaucagcuucuggaugugcuccaacggcucucugcagugccgcauuuguauauga

SEQ ID NO: 134985 - RNA, 1701 nt, Artificial Sequence
  derived and/or modified sequence opt3 from hemagglutinin__InfluenzaA__AKA59355
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggcccgcaguuuuuauaaaaaucugaucuggcucgugaagaaaggaaacagcuacccaaaguuaaaucaaucuuauauaaacgacaaaggcaaggaaguacugguucuuuggggcauccaccaucccccuacguccgcugaucagcagucauuguaccagaaugccgacgcguacguguucgucgggacuagccgauauaguaagaaauuuaagccagagauugcaauccgucccaaagugagagaucaagagggaaggaugaacuacuauuggacccugguggaaccuggugacaagauuacauucgaggccacuggcaaccuagucguuccacgguacgcuuuugccauggaacgcaaugcagggucuggaaucauaauuuccgauaccccggugcacgacugcaacacaaccugucagacgcccaaaggcgcuaucaauacuagccucccuuuccagaacauucacccaaucacaaucgguaagugccccaaauauguaaagucgaccaagcugagacuugccacugggcugaggaaugugccuucuauucagucccggggauuguuuggcgcgauagccggcuucaucgaagggggauggacagguauggucgacggcugguacggguaucaucaccaaaacgaacagggaucaggcuacgcagcugaucucaaaaguacccagaaugccauugacgagaucacgaacaaggugaaucugguuauagagaaaaugaacacccaguuuacagcuguggguaaggaguucagccacuuagaaaaacgcauugaaaaucugaacaagaaggucgaugacggguuccucgauaucuggacuuacaaugccgagcuucugguguugcuagaaaacgagcgaacccuggacuaucaugauuccaauguuaaaaaccucuacgagaagaucagaucucaacugaaaaacaaugcaaaggaaauuggcaacggauguuuugaguucuaucacaaaugcgacaauacauguauggaaagcguaaagaacggcacuuacgauuauccaaaguacucagaggaagccaaacuuaauagggaggagaucgacggggugaagcuggaaaguacccgggucuaucagauuuuggcuauauacuccacaguggcgagcucucucguccuggugguuucauuaggagcaaucaguuuuuggaugugcagcaacgguucccugcagugccguauuuguaucuga

SEQ ID NO: 134986 - RNA, 1701 nt, Artificial Sequence
  derived and/or modified sequence opt3 from hemagglutinin__InfluenzaA__AKE37137
augaaggccagacuggugguccuccuuuacaccuucgcuacagcaaacgccgacacucugugcaucggcuaucacgcgaauaacagcacggauaccguugacacaguguuggagaaaaauguaacugugacccauuccgucaacuuacuggaagauaagcacaaugggaaacuauguaagcucaggggaguggcuccccugcaucuugguaaaugcaacauugccggcuggauacuggggaauccugagugugaaucuuugucaacagcaaguagcugguccuacaucguugagaccucuucgucagacaacggaacuugcuauccaggcgauuuuauugacuacgaggagcuccgggagcagcugagcaguguguccucuuucgaacgcuuugagaucuucccgaagacaagcuccuggcccaaucacgauccuaacaagggugucaccgccgcuuguccacaugcaggggccaaaucauuuuauaagaaucugauuuggcucgugaaaaagggaaacaguuaccccaaauuaagcacgucuuauaucaaugacaagggcaaggaaguacugguucuuuggggcauacaccacccuuccacuucagcugaucaacagagcuuguaccagaacgccgacgcguacgcauucguggggaccagucgauauucuaaaaaguuuaaaccagagaucgccauucgucccaaggucagagauagggagggacggaugaauuacuauuggacacugguggaaccuggugacaaaaucacuuucgaggcuaccggcaaccuaguggucccacgcuacgccuuugcaauggaaagaaacgcuggguccggaauuaucauaagcgauacaucgguucaugacugcaauaccacgugucagacuccgaagggcgccauuaacacaucucuccccuuccaaaaugugcacccuaucaccauugguaaaugcccaaaguauguaaaguccacuaaacugaggcuugcgacagggcugcggaacgugcccucaauccagagucgcggauuguuuggcgccaucgcaggcuucauugaagggggauggaccgguauggucgacggcugguacggguaucaucaccagaaugaacagggaagcggcuacgcugccgaucucaaguccacgcaaaacgcuuuugacgagauaaccaauaaagugaacucuguuaucgagaagaugaauacacaguucacugccguggguaaagaguucaaccaccuggaaaagcgaauugaaaauuuaaacaagaaagucgaugacggguuucuggauaucuggaccuacaaugcagagcuccuugugcuguuggaaaacgagagaacacuagacuaucaugauagcaauguaaagaaccuguacgagaaaguuaggucacagcucaagaacaaugccaaagaaauaggcaacggauguuucgaguuuuaucacaagugcgacaauacuuguauggaaagugugaagaacggcaccuacgauuauccuaaauacuccgaggaagcuaagcugaaucgggaggagauugacggggucaaacuugaaagcacacguaucuaucagauccuggcgauuuacucuaccguggcaucaaguuugguccucgugguuagccugggagccaucuccuucuggaugugcucuaacgguucguuacaaugccgcauuuguauauga

SEQ ID NO: 134987 - RNA, 1701 nt, Artificial Sequence
  derived and/or modified sequence opt3 from hemagglutinin__InfluenzaA__AKS48035
auggagaagauggugcugcuccuugccgucguuagccuggugaaauccgaccagaucugcauuggcuaccacgcuaacaauucuaccgaacaaguagauacaauaauggagaagaacgugacugucacgcaugcacaggacaucuuggagaaaacccacaaugggagauuaugugaucugaacggagugaagccccuaauucucaaagacugcucaguugccgguuggcugcuuggcaauccuaugugugaugaguucaucagggugccagaauggaguuauauugucgagcgggcgaacccggcuaaugaccugugcuaccccgggaacuugaaugauuaugaggaacucaagcaucugcugagccgcaucaaccacuuugagaagacacucauaaucccuaaauccucuuggccaaaucauacuucgucaggagugagcgccgcaugucccuaccagggcaugccuaguuucuuucgaaacguaguuugguuaaccaagaaaaaugacgccuauccaacaauuaagauguccuacaacaauaccuaucgugaagaucugcuuaucuugugggguauucaccacucuaacaacgcugcagagcagacuaaucuguacaaaaaccccacaaccuacgugagcgucgggacguccacucuaaaucaaagacucgagccuaagaucgccaccaggucacaggugaacggacagcggggccgcauggacuucuuuuggacaauacugaagccaaaugaugcuauucauuucgaaaguaacggcaauuuuaucgccccggaguaugcguacaaaauugugaagaaaggggacagcacuaucaugaagucugaaauggaguauggacacugcaacaccaaaugucagacacccaucggugcaauuaauuccucaaugccuuuccauaacauacacccacuuaccaucggcgaaugccccaaguacgucaaaagcaauaagcugguuuuggccacggggcucagaaacaguccucugagggagcggcgccgaaagagaggauuauuuggcgcuauugccgguuucaucgaagggggauggcaaggcaugguggauggcugguauggguaccaccauucuaaugaacagggauccgguuaugcagcugacagggagagcacucagaaagccauagacggcguaacaaacaaggucaauucgauuaucgauaaaaugaacacccaguuugaagcgguggggcgggaguucaacaaucuggaacgucgcaucgagaaccucaauaagaaaauggaggacggauuucuugauguguggacuuacaacgccgaacuguugguucuaauggagaaugaaagaacacuggacuuccacgauucuaacgugaagaaucucuacgacaaggucaggcugcaacuucgggauaacgcaaaagagcugggcaaugguuguuucgaauuuuaucauaagugcgacaacgaguguauggaguccgugcgaaaugggaccuacgauuauccacaguacucagaagaggcucgcuugaaaagagaagagauuaguggcguaaagcucgagagcaucggaacguaucagauucuguccauauacucuaccguugccagcucauuagcucuggccaucauuguggcaggccuaagucucuggaugugcuccaacgggagccugcaaugcaggaucuguaucuga

SEQ ID NO: 134988 - RNA, 1701 nt, Artificial Sequence
  derived and/or modified sequence opt3 from hemagglutinin__InfluenzaA__ALA08472
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguaugucuggggagugcaccauccuggcacagauaaggaccagauuuuccuuuacgcccagucuuccggcagaaucacuguaucaaccaaaaggagccaacaggcuguuauaccaaauauugggagucggccccgcaucagagauauuccuucuaggaucuccaucuacuggacaauugugaagccaggagacauauugcugaucaacagcaccgguaaucuaauugccccgcggggcuauuuuaaaauccgcucggggaagucuuccauaaugcgaucagacgcgcccauuggaaaauguaagagugaaugcaucacgccuaacggcagcaucccaaaugauaagcccuuccagaacgucaauagaauuacuuacggugcauguccuagguaugugaaacacuccacacucaagcuggccaccgggaugcggaacgugccagagaaacagacucguggaaucuuuggcgcuauugccggcuucauagaaaaugggugggagggaauggucgacgguugguacggcuuucgccaccaaaacucugaggggagaggacaggcagcugaucuuaagagcacacaggccgcgaucgaccaaauuaauggcaaacugaacagguugaucgguaagaccaaugaaaaauuccaucagaucgagaaggaauuuucagagguugaagggcggauucaggaucucgagaaguauguggaggacacgaaaauagaucuguggaguuacaacgccgaauuacugguagcacucgagaaucagcacaccaucgaccuuacagauuccgaaaugaacaagcuguuugagaaaacuaagaaacaauugcgagaaaacgcugaggacaugggcaauggaugcuucaagauuuaucauaagugugauaacgccugcaucggcagcauucgcaaugggaccuacgaccacaacguguacagagacgaggcucuaaauaacagguuucagaucaaaggagucgaacugaagucugguuauaaagauuggauacucuggaucucauucgccauuaguugcuuucugcuuuguguggcacuguugggcuucaucaugugggccugccagaaggggaauauucgguguaacaucugcauauga

SEQ ID NO: 134989 - RNA, 1701 nt, Artificial Sequence; identical to SEQ ID NO: 134457
  derived and/or modified sequence opt3 from hemagglutinin__InfluenzaA__ALA08475

SEQ ID NO: 134990 - RNA, 1701 nt, Artificial Sequence
  derived and/or modified sequence opt3 from hemagglutinin__InfluenzaA__ALA08478
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcaaaaacuguacacucaucgacgcucugcuuggggauccgcagugcgacggauuucagaauaagaggugggaucuguucguggaacggagcaaagccuauuccaacuguuaccccuaugacgucccugauuacgcaucuuugcgcucgcucguggccucaagcggcacccuggaguuuaaugacgaaaguuucaacugggcugguguuacucaaaaugggacauccucugcaugcauucgaggaagcaacuccucauuuuucagucgucugaauuggcucacccauagcaacuuuaaguauccagccuuaaaugugacgaugcccaacaacgagcaguucgauaagcuguacaucuggggcguccaccauccuggcacugacaaagaucagauuuuucuuuaugcucagucuuccgggagaaucaccgugucaacaaagaggagccaacaggccguaauaccaaauauuggaagucggccccgcaucagaaacauuccuucuaggaucuccaucuacuggacuauuguuaaaccaggugacauauugcugaucaauagcaccggcaaccuaauugcgccgcggggguacuucaagauccagucgggaaaaucuuccauaaugcgcucagacgcacccauuggcaaguguaagagugagugcaucacaccuaaugguagcaucccaaacgauaaacccuuucagaaugugaaccgaauuaccuauggggccuguccuagauacgucaagcaauccacgcucaaacuggcuacuggaaugaggaaugugccagaaaagcagacacggggcaucuucggcgccauugcaggguuuauagagaacggaugggaagguaugaaagacggcugguauggguuccgucaccaaaauucugagggacgcggccaggcugccgaucuuaagagcacccaggcggccaucgaccagauuaacgguaaacugaauagauugaucgggaagacuaacgagaaguuccaccagaucgaaaaagaguuuucagaaguggagggcaggauucaagaucucgaaaaguacgucgaggacacaaaaauagaucuguggaguuauaaugcagaguuacugguugcucucgaaaaccagcauaccaucgaccuuacggauuccgagaugaacaagcuguucgagaaaaccaagaagcaguugcgggaaaaugccgaagacaugggaaacggcugcuuuaaaauuuaccacaagugugauaaugcuugcaucgggagcauucgaaacggaacauaugaccaugacguguaccgcgaugaggcccuaaauaacagauuccagaucaaagguguagagcugaagucuggcuacaaagacuggauacucuggaucucauuugcaauuaguugcuuccugcuuuguguggcccuguugggguuuaucaugugggcuugccaaaagggaaauauuagguguaacaucugcauauga

SEQ ID NO: 134991 - RNA, 1701 nt, Artificial Sequence; identical to SEQ ID NO: 132010
  derived and/or modified sequence opt3 from hemagglutinin__InfluenzaA__ALA08479

SEQ ID NO: 134992 - RNA, 1701 nt, Artificial Sequence
  derived and/or modified sequence opt3 from hemagglutinin__InfluenzaA__ALA08481
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagcccauuccaacuguuaucccuacgacgucccugauuaugcaucuuugcggucgcucguggccucaagcggcacccuggaauuuaauaacgagaguuucaauugggcugguguuacucaaaacgggacauccucuagcugcauucgcggauccaauucaaguuucuucagccgacugaacuggcucacccacuuaaauucuaaguacccagcacugaacgugacgaugcccaacaaugagcaguuugacaaacuuuauaucuggggcguccaucacccuggcacugauaaggaccagauuuucuuguacgcccaguccucagggcguaucaccgugagcacaaagagaagucaacaggcuguaauaccaaacauuggaucuaggccccggauccgcgauauuccuuccagaaucagcaucuauuggacuauuguuaaaccaggugacauacugcuaaucaauucgaccggcaaccucauugccccgaggggguacuuuaagauccggucuggaaaauccucaauaaugcgcagugacgcgcccauuggcaaguguaagagcgaaugcaucacaccuaaugguuccaucccaaacgauaaacccuuccagaaugugaaccgaauuaccuacggggcauguccuagauaugucaagcagucuacgcugaaacuugccacuggaaugaggaaugugccagagcggcaaacacguggcaucuuuggcgcuauugccggguucauagaaaacggaugggaggguaugguggacggcugguacggguuucgccaccagaauagcgagggaagaggccaggcagcugaucugaagucaacccaagccgcgaucgaccagauuaacgguaaauugaauaggcucaucgggaagacuaacgaaaaauuccaucagaucgagaaggaauuuagugaggucgaaggccggauucaggaucuggagaaguauguugaggacacaaaaauagauuuaugguccuacaaugccgaacugcucguggcacuugagaaccaacacaccaucgaccugacggauagcgaaaugaacaaguuguuugagaaaaccaagaaacagcuacgagaaaaugcugaggacaugggaaacggcugcuucaagauuuaucauaagugugauaaugccugcaucgggucuauucgcaacggaacauacgaccacgacguauauagagaugaggcucugaauaacagguuucagaucaaagguguggaacucaagucaggcuacaaagacuggauacuguggaucaguuucgccauuagcugcuuucuucugugugucgcauugcucggguucaucaugugggccugccagaagggaaauauucgguguaacaucugcauauga

SEQ ID NO: 134993 - RNA, 1701 nt, Artificial Sequence; identical to SEQ ID NO: 134992
  derived and/or modified sequence opt3 from hemagglutinin__InfluenzaA__ALA08482

SEQ ID NO: 134994 - RNA, 1701 nt, Artificial Sequence
  derived and/or modified sequence opt3 from hemagglutinin__InfluenzaA__ALA08483
augaagaccaucauuggccugagcuacauacucugccuuguguucgcccagaaacugcccgggaacgacaauuccacagcuacuuuguguuuaggacaccaugcagucccuaacgguacgaucguuaagaccauuacaaaugauagaaucgaggugacuaacgccaccgaacugguacaaaauucuucaauuggcgagaucugcgacaguccacaccagauacuagauggggaaaacuguacacucaucgacgcgcugcuuggagauccgcagugcgacggcuuucagaauaaaaagugggaucuguucguggagaggagcaaggcuuauuccaacuguuaccccuaugacgucccugauuacgccucuuugcggucgcucguggcaucaagcgguacccuggaauuuaauaacgagaguuucaauugggccgggguuacucaaaacggaacauccucuagcugcauucgcggcuccaauucaaguuucuucagccgacugaacuggcucacccauuuaaauucuaaguauccagcucugaacgugacgaugcccaacaaugagcaguuugacaaacuuuacaucuggggcguccaccauccugggacugauaaagaccagauuuucuuguaugcacaguccucaggacguaucaccgugagcacaaagagaagucaacaggccguaauaccaaacauugguucuaggccccggauccgcgauauuccuuccagaaucagcaucuacuggacuauuguuaaaccaggcgacauacugcuaaucaauucgaccgggaaccucauugcuccgaggggauacuuuaagauccggucuggcaaauccucaauaaugcgcagugacgcccccauugguaaguguaagagcgaaugcaucacaccuaauggguccaucccaaacgauaaacccuuccagaaugugaaccgaauuaccuauggagcguguccuagauacgucaagcagucuacgcugaaacuugcaacuggcaugaggaaugugccagagcggcaaacacguggcaucuuuggggccauugcuggauucauagaaaacgguugggagggcaugguggacgggugguauggauuucgccaccagaauagcgagggcagaggucaggccgcagaucugaagucaacccaagcugccaucgaccagauuaacgggaaauugaauaggcucaucggcaagacuaacgaaaaauuccaccagaucgagaaggaauuuagugaggucgaaggacggauucaggaucuggagaaguacguugaggacacaaaaauagauuuaugguccuauaaugcggaacugcucguggcccuugagaaccaacauaccaucgaccugacggauagcgaaaugaacaaguuguuugagaaaaccaagaaacagcuacgagaaaaugcagaggacaugggcaacgggugcuucaagauuuaccacaagugugauaaugcuugcaucggaucuauucgcaacgguacauaugaccaugacguauacagagaugaggcccugaauaacagguuucagaucaaaggcguggaacucaagucaggguacaaagacuggauacuguggaucaguuucgcuauuagcugcuuucuucugugugucgccuugcucggauucaucaugugggcaugccagaagggcaauauucgguguaacaucugcauauga

SEQ ID NO: 134995 - RNA, 1701 nt, Artificial Sequence
  derived and/or modified sequence opt3 from hemagglutinin__InfluenzaA__ALA08484
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacuauuucaaccaaaaggagccaacaggcugugaucccaaauauugggagucggccccgcaucagagauaucccuucuaggauuuccauauacuggacaaucguaaagccaggagacauuuugcugaucaacagcaccgguaaucuaauagccccgcggggcuauuuuaaaauucgcucggggaagucuuccaucaugcgaucagacgcgcccaucggaaaauguaagagugaaugcauuacgccuaacggcagcaucccaaaugauaagcccuuccagaacguuaauagaauuacuuacggugcauguccuagguaugugaaacacuccacacucaagcuggccaccgggaugcggaacgucccagagaaacagacucguggaauauuuggcgcuaucgccggcuucauugaaaaugggugggagggaaugguggacgguugguacggcuuucgccaccaaaacucugaggggagaggacaggcagcugaucuuaagagcacacaggccgcgaucgaccaaaucaauggcaaacugaacagguugauugguaagaccaaugaaaaauuccaucagauagagaaggaauuuucagagguggaagggcggauccaggaucucgagaaguaugucgaggacacgaaaauugaucuguggaguuacaacgccgaauuacugguugcacucgagaaucagcacaccaucgaccuuacagauuccgaaaugaacaagcuguuugagaaaacuaagaaacaauugcgagaaaacgcugaggacaugggcaauggaugcuucaagauuuaucauaagugugauaacgccugcaucggcagcauacgcaaugggaccuacgaccacaacguguacagagacgaggcucuaaauaacagguuucagaucaaaggaguagaacugaagucugguuauaaagauuggauucucuggaucucauucgccauuaguugcuuucugcuuuguguggcacuguugggcuucaucaugugggccugccagaaggggaauauacgguguaacauuugcaucuga

SEQ ID NO: 134996 - RNA, 1701 nt, Artificial Sequence
  derived and/or modified sequence opt3 from hemagglutinin__InfluenzaA__ALA08488
augaagaccaucauugcccugagcuacauacucugccuuguguucgcucagaaaauccccggcaacgggaauaguacagcaacucuguguuugggacaccaugccgucccuaacgguacgauuguuaagaccaucacaaaugacagaauugaggugacuaacgcgaccgaauuaguacaaaauucuucaaucggcgagauaugcgauaguccacaccagauccuggacggggaaaacuguacacuaauugaugcucuccugggagacccgcagugcgauggcuuucagaauaaaaagugggaccuuuucguggagaggagcaaagccuauuccaacuguuaccccuaugaugucccugacuacgcaucucugcggucguugguggccucaagcgguacccucgaauuuaauaacgagaguuucaauuggacugggguuacacaaaacggaaccuccucugcuugcauccgccgaagcuccucauccuuuuucagccgucugaauuggcugacgcaucucaacuauacuuacccagcauuaaaugugaccaugcccaacaacgagcaguuugauaagcuguauauuuggggcguccaccauccuggcacagacaaggaucagaucuuccuuuacgcccagucuuccgggagaauaacugugucaaccaaaaggagccaacaggcuguaauuccaaauaucggaagucggccccgcauuagagacaucccuucuaggaucuccauuuacuggacaauaguuaagccaggugauaucuugcugauuaacagcaccggcaaucuaaucgccccgcggggguauuuuaaaauacgcucgggaaagucuuccauuaugcgaucagacgcgcccaucggcaaauguaagagugaaugcaucacgccuaacgguagcauuccaaaugacaagcccuuccagaacgugaauagaaucacuuacggggcauguccuagguaugucaaacacuccacacucaagcuggccaccggaaugcggaacgugccagagaaacagacucguggcauuuuuggcgcuauagccggguucaucgaaaauggaugggaggguaugguggauggcugguacggguuucgccaccaaaacucugagggaagaggccaggcagcugaccuuaagagcacacaggccgcgauugaucaaaucaaugguaaacugaacagguugaucgggaagaccaaugaaaaauuccaucagauugagaaggaguucucagaagucgaaggccggauacaggaccucgagaaguauguugaggauacgaaaaucgaccuguggaguuacaacgccgaauuacugguggcacucgagaaucagcacaccauugaucuuacagacuccgaaaugaacaagcuguuugagaaaacuaagaaacaauugcgagaaaacgcugaggauaugggaaauggcugcuucaagaucuaucauaagugugacaacgccugcauugggagcauccgcaauggaaccuacgaucacaacguauacagagacgaggcucuaaauaacagguuucagauaaaagguguggaacugaagucuggcuauaaagacuggauccucuggauuucauucgccaucaguugcuuucugcuuugugucgcacuguugggguucauuaugugggccugccagaagggaaauauccgguguaacauaugcauuuga

SEQ ID NO: 134997 - RNA, 1701 nt, Artificial Sequence
  derived and/or modified sequence opt3 from hemagglutinin__InfluenzaA__ALA08490
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacucaagcuggccaccgggaugcggaacgugccagagaaacagacucguggaauuuuuggcgcuauagccggcuucaucgaaaaugggugggagggaaugguggacgguugguacggcuuucgccaccaaaacucugaggggagaggacaggcagcugaucuuaagagcacacaggccgcgauugaccaaaucaauggcaaacugaacagguugaucgguaagaccaaugaaaaauuccaucagauugagaaggaauuuucagaggucgaagggcggauacaggaucucgagaaguauguugaggacacgaaaaucgaucuguggaguuacaacgccgaauuacugguggcacucgagaaucagcacaccauugaccuuacagauuccgaaaugaacaagcuguuugagaaaacuaagaaacaauugcgagaaaacgcugaggacaugggcaauggaugcuucaagaucuaucauaagugugauaacgccugcauuggcagcauccgcaaugggaccuacgaccacaacguauacagagacgaggcucuaaauaacagguuucagauaaaaggaaucgaacugaagucugguuauaaagauuggauucucuggaucucauucgccauuaguugcuuucugcuuuguguggcacuguugggcuucaucaugugggccugccagaaggggaauauacgguguaacauuugcaucuga

SEQ ID NO: 134998 - RNA, 1701 nt, Artificial Sequence
  derived and/or modified sequence opt3 from hemagglutinin__InfluenzaA__ALA08491
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacaugacgaugcccaacaaugagcaguucgacaaguuguacaucuggggcgugcaccauccuggcacugauaaagaccagauuuuucuuuaugcucagagcucugggcguaucaccgucuccacaaagagaucacaacaggccgugauaccaaacauuggaagcaggccccggauccgcaauauuccuaguagaaucucuaucuacuggacuauuguaaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacguuaaucgaauuaccuauggggccuguccuagauacgugaagcagagcacgcugaaacuugcuacuggaaugaggaacgucccagagaagcaaacacggggcaucuucggcgccauugcaggguuuauagaaaauggaugggaggguaugaaagauggcugguauggguuccgucaccagaacuccgagggacgcggccaggcugccgaccugaagucuacccaagcggccaucgaucagauuaaugguaaauugaacagacucaucgggaagacuaaugaaaaguuccaccagaucgagaaagaauuuagcgagguggaaggcaggauucaggaccuggagaaguacguggaggauacaaaaauagacuuauggucauauaacgcagaacugcucgucgcucuugagaaccaacauaccaucgaucugacggacagugaaaugaauaaguuguucgagaaaaccaagaagcagcuacgggaaaacgccgaggauaugggaaauggcugcuuuaaaauuuaccacaagugugacaacgcuugcaucggguccauucgaaauggaacauaugaucaugacguuuaccgcgacgaggcccugaacaauagauuccagaucaaagguguggaacucaagagcggcuacaaagauuggauacuguggaucucuuuugcaauuucaugcuuccuucuguguguagccuugcucggguuuaucaugugggcuugccagaagggaaacauuagguguaauaucugcauauga

SEQ ID NO: 134999 - RNA, 1701 nt, Artificial Sequence; identical to SEQ ID NO: 134997
  derived and/or modified sequence opt3 from hemagglutinin__InfluenzaA__ALA08492

SEQ ID NO: 135000 - RNA, 1701 nt, Artificial Sequence
  derived and/or modified sequence opt3 from hemagglutinin__InfluenzaA__ALA08493
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguagaagugaaugcaucacgccuaacggcagcauuccaaaugauaagcccuuccagaacgugaauaggaucacuuacggugcauguccucgguaugucaagcacuccacacucaaacuggccaccgggaugcguaacgugccagagaagcagacucgcggaauuuuuggcgcuauagccggcuucaucgaaaaugggugggagggaaugguggacgguugguacggcuuuagacaccaaaacucugaggggaggggacaggcagcugaucuuaaaagcacacaggccgcgauugaccaaaucaauggcaagcugaaccgguugaucgguaaaaccaaugaaaaguuccaucagauugagaaagaauuuucagaggucgaagggcgaauacaggaucucgagaaguauguugaggacacgaagaucgaucuguggaguuacaacgccgaauuacugguggcacucgagaaucagcacaccauugaccuuacagauuccgaaaugaacaaacuguuugagaagacuaaaaagcaauugcgcgaaaacgcugaggacaugggcaauggaugcuucaaaaucuaucauaagugugauaacgccugcauuggcagcaucagaaaugggaccuacgaccacaacguauacagggacgaggcucuaaauaaccgguuucagauaaagggaaucgaacugaaaucugguuauaaggauuggauucucuggaucucauucgccauuaguugcuuucugcuuuguguggcacuguugggcuucaucaugugggccugccagaaagggaauauacgcuguaacauuugcaucuga

SEQ ID NO: 135001 - RNA, 1701 nt, Artificial Sequence
  derived and/or modified sequence opt3 from hemagglutinin__InfluenzaA__ALA08494
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaagggagccaacaggcuguaauuccaaauaucggaaguaggccccggauucgcgauaucccuucuagaaucuccauuuacuggacaauaguuaagccaggugacaucuugcugauuaacagcaccggcaaucuaaucgccccgaggggguauuuuaaaauacggucgggaaagucuuccauuaugcgcucagacgcgcccaucggcaaauguaagagugaaugcaucacgccuaacgguagcauuccaaaugauaagcccuuccagaacgugaaucgaaucacuuacggggcauguccuagauaugucaaacacuccacacucaagcuggccaccggaaugaggaacgugccagagaaacagacucggggcauuuuuggcgcuauagccggguucaucgaaaauggaugggaggguaugguggacggcugguacggguuucgucaccaaaacucugagggacgcggccaggcagcugaucuuaagagcacacaggccgcgauugaccaaaucaaugguaaacugaacagauugaucgggaagaccaaugaaaaauuccaucagauugagaaggaauuuucagaggucgaaggcaggauacaggaucucgagaaguauguugaggacacgaaaaucgaucuguggaguuacaacgccgaauuacugguggcacucgagaaucagcacaccauugaccuuacagauuccgaaaugaacaagcuguuugagaaaacuaagaaacaauugcgggaaaacgcugaggacaugggaaauggcugcuucaagaucuaucauaagugugauaacgccugcauugggagcauccgaaauggaaccuacgaccacaacguauaccgcgacgaggcucuaaauaacagauuucagauaaaagguguggaacugaagucuggcuauaaagauuggauccucuggauuucauucgccaucaguugcuuucugcuuugugucgcacuguugggguucauuaugugggccugccagaagggaaauaucagguguaacauaugcauuuga

SEQ ID NO: 135002 - RNA, 1701 nt, Artificial Sequence; identical to SEQ ID NO: 135001
  derived and/or modified sequence opt3 from hemagglutinin__InfluenzaA__ALA08495

SEQ ID NO: 135003 - RNA, 1701 nt, Artificial Sequence; identical to SEQ ID NO: 135001
  derived and/or modified sequence opt3 from hemagglutinin__InfluenzaA__ALA08496

SEQ ID NO: 135004 - RNA, 1701 nt, Artificial Sequence; identical to SEQ ID NO: 134457
  derived and/or modified sequence opt3 from hemagglutinin__InfluenzaA__ALA08497

SEQ ID NO: 135005 - RNA, 1701 nt, Artificial Sequence; identical to SEQ ID NO: 134457
  derived and/or modified sequence opt3 from hemagglutinin__InfluenzaA__ALA08498

SEQ ID NO: 135006 - RNA, 1701 nt, Artificial Sequence
  derived and/or modified sequence opt3 from hemagglutinin__InfluenzaA__ALA08499
augaagaccaucauugcccugagcuacauacucugccuuguguucgcucagaaacugcccgagaacgacaauuccacagcaacuuuguguuuaggccaccaugccgucccuaacgggacgaucguuaagaccauuacaucugauagaaucgaagugacuaaugcgaccgagcugguacaaaacucaaguauuggagaaaucugcgacagcccacaccagauacuagaugguaaaaauuguacacucaucgacgcucugcuuggcgauccgcagugcgacggguuucagaacaagaaaugggaucuguucguggagagguccaaggccuauucuaauuguuaccccuaugacgucccugauuacgcaucguugcggucacucguggccagcaguggaacccuggaauuuaacgacgaguccuucaauugggcuggcguuacucaaaacgguacaucuagcgcaugcauucgcggguccaauucaaguuucuuuagccgacugaacuggcucacccauucuaauuuuaaguauccagccuuaaacgugacgaugcccaauaacgagcaguucgauaaacuguacaucuggggaguccaccauccuggcacugacaaggaucagauuuuucuuuaugcucaguccucaggccguaucaccgugagcacaaaaagaagucaacaggccguaauaccaaacauugggucuaggccccggauccgcgacauuccuuccagaaucagcaucuacuggacuauuguuaagccaggagacauauugcugaucaauucgaccgguaaccuaauugcgccgaggggcuacuucaaaauccggucugggaaguccucaauaaugcgcagugaugcacccauuggaaaguguaaaagcgaaugcaucacaccuaauggcuccaucccaaacgacaagcccuuucagaaugugaaccgaauuaccuauggugccuguccuagauacgucaaacagucuacgcucaagcuggcuacugggaugaggaaugugccagagaaacaaacacggggaaucuucggcgccauugcaggcuuuauagaaaacgggugggagggaaugaaggaugguugguauggcuuccgucaccagaauagcgaggggcgcggacaggcugccgaccuuaaaucaacccaagcggccaucgaucagauuaacggcaagcugaauagauugaucgguaagacuaacgaaaaauuccaccagaucgagaaggaauuuagugagguggaagggaggauucaggaccucgagaaauacgucgaggauacaaagguugaccugugguccuauaaugcagaauuacugguggcucucgagaaccaacauaccauagaucuuacggacagcgaaaugaauaaacuguucgagaagaccaagaaacaguugcgggaaaacgccgaggauaugggcaacggaugcuuuaagaucuaccacaaaugugacaaugcuugcauuggcucuauccgaaacgggacauaugaccaugauguauaccgcgacgaggcccuaaauaacagauuccagauuaagggaguggaacugaaaucagguuacaaggauuggauccucuggauaaguuuugcaaucagcugcuuccugcuuugugucgcccuguugggcuuuauuaugugggcuugccagaaggggaauaucagguguaacauuugcaucuga

SEQ ID NO: 135007 - RNA, 1701 nt, Artificial Sequence; identical to SEQ ID NO: 134990
  derived and/or modified sequence opt3 from hemagglutinin__InfluenzaA__ALA08501

SEQ ID NO: 135008 - RNA, 1701 nt, Artificial Sequence
  derived and/or modified sequence opt3 from hemagglutinin__InfluenzaA__ALA08502
augaagaccaucauugcccugagcuacauacucugccuuguguucgcucagaaacugcccgagaacgacaauuccacagcaacuuuguguuuaggccaccaugccgucccuaacgggacgaucguuaagaccauuacaucugauagaaucgaagugacuaaugcgaccgagcugguacaaaacucaaguauuggagaaaucugcgacagcccacaccagauacuagaugguaaaaauuguacacucaucgacgcucugcuuggcgauccgcagugcgacggguuucagaacaagaaaugggaucuguucguggagagguccaaggccuauucuaauuguuaccccuaugacgucccugauuacgcaucguugcggucacucguggccagcaguggaacccuggaauuuaacgacgaguccuucaauugggcuggcguuacucaaaacgguacaucuagcgcaugcauucgcggguccaauucaaguuucuuuagccgacugaacuggcucacccauucuaauuuuaaguauccagccuuaaacgugacgaugcccaauaacgagcaguucgauaaacuguacaucuggggaguccaccauccuggcacugacaaggaucagauuuuucuuuaugcucaguccucaggccguaucaccgugagcacaaaaagaagucaacaggccguaauaccaaacauugggucuaggccccggauccgcaauauuccuuccagaaucagcaucuacuggacuauuguuaagccaggagacauauugcugaucaacucgaccgguaaucuaauugcgccgaggggcuacuucaaaauccggucugggaaguccucaauaaugcgcagugacgcacccauuggaaaguguaaaagcgaaugcaucacaccuaacggcuccaucccaaaugauaagcccuuucagaacgugaaucgaauuaccuauggugccuguccuagauacgucaaacagucuacgcucaagcuggcuacugggaugaggaacgugccagagaaacaaacacggggaaucuucggcgccauugcaggcuuuauagaaaaugggugggagggaaugaaggacgguugguauggcuuccgucaccagaacagcgaggggcgcggacaggcugccgaucuuaaaucaacccaagcggccaucgaccagauuaauggcaagcugaacagauugaucgguaagacuaaugaaaaauuccaccagaucgagaaggaauuuagugagguggaagggaggauucaggaucucgagaaauacgucgaggacacaaagguugaucugugguccuauaacgcagaauuacugguggcucucgagaaucaacauaccauagaccuuacggauagcgaaaugaacaaacuguucgagaagaccaagaaacaguugcgggaaaacgccgaggacaugggcaauggaugcuuuaagaucuaccacaaaugugauaacgcuugcauuggcucuauccgaaaugggacauaugaccaugacguauaccgcgaugaggcccuaaacaauagauuccagauuaagggaguggaacugaaaucagguuacaaggacuggauccucuggauaaguuuugcaaucagcugcuuccugcuuugugucgcccuguugggcuuuauuaugugggcuugccagaaggggaacaucagguguaauauuugcaucuga

SEQ ID NO: 135009 - RNA, 1701 nt, Artificial Sequence; identical to SEQ ID NO: 135008
  derived and/or modified sequence opt3 from hemagglutinin__InfluenzaA__ALA08503

SEQ ID NO: 135010 - RNA, 1701 nt, Artificial Sequence; identical to SEQ ID NO: 134457
  derived and/or modified sequence opt3 from hemagglutinin__InfluenzaA__ALA08504

SEQ ID NO: 135011 - RNA, 1701 nt, Artificial Sequence; identical to SEQ ID NO: 134457
  derived and/or modified sequence opt3 from hemagglutinin__InfluenzaA__ALA08505

SEQ ID NO: 135012 - RNA, 1701 nt, Artificial Sequence; identical to SEQ ID NO: 134457
  derived and/or modified sequence opt3 from hemagglutinin__InfluenzaA__ALA08506

SEQ ID NO: 135013 - RNA, 1701 nt, Artificial Sequence; identical to SEQ ID NO: 134457
  derived and/or modified sequence opt3 from hemagglutinin__InfluenzaA__ALA08507

SEQ ID NO: 135014 - RNA, 1701 nt, Artificial Sequence
  derived and/or modified sequence opt3 from hemagglutinin__InfluenzaA__ALA08508
augaagaccaucauugcccugagcuacauacucugccuuguguucgcucagaaacugcccgagaacgacaauuccacagcaacuuuguguuuaggccaccaugccgucccuaacgggacgaucguuaagaccauuacaucugauagaaucgaagugacuaaugcgaccgagcugguacaaaacucaaguauuggagaaaucugcgacagcccacaccagauacuagaugguaaaaauuguacacucaucgacgcucugcuuggcgauccgcagugcgacggguuucagaacaagaaaugggaucuguucguggagagguccaaggccuauucuaauuguuaccccuaugacgucccugauuacgcaucguugcggucacucguggccagcaguggaacccuggaauuuaacgacgaguccuucaauugggcuggcguuacucaaaacgguacaucuagcgcaugcauucgcggguccaauucaaguuucuuuagccgacugaacuggcucacccauucuaauuuuaaguauccagccuuaaacgugacgaugcccaauaacgagcaguucgauaaacuguacaucuggggaguccaccauccuggcacugacaaggaucagauuuuucuuuaugcucaguccucaggccguaucaccgugagcacaaaaagaagucaacaggccguaauaccaaacauugggucuaggccccggauccgcaauauuccuuccagaaucagcaucuacuggacuauuguuaagccaggagacauauugcugaucaacucgaccgguaaucuaauugcgccgaggggcuacuucaaaauccggucugggaaguccucaauaaugcgcagugacgcacccauuggaaaguguaaaagcgaaugcaucacaccuaacggcuccaucccaaaugauaagcccuuucagaacgugaaucgaauuaccuauggugccuguccuagauacgucaaacagucuacgcucaagcuggcuacugggaugaggaacgugccagagaaacaaacacggggaaucuucggcgccauugcaggcuuuauagaaaaugggugggagggaaugaaggacgguugguauggcuuccgucaccagaacagcgaggggcgcggacaggcugccgaucuuaaaucaacccaagcggccaucgaccagauuaauggcaagcugaacagauugaucgguaagacuaaugaaaaauuccaccagaucgagaaggaauuuagugagguggaagggaggauucaggaucucgagaaauacgucgaggacacaaagauagaucugugguccuauaacgcagaauuacugguugcucucgagaaucaacauaccaucgaccuuacggauagcgaaaugaacaaacuguucgagaagaccaagaaacaguugcgggaaaacgccgaggacaugggcaauggaugcuuuaagauuuaccacaaaugugauaacgcuugcaucggcucuauucgaaaugggacauaugaccaugacguguaccgcgaugaggcccuaaacaauagauuccagaucaagggaguagaacugaaaucagguuacaaggacuggauacucuggaucaguuuugcaauuagcugcuuccugcuuuguguggcccuguugggcuuuaucaugugggcuugccagaaggggaacauuagguguaauaucugcauauga

SEQ ID NO: 135015 - RNA, 1701 nt, Artificial Sequence; identical to SEQ ID NO: 134457
  derived and/or modified sequence opt3 from hemagglutinin__InfluenzaA__ALA08509

SEQ ID NO: 135016 - RNA, 1701 nt, Artificial Sequence; identical to SEQ ID NO: 134457
  derived and/or modified sequence opt3 from hemagglutinin__InfluenzaA__ALA08510

SEQ ID NO: 135017 - RNA, 1701 nt, Artificial Sequence
  derived and/or modified sequence opt3 from hemagglutinin__InfluenzaA__ALA08511
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucuagcugcauccgccgauccucaaguagcuuuuucucucgucugaauuggcugacgcaucucaacuauacuuacccagcuuuaaaugugaccaugcccaacaacgagcaguuugacaagcuguauauuuggggaguccaccauccuuccacagauaaggaccagaucuuccuuuacgcacagucaagcggcagaauaacugugaguaccaaaaggucucaacaggccguaauuccaaauaucggcucccggccccgcauuagagauaucccuagcaggaucucgauuuacuggacaauaguuaagccaggggacaucuugcugauuaacucuaccggaaaucuaaucgcuccgcgggguuauuuuaaaauacgcuccggcaagucaaguauuaugcgaagcgacgcccccaucgggaaauguaaguccgaaugcaucacgccuaacggaucuauuccaaaugauaagcccuuccagaacgugaauagaaucacuuacggcgcguguccuagguaugucaaacacagcacacucaagcuggcaaccgguaugcggaacgugccagagaaacagacucgugggauuuuuggagccauagcuggcuucaucgaaaauggcugggaggggaugguggacggaugguacgguuuucgccaccaaaacucagagggcagagggcaggccgcagaucuuaagaguacacaggcugccauugaccaaaucaauggaaaacugaacagguugaucggcaagaccaaugaaaaauuccaucagauugagaaggaguucuccgaagucgaaggucggauacaggaucucgagaaguauguugaggacacgaaaaucgaucuguggagcuacaacgcggaauuacugguggcccucgagaaucagcacaccauugaccuuacagauucugaaaugaacaagcuguuugagaaaacuaagaaacaauugcgagaaaacgcagaggacauggggaauggcugcuucaagaucuaucauaagugugauaacgcuugcauuggaucaauccgcaauggcaccuacgaccacaacguauacagagacgaggcccuaaauaacagguuucagauaaaagggguggaacugaagaguggauauaaagauuggauccucuggauuagcuucgcuaucuccugcuuucugcuuugugucgcccuguuggguuucauuaugugggcaugccagaagggcaauauccgguguaacauaugcauuuga

SEQ ID NO: 135018 - RNA, 1701 nt, Artificial Sequence; identical to SEQ ID NO: 134457
  derived and/or modified sequence opt3 from hemagglutinin__InfluenzaA__ALA08512

SEQ ID NO: 135019 - RNA, 1701 nt, Artificial Sequence; identical to SEQ ID NO: 134457
  derived and/or modified sequence opt3 from hemagglutinin__InfluenzaA__ALA08514

SEQ ID NO: 135020 - RNA, 1701 nt, Artificial Sequence; identical to SEQ ID NO: 134457
  derived and/or modified sequence opt3 from hemagglutinin__InfluenzaA__ALA08515

SEQ ID NO: 135021 - RNA, 1701 nt, Artificial Sequence; identical to SEQ ID NO: 134457
  derived and/or modified sequence opt3 from hemagglutinin__InfluenzaA__ALA08516

SEQ ID NO: 135022 - RNA, 1701 nt, Artificial Sequence; identical to SEQ ID NO: 135014
  derived and/or modified sequence opt3 from hemagglutinin__InfluenzaA__ALA08517

SEQ ID NO: 135023 - RNA, 1701 nt, Artificial Sequence; identical to SEQ ID NO: 134457
  derived and/or modified sequence opt3 from hemagglutinin__InfluenzaA__ALA08519

SEQ ID NO: 135024 - RNA, 1701 nt, Artificial Sequence
  derived and/or modified sequence opt3 from hemagglutinin__InfluenzaA__ALA08520
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagccaucuggcagaauaacuguguccaccaaaaggucacaacaggcuguaauucccaauaucgggagccggccucgcauuagagauaucccaaguaggaucucuauuuacuggacaauaguuaagccgggagacaucuugcugauuaacuccaccgguaaucuaaucgcgccccggggcuauuuuaaaauacgcaacggaaagagcucgauuaugcgaucugacgccccuaucgggaaauguaaguccgaaugcaucacgccaaauggcucaauucccaacgauaagccuuuccagaaugugaacagaaucacuuacggugcauguccaagguaugucaaacacaguacacucaagcuggccaccgggaugcggaaugugcccgagaaacagacucguggaauuuuuggcgcuauagccggcuucaucgaaaacgggugggagggaaugguggacgguugguacggcuuucgccaccaaaauagcgaggggagaggacaggcagcugaucuuaaguccacacaggccgcgauugaccaaaucaacggcaaacugaauagguugaucgguaagaccaacgaaaaauuccaucagauugagaaggaauuuucugaggucgaagggcggauacaggaucucgagaaguauguugaggacacgaaaaucgaucuguggagcuacaaugccgaauuacugguggcacucgagaaccagcacaccauugaccuuacagauucagaaaugaacaagcuguuugagaaaacuaagaaacaauugcgagaaaaugcugaggacaugggcaacggaugcuucaagaucuaucauaagugugauaaugccugcauuggcaguauccgcaacgggaccuacgaccacaauguauacagagacgaggcucuaaacaauagguuucagauaaaaggaguggaacugaaguccgguuauaaagauuggauccucuggauuagcuucgccaucucuugcuuucugcuuugugucgcacuguugggcuucauuaugugggccugccagaaggggaacauccgguguaauauaugcauuuga

SEQ ID NO: 135025 - RNA, 1701 nt, Artificial Sequence; identical to SEQ ID NO: 132154
  derived and/or modified sequence opt3 from hemagglutinin__InfluenzaA__ALA08522

SEQ ID NO: 135026 - RNA, 1701 nt, Artificial Sequence
  derived and/or modified sequence opt3 from hemagglutinin__InfluenzaA__ALA08523
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaucgguaaucuaauagccccgcggggcuauuuuaaaauucgcucggggaagucuuccaucaugcgaucagacgcgcccaucggaaaauguaagagugaaugcauuaccccuaacggcagcaucccaaaugauaagcccuuccagaacgugaauagaauuacguacggugcauguccuagguaugucaaacacuccacucucaagcuggccacagggaugcggaacgugccagagaaacagacccguggaauauuuggcgcuaucgccggcuucauugaaaaugggugggagggaaugguggacgguugguacggcuuucgccaccaaaacucugaggggagaggacaggcagcugaucuuaagagcacucaggccgcgaucgaccaaaucaauggcaaacugaacagguugauugguaagacaaaugaaaaauuccaucagauagagaaggaauuuucagaggucgaagggcggauccaggaucucgagaaguauguugaggacaccaaaauugaucuguggaguuacaacgccgaauuacugguggcacucgagaaucagcacacgaucgaccuuaccgauuccgaaaugaacaagcuguuugagaaaacaaagaaacaauugcgagaaaacgcugaggacaugggcaauggaugcuucaagauuuaucauaagugugauaacgccugcaucggcagcauacgcaaugggacuuacgaccacaacguauacagagacgaggcucuaaauaacagguuucagaucaaaggaguggaacugaagucugguuauaaagauuggauucucuggaucucauucgccauuaguugcuuucugcuuugugucgcacuguugggcuucaucaugugggccugccagaaggggaauauacgguguaacauuugcaucuga

SEQ ID NO: 135027 - RNA, 1701 nt, Artificial Sequence
  derived and/or modified sequence opt3 from hemagglutinin__InfluenzaA__ALA08524
augaagaccaucauugcccugagcuacauacucugcaugguguucgcucagaaaauccccggcaacgacaauuccacagcaacucuuugucuggggcaccaugccgucccuaacggaacgauuguuaagaccaucacaaaugauagaauugaggugacuaacgcgaccgaauugguacaaaauucuucaaucggugagauaugcgacaguccacaccagaucuuagauggcgaaaacuguacacugauugacgcucuacucggggauccgcagugcgacggauuucagaauaaaaagugggaucuguucguggagaggagcaaagccuauuccaacuguuaccccuaugacgucccugauuacgcaucucuucggucgcugguggccucaagcggcaccuuggaauuuaauaacgagaguuucaauuggacugguguuacacaaaacgggaccuccucugcuugcauccgccgaagcuccucaaguuucuucagccgucucaauuggcugacgcaucugaacuauacuuacccagcacucaaugugaccaugcccaacaacgagcaguuugacaaguuauauauuuggggaguccaccauccuggcacagauaaggaccagaucuuccuguacgcccagucuuccggcagaauaacugugucaaccaaaaggagccaacaggcuguaauuccaaauaucgggagucggcuucgcauuagagauauccccucuaggaucuccauuuacuggacaauaguuaagccuggagacaucuugcugauuaacagcaccgguaaucuaaucgccccacggggcuauuuuaaaauacgcucggggaagucuuccauuaugcgaucagacgcgccgaucggaaaauguaagagugaaugcaucacgcccaacggcagcauuccuaaugauaagccauuccagaacgugaauagaaucacuuacggugcaugucccagguaugucaaacacuccacacucaagcuggccaccgggaugcggaacgugccugagaaacagacucguggaauuuuuggcgcuauagccggcuucaucgaaaaugggugggagggaaugguggacgguugguacggcuuucgccaccaaaacucugaggggagaggacaggcagcugaucuuaagagcacacaggccgcgauugaccaaaucaauggcaaacugaacagguugaucgguaagaccaaugaaaaauuccaucagauugagaaggaauuuucagaggucgaagggcggauacaggaucucgagaaguauguugaggacacgaaaaucgaucuguggaguuacaacgccgaauuacugguggcacucgagaaucagcacaccauugaccuuacagauuccgaaaugaacaagcuguuugagaaaacuaagaaacaauugcgagaaaacgcugaggacaugggcaauggaugcuucaagaucuaucauaagugugauaacgccugcauuggcagcauccgcaaugggaccuacgaccacaacguauacagagacgaggcucuaaauaacagguuucagauaaaaggaguggaacugaagucugguuauaaagauuggauccucuggauuucauucgccaucaguugcuuucugcuuugugucgcacuguugggcuucauuaugugggccugccagaaggggaauauccgguguaacauaugcauuuga

SEQ ID NO: 135028 - RNA, 1701 nt, Artificial Sequence; identical to SEQ ID NO: 134457
  derived and/or modified sequence opt3 from hemagglutinin__InfluenzaA__ALA08525

SEQ ID NO: 135029 - RNA, 1701 nt, Artificial Sequence; identical to SEQ ID NO: 134457
  derived and/or modified sequence opt3 from hemagglutinin__InfluenzaA__ALA08526

SEQ ID NO: 135030 - RNA, 1701 nt, Artificial Sequence; identical to SEQ ID NO: 135014
  derived and/or modified sequence opt3 from hemagglutinin__InfluenzaA__ALA08527

SEQ ID NO: 135031 - RNA, 1701 nt, Artificial Sequence
  derived and/or modified sequence opt3 from hemagglutinin__InfluenzaA__ALA08528
augaagaccaucauugcccugagcuacauacucugccuuguguucgcucagaaacugcccgagaacgacaauuccacagcaacuuuguguuuaggccaccaugccgucccuaacgggacgaucguuaagaccauuacaucugauagaaucgaagugacuaaugcgaccgagcugguacaaaacucaaguauuggagaaaucugcgacagcccacaccagauacuagaugguaaaaauuguacacucaucgacgcucugcuuggcgauccgcagugcgacggguuucagaacaagaaaugggaucuguucguggagagguccaaggccuauucuaauuguuaccccuaugacgucccugauuacgcaucguugcggucacucguggccagcaguggaacccuggaauuuaacgacgaguccuucaauugggcuggcguuacucaaaacgguacaucuagcgcaugcauucgcggguccaauucaaguuucuucagccgacugaacuggcucacccauucuaauuuuaaguauccagccuuaaacgugacgaugcccaauaacgagcaguucgauaaacuguacaucuggggaguccaccauccuggcacugacaaggaucagauuuaucuuuacgcucaguccucaggccguaucaccgugagcacaaaaagaagucaacaggccguaauaccaaacauugggucuaggccccggauccgcaauauuccuuccagaaucagcaucuacuggacuauuguuaagccaggagacauauugcugaucaacucgaccgguaaucuaauugcgccgaggggcuauuuuaaaauccggucugggaaguccucaauaaugcgcagugacgcacccauuggaaaguguaaaagcgaaugcaucacaccuaacggcuccaucccaaaugauaagcccuuccagaacgugaaucgaauuaccuacggugccuguccuagauaugucaaacagucuacgcucaagcuggcuacugggaugaggaacgugccagagaaacaaacacggggaaucuuuggcgccauugcaggcuucauagaaaaugggugggagggaaugaaggacgguugguacggcuuucgucaccagaacagcgaggggcgcggacaggcugccgaucuuaaaucaacccaagcggccaucgaccagauuaauggcaagcugaacagauugaucgguaagacuaaugaaaaauuccaccagaucgagaaggaauuuagugagguggaagggaggauucaggaucucgagaaauaugucgaggacacaaagauagaucugugguccuacaacgcagaauuacugguugcucucgagaaucaacauaccaucgaccuuacggauagcgaaaugaacaaacuguuugagaagaccaagaaacagaugcgggaaaacgccgaggacaugggcaauggaugcuucaagauuuaucacaaaugugauaacgcuugcaucggcucuauucgaaaugggacauacgaccaugacguguaccgcgaugaggccuugaacaauagauuucagaucaagggaguagaacuaaaaucagguuauaaggacuggauacuguggaucaguuucgcaauuagcugcuuucuccuguguguggcccuucugggcuucaucaugugggcuugccagaaggggaacauuagguguaauaucugcauauga

SEQ ID NO: 135032 - RNA, 1701 nt, Artificial Sequence; identical to SEQ ID NO: 134457
  derived and/or modified sequence opt3 from hemagglutinin__InfluenzaA__ALA08529

SEQ ID NO: 135033 - RNA, 1701 nt, Artificial Sequence; identical to SEQ ID NO: 134457
  derived and/or modified sequence opt3 from hemagglutinin__InfluenzaA__ALA08530

SEQ ID NO: 135034 - RNA, 1701 nt, Artificial Sequence
  derived and/or modified sequence opt3 from hemagglutinin__InfluenzaA__ALA08531
augaagaccaucauugcccugagcuacauacucugccuuguguucgcucagaaacugcccgagaacgacaauuccacagcaacuuuguguuuaggccaccaugccgucccuaacgggacgaucguuaagaccauuacaucugauagaaucgaagugacuaaugcgaccgagcugguacaaaacucaaguauuggagaaaucugcgacagcccacaccagauacuagaugguaaaaauuguacacucaucgacgcucugcuuggcgauccgcagugcgacggguuucagaacaagaaaugggaucuguucguggagagguccaaggccuauucuaauuguuaccccuaugacgucccugauuacgcaucguugcggucacucguggccagcaguggaacccuggaauuuaacgacgaguccuucaauugggcuggcguuacucaaaacgguacaucuagcgcaugcauucgcggguccaauucaaguuucuuuagccgacugaacuggcucacccauucuaauuuuaaguauccagccuuaaacgugacgaugcccaauaacgagcaguucgauaaacuguacaucuggggaguccaccauccuggcacugacaaggaucagauuuuucuuuaugcucaguccucaggccguaucaccgugagcacaaaaagaagucaacaggccguaauaccaaacauugggucuaggccccggauccgcaauauuccuuccagaaucagcaucuacuggacuauuguuaagccaggagacauauugcugaucaacucgaccgguaaucuaauugcgccgaggggcuacuucaaaauccggucugggaaguccucaauaaugcgcagugacgcacccauuggaaaguguaaaagcgaaugcaucacaccuaacggcuccaucccaaaugauaagcccuuucagaacgugaaucgaauuaccuauggugccuguccuagauacgucaaacagucuacgcucaagcuggcuacugggaugaggaacgugccagagaaacaaacacggggaaucuucggcgccauugcaggcuuuauagaaaaugggugggagggaaugaaggacgguugguauggcuuccgucaccagaacagcgaggggcgcggacaggcugccgaucuuaaaucaacccaagcggccaucgaccagauuaauggcaagcugaacagauugaucgguaagacuaaugaaaaauuccaccagaucgagaaggaauuuagugagguggaagggaggauucaggaucucgagaaauacgucgaggacacaaagauagaucugugguccuauaacgcagaauuacugguugcucucgagaaucaacauaccaucgaccuuacggauagcgaaaugaacaaacuguucgagaagaccaagaaacaguugcgggaaaacgccgaggacaugggcaauggaugcuuuaagauuuaccacaaaugugauaacgcuugcaucggcucuauucgaaaugggacauauaaccaugacguguaccgcgacgaggcccuaaauaacagauuccagaucaagggaguagaacugaaaucagguuacaaggauuggauacucuggaucaguuuugcaauuagcugcuuccugcuuuguguggcccuguugggcuuuaucaugugggcuugccagaaggggaauauuagguguaacaucugcauauga

SEQ ID NO: 135035 - RNA, 1701 nt, Artificial Sequence; identical to SEQ ID NO: 134457
  derived and/or modified sequence opt3 from hemagglutinin__InfluenzaA__ALA08532

SEQ ID NO: 135036 - RNA, 1701 nt, Artificial Sequence; identical to SEQ ID NO: 134457
  derived and/or modified sequence opt3 from hemagglutinin__InfluenzaA__ALA08533

SEQ ID NO: 135037 - RNA, 1701 nt, Artificial Sequence; identical to SEQ ID NO: 134457
  derived and/or modified sequence opt3 from hemagglutinin__InfluenzaA__ALA08534

SEQ ID NO: 135038 - RNA, 1701 nt, Artificial Sequence; identical to SEQ ID NO: 134457
  derived and/or modified sequence opt3 from hemagglutinin__InfluenzaA__ALA08535

SEQ ID NO: 135039 - RNA, 1701 nt, Artificial Sequence; identical to SEQ ID NO: 135014
  derived and/or modified sequence opt3 from hemagglutinin__InfluenzaA__ALA08536

SEQ ID NO: 135040 - RNA, 1701 nt, Artificial Sequence; identical to SEQ ID NO: 135014
  derived and/or modified sequence opt3 from hemagglutinin__InfluenzaA__ALA08537

SEQ ID NO: 135041 - RNA, 1701 nt, Artificial Sequence; identical to SEQ ID NO: 135014
  derived and/or modified sequence opt3 from hemagglutinin__InfluenzaA__ALA08538

SEQ ID NO: 135042 - RNA, 1701 nt, Artificial Sequence; identical to SEQ ID NO: 134457
  derived and/or modified sequence opt3 from hemagglutinin__InfluenzaA__ALA08539

SEQ ID NO: 135043 - RNA, 1701 nt, Artificial Sequence; identical to SEQ ID NO: 135014
  derived and/or modified sequence opt3 from hemagglutinin__InfluenzaA__ALA08540

SEQ ID NO: 135044 - RNA, 1701 nt, Artificial Sequence; identical to SEQ ID NO: 135014
  derived and/or modified sequence opt3 from hemagglutinin__InfluenzaA__ALA08541

SEQ ID NO: 135045 - RNA, 1701 nt, Artificial Sequence; identical to SEQ ID NO: 135014
  derived and/or modified sequence opt3 from hemagglutinin__InfluenzaA__ALA08542

SEQ ID NO: 135046 - RNA, 1701 nt, Artificial Sequence
  derived and/or modified sequence opt3 from hemagglutinin__InfluenzaA__ALA08543
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcugccauuccaaauaucgggagucggccccgcauuagagauaucccuucuaggaucuccauuuacuggacaauaguaaagccaggagacaucuugcugauuaacagcaccgguaaucuaaucgcgccgcggggcuauuuuaaaauacgcucggggaagucuuccauuaugcgaucagacgcacccaucggaaaauguaagagugaaugcaucacgccuaacggcagcauuccaaaugauaagcccuuccagaacguuaauagaaucacuuacggugccuguccuagguaugugaaacacuccacacucaagcuggcuaccgggaugcggaacgucccagagaaacagacucguggaauuuuuggcgccauagcaggcuucaucgaaaaugggugggagggaaugguggacgguugguacggcuuucgccaccaaaacucugaggggagaggacaggcugccgaucuuaagagcacacaggcggccauugaccaaaucaauggcaaacugaacagguugaucgguaagaccaaugaaaaauuccaucagauugagaaggaauuuucagagguggaagggcggauacaggaucucgagaaguaugucgaggacacgaaaaucgaucuguggaguuacaacgcagaauuacugguugcucucgagaaucagcacaccauugaccuuacagauuccgaaaugaacaagcuguuugagaaaacuaagaaacaauugcgagaaaacgccgaggacaugggcaauggaugcuucaagaucuaucauaagugugauaacgcuugcauuggcagcauccgcaaugggaccuacgaccacaacguguacagagacgaggcccuaaauaacagguuucagauaaaaggaguagaacugaagucugguuauaaagauuggauccucuggauuucauucgcaaucaguugcuuucugcuuuguguggcccuguugggcuucauuaugugggcuugccagaaggggaauauccgguguaacauaugcauuuga

SEQ ID NO: 135047 - RNA, 1701 nt, Artificial Sequence; identical to SEQ ID NO: 134457
  derived and/or modified sequence opt3 from hemagglutinin__InfluenzaA__ALA08545

SEQ ID NO: 135048 - RNA, 1701 nt, Artificial Sequence; identical to SEQ ID NO: 134457
  derived and/or modified sequence opt3 from hemagglutinin__InfluenzaA__ALA08546

SEQ ID NO: 135049 - RNA, 1701 nt, Artificial Sequence
  derived and/or modified sequence opt3 from hemagglutinin__InfluenzaA__ALA08548
augaagaccaucauugcccugagcuacauacucugccuuguguucgcucagaaacugcccgagaacgacaauuccacagcaacuuuguguuuaggccaccaugccgucccuaacgggacgaucguuaagaccauuacaucugauagaaucgaagugacuaaugcgaccgagcugguacaaaacucaaguauuggagaaaucugcgacagcccacaccagauacuagaugguaaaaauuguacacucaucgacgcucugcuuggcgauccgcagugcgacggguuucagaacaagaaaugggaucuguucguggagagguccaaggccuauucuaauuguuaccccuaugacgucccugauuacgcaucguugcggucacucguggccagcaguggaacccuggaauuuaacgacgaguccuucaauugggcuggcguugcacaaaacgguacuucuagcgccugcauucgcggguccaauucaaguuucuuuagccgacugaacuggcucacacauucuaauuuuaaguauccagcuuuaaacgugaccaugcccaauaacgagcaguucgauaaacuguacaucuggggaguccaccauccuggcacggacaaggaucagauuuuucuuuaugcccaguccucaggccguaucacugugagcaccaaaagaagucaacaggcgguaauaccaaacauugggucuaggccccggauccgcaauauuccuuccagaaucagcaucuacuggacaauuguuaagccaggagacauauugcugaucaacucgacugguaaucuaauugcaccgaggggcuacuucaaaauccggucugggaaguccucaauaaugcgcagugacgcccccauuggaaaguguaaaagcgaaugcaucaccccuaacggcuccaucccaaaugauaagcccuuucagaacgugaaucgaauuacauauggugcuuguccuagauacgucaaacagucuacccucaagcuggccacggggaugaggaacgugccagagaaacaaacucggggaaucuucggcgcaauugcuggcuuuauagaaaaugggugggagggaaugaaggacgguugguauggcuuccgucaccagaacagcgaggggcgcggacaggccgcggaucuuaaaucaacacaagccgcaaucgaccagauuaauggcaagcugaacagauugaucgguaagaccaaugaaaaauuccaccagaucgagaaggaauuuagugagguggaagggaggauucaggaucucgagaaauacgucgaggacacuaagauagaucugugguccuauaacgcugaauuacugguugcccucgagaaucaacauacaaucgaccuuaccgauagcgaaaugaacaaacuguucgagaagacgaagaaacaguugcgggaaaacgcugaggacaugggcaauggaugcuuuaagauuuaccacaaaugugauaacgccugcaucggcucuauucgaaaugggaccuaugaccaugacguguaccgcgaugaggcacuaaacaauagauuccagaucaagggaguagaacugaaaucagguuacaaggacuggauacucuggaucaguuuugccauuagcugcuuccugcuuuguguggcucuguugggcuuuaucaugugggcgugccagaaggggaacauuagguguaauaucugcauauga

SEQ ID NO: 135050 - RNA, 1701 nt, Artificial Sequence
  derived and/or modified sequence opt3 from hemagglutinin__InfluenzaA__ALA08549
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaacaggugugaucugcgacaguccacaccagauacuggauggcgagaacuguacccuaaucgacgcucuccugggggauccgcagugcgacggauuucagaauaaaaagugggaucuuuucgucgaaaggagcaaagccuauuccaacuguuaccccuaugacgugccugauuacgcaucucugcggucguugguugccucaagcggcacucucgaguuuaauaacgaaaguuucaauuggacaggugugacccaaaacgggacguccucugcuugcauucgccgaagcuccucaaguuucuuuagccgucugaauuggcugacucaucucaacuauaccuacccagcauuaaaugucacaaugcccaacaacgagcaguuugacaagcuguauaucuggggagugcaccauccuggcacugauaaggaccagauuuuccuuuacgcccagucuuccggcagaaucaccguaucaacaaaagggagccaacaggcuguuauaccaaauauuggaaguaggccccggauccgcgauauuccuucuagaaucuccaucuacuggaccauugugaagccaggugacauauugcugaucaacagcacgggcaaucuaauugccccgaggggguauuuuaaaauccggucgggaaagucuuccauaaugcgcucagacgcgcccauuggcaaauguaagagugagugcaucacuccuaacgguagcaucccaaaugauaagcccuuccagaacgucaaucgaauuacauacggggcauguccuagauaugugaaacacuccacccucaagcuggccacuggaaugaggaacgugccagaaaaacagacacggggcaucuuuggcgcuauugccggguucauagagaauggaugggaagguauggucgacggcugguacggguuucgucaccaaaacucugagggacgcggccaggcagcugaucuuaagagcacccaggccgcgaucgaccaaauuaaugguaaacugaacagauugaucgggaagacgaaugagaaauuccaucagaucgaaaaggaguucucagaaguugagggcaggauucaggaucucgaaaaguauguggaggacaccaaaauagaucuguggaguuacaacgccgaguuacugguagcacucgaaaaucagcacacaaucgaccuuacugauuccgagaugaacaagcuguuugagaaaacccggaagcaauugcgagaaaacgcugaagacaugggaaauggcugcuucaaaauuuaucauaagugugauaacgccugcaucgggagcauucgcaauggaacauacgaccacaacguguacagagacgaggcucuaaauaacagguuucagaucaagggugucgagcugaaaucuggcuauaaggauuggauacucuggaucucauucgccauuaguugcuuucugcuuuguguggcacuguugggguucaucaugugggccugccagaaaggaaauauucgguguaacaucugcauauga

SEQ ID NO: 135051 - RNA, 1701 nt, Artificial Sequence; identical to SEQ ID NO: 135014
  derived and/or modified sequence opt3 from hemagglutinin__InfluenzaA__ALA08550

SEQ ID NO: 135052 - RNA, 1701 nt, Artificial Sequence
  derived and/or modified sequence opt3 from hemagglutinin__InfluenzaA__ALA08551
augaagaccaucauugcccugagcuacauacucugccuuguguucgcucagaaacuguuggagaacgacaauuccacagcaacuuuaugucugggccaccaugccguccccaacgggacgaucguuaagaccauuacaucugauagaaucgaagugacuaaugcgaccgagcuaguacaaaacucaaguauuggagaaaucugcgacagcccucaccagauacucgaugguaaaaauuguacacugaucgacgcccuucugggcgauccacagugcgacggguuucagaacaagaaaugggauuuguucguggagagguccaaggcuuauucuaauuguuacccguaugacguccccgauuacgcaucgcuccggucacugguggccagcaguggaacccuggaauuuaacgacgaguccuucaauugggcuggcguuacucaaaacgguacaucuagcgcaugcauucgcggguccaauucaaguuucuuuagccgacucaacugguuaacccauucuaauuuuaaguauccugcccugaacgugacgaugccaaauaacgagcaguucgauaaacuuuacaucuggggaguccaccaucccggcacugacaaggaucagauuuuucuuuaugcucaguccucaggccguaucaccgugagcacaaaaagaagucaacaggccguaauaccuaacauugggucuaggccacggauccgcaauauucccuccagaaucagcaucuacuggacuauuguuaagccuggagacauacugcuaaucaacucgaccgguaaucucauugcgccaaggggcuacuucaaaauccggucugggaaguccucaauaaugcgcagugacgcaccgauuggaaaguguaaaagcgaaugcaucacacccaacggcuccaucccuaaugauaagccauuucagaacgugaaucgaauuaccuauggugccugucccagauacgucaaacagucuacgcugaaguuggcuacugggaugaggaacgugccugagaaacaaacacggggaaucuucggcgccauugcaggcuuuauagaaaaugggugggagggaaugaaggacgguugguauggcuuccgucaccagaacagcgaggggcgcggacaggcugccgaucugaaaucaacccaagcggccaucgaccagauuaauggcaaguugaacagacucaucgguaagacuaaugaaaaauuccaccagaucgagaaggaauuuagugagguggaagggaggauucaggaucuggagaaauacgucgaggacacaaagauagauuuaugguccuauaacgcagaacugcucguugcucuugagaaucaacauaccaucgaccugacggauagcgaaaugaacaaauuguucgagaagaccaagaaacagcuacgggaaaacgccgaggacaugggcaauggaugcuuuaagauuuaccacaaaugugauaacgcuugcaucggcucuauucgaaaugggacauaugaccauaacguguaccgcgacgaggcccugaauaacagauuccagaucaagggaguagaacucaaaucagguuacaaggauuggauacuguggaucaguuuugcaauuagcugcuuccuucuguguguggccuugcucggcuuuaucaugugggcuugccagaaggggaauauuagguguaacaucugcauauga

SEQ ID NO: 135053 - RNA, 1701 nt, Artificial Sequence; identical to SEQ ID NO: 135014
  derived and/or modified sequence opt3 from hemagglutinin__InfluenzaA__ALA08552

SEQ ID NO: 135054 - RNA, 1701 nt, Artificial Sequence; identical to SEQ ID NO: 135014
  derived and/or modified sequence opt3 from hemagglutinin__InfluenzaA__ALA08553

SEQ ID NO: 135055 - RNA, 1701 nt, Artificial Sequence
  derived and/or modified sequence opt3 from hemagglutinin__InfluenzaA__ALA08554
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacucaagcuggccaccgggaugcggaacgugccagagaaacagacucguggaauuuuuggcgcuauagccggcuucaucgaaaaugggugggagggaaugguggacgguugguacggcuuucgccaccaaaacucugaggggagaggacaggcagcugaucuuaagagcacacaggccgcgauugaccaaaucaauggcaaacugaacagguugaucgguaagaccaaugaaaaauuccaucagauugagaaggaauuuucagaggucgaagggcggauacaggaucucgagaaguauguugaggacacgaaaaucgaucuguggaguuacaacgccgaauuacugguggcacucgagaaucagcacaccauugaccuuacagauuccgaaaugaacaagcuguuugagaaaacuaagaaacaauugcgagaaaacgcugaggacaugggcaauggaugcuucaagaucuaucauaagugugauaacgccugcauuggcagcauccgcaaugggaccuacgaccacaacguauacagagacgaggcucuaaauaacagguuucagauaaaaggaguggaacugaugucugguuauaaggauuggauccucuggauuucauucgccaucaguugcuuucugcuuugugucgcacuguugggcuucauuaugugggccugccagaaagggaauauccgguguaacauaugcauuuga

SEQ ID NO: 135056 - RNA, 1701 nt, Artificial Sequence
  derived and/or modified sequence opt3 from hemagglutinin__InfluenzaA__ALA08555
augaagaccaucauugcccugagcuacauacucugccuuguguucgcucagaaacugcccgagaacgacaauuccacagcaacuuuguguuuaggccaccaugccgucccuaacgggacgaucguuaagaccauuacaucugaucaaaucgaagugacuaaugcgaccgagcugguacagaacucaaguauuggagaaaucugcgacagcccacaccagauacuagaugguaaaaauuguacacucaucgacgcucugcuuggcgauccgcagugcgacggguuucaaaacaagaaaugggaucuguucguggagagauccaaggccuauucuaauuguuaccccuaugacgucccugauuacgcaucguugaggucacucguggccagcaguggaacccuggaauuuaacgacgaguccuucaauugggcuggcguuacucagaacgguacaucuagcgcaugcauucggggguccaauucaucauuuuucagccgccugaacuggcucacccauucuaauuuuaaguauccagccuuaaacgugacgaugcccaauaacgagcaguucgauaaacuguacaucuggggaguccaccauccuggcacugacaaggaucagauuuuucuuuaugcucaauccucaggccgaaucaccgugagcacaaaacguagucagcaggccguaauaccaucuauuggguccagacccaggauccggaacauuccuagccgcaucucgaucuacuggacuauuguuaagccaggagacauauugcugaucaauucuaccgguaaccuaauugcgccgagaggcuacuucaaaaucagguccgggaagucaaguauaaugcggagcgacgcacccauuggaaaguguaaauccgaaugcaucacaccuaauggcucuaucccaaacgauaagcccuuucagaaugugaaccgcauuaccuauggugccuguccucgauacgucaaacaaagcacgcucaagcuggcuacugggaugagaaaugugccagagaaacagacaaggggaaucuucggcgccauugcaggcuuuauagaaaacgggugggagggaaugaaggacgguugguauggcuuccggcaccagaauagugaggggcguggacaagcugccgaucuuaaaaguacccaggcggccaucgaccagauuaacggcaagcugaaucgcuugaucgguaagacuaacgaaaaauuccaccagaucgagaaggaauuuuccgagguggaagggaggauucaagaucucgagaaauacgucgaggacacaaagauagaucuguggagcuauaaugcagaauuacugguugcucucgagaaccagcauaccaucgaccuuacggauucugaaaugaauaaacuguucgagaagaccaagaaacaguugagagaaaacgccgaggacaugggcaacggaugcuuuaagauuuaccacaaaugugauaaugcuugcaucggcucaauucggaacgggacauaugaccauaauguguaccgagacgaggcccuaaacaaucgcuuccagaucaagggaguagaacugaaaagugguuacaaggauuggauacucuggaucagcuuugcaauuuccugcuuccugcuuuguguggcccuguugggcuuuaucaugugggcuugccaaaaggggaacauuagauguaauaucugcauauga

SEQ ID NO: 135057 - RNA, 1701 nt, Artificial Sequence
  derived and/or modified sequence opt3 from hemagglutinin__InfluenzaA__ALA08556
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguaucacacaaaacgggaccuccucugcuugcauucgccgaagcuccucaaguuucuucagccgucugaauuggcugacgcaucucaacuauacuuacccagcauuaaauguuaccaugcccaacaacgagcaguuugacaagcuguauaucuggggagugcaccauccuggcacagauaaggaccagauauuccuuuacgcccagucuuccggcagaauuacugucucaaccaaaaggagccaacaggcugugaucccaaauauugggagucggccccgcaucagagauaucccuucuaggauuuccauauacuggacaaucguaaagccaggagacauuuugcugaucaacagcaccgguaaucuaauagccccgcggggcuauuuuaaaauucgcucggggaagucuuccaucaugcgaucagacgcgcccaucggaaaauguaagagugaaugcauuacgccuaacggcagcaucccaaaugauaagcccuuccagaacguuaauagaauuacuuacggugcauguccuagguaugugaaacacuccacacucaagcuggccaccgggaugcggaacgucccagagaaacagacucguggaauauuuggcgcuaucgccggcuucauugaaaaugggugggagggaaugguggacgguugguacggcuuucgccaccaaaacucugaggggagaggacaggcagcugaucuuaagagcacacaggccgcgaucgaccaaaucaauggcaaacugaacagguugauugguaagaccaaugaaaaauuccaucagauagagaaggaauuuucagagguggaagggcggauccaggaucucgagaaguaugucgaggacacgaaaauugaucuguggaguuacaacgccgaauuacugguugcacucgagaaucagcacaccaucgaccuuacagauuccgaaaugaacaagcuguuugagaaaacuaagaaacaauugcgagaaaacgcugaggacaugggcaauggaugcuucaagauuuaucauaagugugauaacgccugcaucggcagcauacgcaaugggaccuacgaccacaacguguacagagacgaggcucuaaauaacagguuucagaucaaaggaguagaacugaagucugguuauaaagauuggauucucuggaucucauucgccauuaguugcuuucugcuuuguguggcacuguugggcuucaucaugugggccugccagaaggggaauauacgguguaacauuugcaucuga

SEQ ID NO: 135058 - RNA, 1701 nt, Artificial Sequence; identical to SEQ ID NO: 135014
  derived and/or modified sequence opt3 from hemagglutinin__InfluenzaA__ALA08557

SEQ ID NO: 135059 - RNA, 1701 nt, Artificial Sequence; identical to SEQ ID NO: 135014
  derived and/or modified sequence opt3 from hemagglutinin__InfluenzaA__ALA08558

SEQ ID NO: 135060 - RNA, 1701 nt, Artificial Sequence
  derived and/or modified sequence opt3 from hemagglutinin__InfluenzaA__ALA08559
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgccagaucuuccggcaggauaacugugucaaccaaagggagccagcaagcuguaauuccaaauaucggaagucggccccgcauuagagauaucccuucuaggaucuccauuuacuggacaauaguuaagccaggugacaucuugcugauuaacagcgccggcaaucuaaucgcgccgcggggguauuuuaaaauacgcucgggaaagucuuccauuaugcgaucagacgcacccaucggcaaauguaagagugaaugcaucaccccuaacgguagcauuccaaaugauaagcccuuccagaacgugaauagaaucacguacggggccuguccuagguaugucaaacacuccacucucaagcuggcuacaggaaugcggaacgugccagagaaacagacccguggcauuuuuggcgccauagcaggguucaucgaaaauggaugggaggguaugguggacggcugguacggguuucgccaccagaacucugagggaagaggccaagcugccgaucuuaagagcacucaggcggccauugaccagaucaaugguaaacugaacagguugaucgggaagacaaaugaaaaauuccaucaaauugagaaggaauuuucagaggucgaaggccggauacaggaucucgagaaguauguugaggacaccaaaaucgaucuguggaguuacaacgcagaauuacugguggcucucgagaaucagcacacgauugaccuuaccgauuccgaaaugaacaagcuguuugagaaaacaaagaaacaguugcgagaaaacgccgaggacaugggaaauggcugcuucaagaucuaucauaagugugauaacgcuugcauugggagcauccgcaauggaacuuacgaccacaacguauacagagacgaggcccuaaauaacagguuucaaauaaaagguguggaacugaagucuggcuauaaagauuggauccucuggauuucauucgcaaucaguugcuuucugcuuugugucgcccuguugggguucauuaugugggcuugccagaagggaaauauccgguguaacauaugcauuuga

SEQ ID NO: 135061 - RNA, 1701 nt, Artificial Sequence; identical to SEQ ID NO: 134457
  derived and/or modified sequence opt3 from hemagglutinin__InfluenzaA__ALA08560

SEQ ID NO: 135062 - RNA, 1701 nt, Artificial Sequence
  derived and/or modified sequence opt3 from hemagglutinin__InfluenzaA__ALA08561
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauaaguacccagcauuaaaugugacuaugcccaacaaggagcaguuugacaaacuguauauuuggggaguccaccauccuggcaccgauaaggaccagaucuuccuuuacgcccagucuuccggcagaauaacagugucaacuaaaaggagccaacaggcuguaauuccaaacaucgggagucggccccgcauuagagauaucccuucuaggaucuccauuuacuggaccauaguuaagccaggagacaucuugcugauuaauagcacagguaaccuaaucgccccgcggggcuauuuuaaaauacgcucggggaagucuuccauuaugcgaucagacgcgcccaucggaaaguguaaaagugaaugcaucaccccuaauggcagcauuccaaacgauaagcccuuccagaaugugaacagaaucacguacggugcauguccuagguaugucaaacacuccacucucaagcuggccacagggaugcggaaugugccagagaaacagacccguggaauuuuuggcgcuauagccggcuucaucgaaaacgggugggagggaaugguggacgguugguacggcuuucgccaccaaaauucugaggggagaggacaggcagcugaucuuaagagcacucaggccgcgauugaccaaaucaacggcaaacugaauagguugaucgguaagacaaacgaaaaguuccaucagauugagaaagaauuuucagaggucgaagggcggauacaggaucucgagaaguauguugaggacaccaaaaucgaucuguggaguuacaaugccgaauuacugguggcacucgagaaccagcacacgauugaccuuaccgauuccgaaaugaauaagcuguuugagaaaacaaagaagcaauugcgagaaaacgcugaggacaugggcaacggaugcuucaaaaucuaucauaagugugauaaugccugcauuggcagcauccgcaacgggacuuacgaccacaauguauacagagacgaggcucuaaacaauagguuucagauaaaaggaguggaacugaagucugguuauaaagauuggauccucuggauuucauucgccaucaguugcuuucugcuuugugucgcacuguugggcuucauuaugugggccugccagaaggggaacauccgguguaauauaugcauuuga

SEQ ID NO: 135063 - RNA, 1701 nt, Artificial Sequence
  derived and/or modified sequence opt3 from hemagglutinin__InfluenzaA__ALA08563
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacucucggggaagucuuccauuaugcgcucagacgcgcccaucggaaaauguaagagugaaugcaucacgccuaacggcagcauuccaaaugauaagcccuuccagaacgugaaucgaaucacuuacggugcauguccuagauaugucaaacacuccacacugaagcuggccaccgggaugaggaacgugccagagaaacagacucggggaauuuuuggcgcuauagccggcuucaucgaaaaugggugggagggaaugguggacgguugguacggcuuucgucaccaaaacucugaggggcgcggacaggcagcugaucuuaagagcacacaggccgcgauugaccaaaucaauggcaaauugaacagacucaucgguaagaccaaugaaaaauuccaucagauugagaaggaauuuucagaggucgaagggaggauacaggaucuggagaaguauguugaggacacgaaaaucgauuuauggaguuacaacgccgaacugcucguggcacuugagaaucagcacaccauugaccugacagauuccgaaaugaacaaguuguuugagaaaacuaagaaacaacuacgggaaaacgcugaggacaugggcaauggaugcuucaagaucuaucauaagugugauaacgccugcauuggcagcauccgaaaugggaccuacgaccacaacguauaccgcgacgaggcucugaauaacagauuucagauaaaaggaguggaacucaagucugguuauaaagauuggauccuguggauuucauucgccaucaguugcuuucuucugugugucgcauugcucggcuucauuaugugggccugccagaaggggaauaucagguguaacauaugcauuuga

SEQ ID NO: 135064 - RNA, 1701 nt, Artificial Sequence
  derived and/or modified sequence opt3 from hemagglutinin__InfluenzaA__ALA08571
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacucaagcuggccaccgggaugcggaacgugccagagaaacagacucguggaauuuuuggcgcuauagccggcuucaucgaaaaugggugggagggaaugguggacgguugguacggcuuucgccaccaaaacucugaggggagaggacaggcagcugaucuuaagagcacacaggccgcgauugaccaaaucaauggcaaacugaacagguugaucgguaagaccaaugaaaaauuccaucagauugagaaggaauuuucagaggucgaagggcggauacaggaucucgagaaguauguugaggacacgaaaaucgaucuguggaguuacaacgccgaauuacugguggcacucgagaaucagcacaccauugaccuuacagauuccgaaaugaacaagcuguuugagaaaacuaagaaacaauugcgagaaaacgcugaggacaugggcaauggaugcuucaagaucuaucauaagugugauaacgccugcauuggcagcauccgcaaugggaccuacgaccacaacguauacagagacgaggcucuaaauaacagguuucagauaaaaggaguggaacugaagucugguuauaaagauuggauccucuggauuucauucgccacaaguugcuuucugcuuugugucgcacuguugggcuucaucaugugggccugccagaaggggaauauucgguguaacaucugcauauga

SEQ ID NO: 135065 - RNA, 1701 nt, Artificial Sequence; identical to SEQ ID NO: 135000
  derived and/or modified sequence opt3 from hemagglutinin__InfluenzaA__ALA08572

SEQ ID NO: 135066 - RNA, 1701 nt, Artificial Sequence; identical to SEQ ID NO: 134997
  derived and/or modified sequence opt3 from hemagglutinin__InfluenzaA__ALA08573

SEQ ID NO: 135067 - RNA, 1701 nt, Artificial Sequence
  derived and/or modified sequence opt3 from hemagglutinin__InfluenzaA__ALA08574
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacucaagcuggccaccgggaugcggaacgugccagagaaacagacucguggaauuuuuggcgcuauagccggcuucaucgaaaaugggugggagggaaugguggacgguugguacggcuuucgccaccaaaacucugaggggagaggacaggcagcugaucuuaagagcacacaggccgcgauugaccaaaucucaggcaaacugaauagguugaucgguaagaccaacgaaaaauuccaucagauugagaaggaauuuagugaggucgaagggcggauacaggaucucgagaaguauguugaggacacgaaaaucgaucugugguccuacaaugccgaauuacugguggcacucgagaaccagcacaccauugaccuuacagauagcgaaaugaauaagcuguuugagaaaacuaagaaacaauugcgagaaaacgcugaggacaugggcaacggaugcuucaagaucuaucauaagugugauaaugccugcauuggcucuauccgcaacgggaccuacgaccacaauguauacagagacgaggcucuaaacaauagguuucagauaaaaggaguggaacugaagucagguuauaaagauuggauccucuggauuaguuucgccaucagcugcuuucugcuuugugucgcacuguugggcuucauuaugugggccugccagaaggggaacauccgguguaauauaugcauuuga

SEQ ID NO: 135068 - RNA, 1701 nt, Artificial Sequence
  derived and/or modified sequence opt3 from hemagglutinin__InfluenzaA__ALA08575
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacaguccacacucaagcuggccaccgggaugcggaacgugccagagaaacaaacucguggaauuuuuggcgcuauagccggcuucaucgaaaaugggugggagggaaugguggacgguugguacggcuuucgccaccagaacucugaggggagaggacaggcagcugaucuuaagagcacacaagccgcgauugaccagaucaauggcaaacugaacagguugaucgguaagaccaaugaaaaauuccaccagauugagaaggaauuuucagaggucgaagggcggauacaggaucucgagaaguauguugaggacacgaaaaucgaucuguggaguuacaacgccgaauuacugguggcacucgagaaucaacauaccauugaccuuacagauuccgaaaugaacaagcuguuugagaaaacuaagaaacaguugcgagaaaacgcugaggacaugggcaauggaugcuucaagaucuaucacaagugugauaacgccugcauuggcagcauccgcaaugggaccuacgaccauaacguauacagagacgaggcucuaaauaacagguuucagauaaaaggaguggaacugaagucugguuauaaagauuggauccucuggauuucauucgccaucaguugcuuucugcuuugugucgcacuguugggcuucauuaugugggccugccagaaggggaauauccgguguaacauaugcauuuga

SEQ ID NO: 135069 - RNA, 1701 nt, Artificial Sequence; identical to SEQ ID NO: 134457
  derived and/or modified sequence opt3 from hemagglutinin__InfluenzaA__ALA08576

SEQ ID NO: 135070 - RNA, 1701 nt, Artificial Sequence; identical to SEQ ID NO: 134457
  derived and/or modified sequence opt3 from hemagglutinin__InfluenzaA__ALA08577

SEQ ID NO: 135071 - RNA, 1701 nt, Artificial Sequence
  derived and/or modified sequence opt3 from hemagglutinin__InfluenzaA__ALA08579
augaagaccaucauugcccugagcuacauacucugccuuaucuucgcucagaaaauucccggcaacgacaauuccacagcaacucuguguuuggggcaccaugccgugccuaacggaacgaucgucaagaccauuacaaaugauagaaucgagguuacuaacgcgaccgaauuagugcaaaauucuucaauaggugagaucugcgacaguccacaccagauucuggauggcgaaaacuguacacuaaucgacgcucuccugggggauccgcagugcgacggauuucagaauaaaaagugggaucuuuucguagagaggagcaaagccuauuccaacuguuaccccuaugacgugccugauuacgcaucucugcggucguuggucgccucaagcggcacccucgaauuuaauaacgagaguuucaauuggacuggugugacacaaaacgggaccuccucugcuugcauucgcaagagcuccucaaguuucuucagccgacugaauuggcugacgcaucucaacuauacuuacccagcauuaaauguuaccaugcccaacaacgagcaguuugacaagcuguauaucuggggagugcaccauccuggcacagauaaagaccagauauuccuuuacgcccguucuuccggcagaauuacugucucaaccaagaggagccagcaagcugugaucccaaauauugggagucggccccgcaucagagauaucccuucuaggauuuccauauacuggacaaucguaaaaccaggagacauuuugcugaucaacagcaccgguaaucuaauagccccgcggggcuauuuuaagauucgcucggggaaaucuuccaucaugcgaucagacgcgcccaucggaaaguguaagagugaaugcauuacgccuaacggcagcaucccaaaugauaaacccuuccagaacguuaauagaauuacuuacggugcauguccuagguaugugaagcacuccacacucaaacuggccaccgggaugcggaacgucccagagaagcagacucguggaauauuuggcgcuaucgccggcuucauugaaaaugggugggagggaaugguggacgguugguacggcuuucgccaccagaacucugaggggagaggacaagcagcugaucuuaaaagcacacaggccgcgaucgaccagaucaauggcaagcugaacagguugauugguaaaaccaaugaaaaguuccaucaaauagagaaggaauuuucagagguggaagggcggauccaggaucucgagaaauaugucgaggacacgaagauugaucuguggaguuacaacgccgaauuacugguugcacucgagaaucagcacaccaucgaccuuacagauuccgaaaugaacaaacuguuugagaagacuaaaaagcaguugcgagaaaacgcugaggacaugggcaauggaugcuucaagauuuaucauaaaugugauaacgccugcaucggcagcauacgcaaugggaccuacgaccacaacguguacagagacgaggcucuaaauaacagguuucaaaucaagggaguagaacugaaaucugguuauaaggauuggauucucuggaucucauucgccauuaguugcuuucugcuuuguguggcacuguugggcuucaucaugugggccugccagaaagggaauauacgguguaacauuugcaucuga

SEQ ID NO: 135072 - RNA, 1701 nt, Artificial Sequence
  derived and/or modified sequence opt3 from hemagglutinin__InfluenzaA__ALA08580
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgccagaucuuccggcaggauaacugugucaaccaaagggagccagcaagcuguaauuccaaauaucggaagucggccccgcauuagagauaucccuucuaggaucuccauuuacuggacaauaguuaagccaggugacaucuugcugauuaacagcaccggcaaucuaaucgccccgcggggguauuuuaaaauacgcucgggaaagucuuccauuaugcgaucagacgcgcccaucggcaaauguaagagugaaugcaucacgccuaacgguagcauuccaaaugauaagcccuuccagaacgugaauagaaucacuuacggggcauguccuagguaugucaaacacuccacacucaagcuggccaccggaaugcggaacgugccagagaaacagacucguggcauuuuuggcgcuauagccggguucaucgaaaauggaugggaggguaugguggacggcugguacggguuucgccaccagaacucugagggaagaggccaagcagcugaucuuaagagcacacaggccgcgauugaccagaucaaugguaaacugaacagguugaucgggaagaccaaugaaaaauuccaucaaauugagaaggaauuuucagaggucgaaggccggauacaggaucucgagaaguauguugaggacacgaaaaucgaucuguggaguuacaacgccgaauuacugguggcacucgagaaucagcacaccauugaccuuacagauuccgaaaugaacaagcuguuugagaaaacuaagaaacaguugcgagaaaacgcugaggacaugggaaauggcugcuucaagaucuaucauaagugugauaacgccugcauugggagcauccgcaauggaaccuacgaccacaacguauacagagacgaggcucuaaauaacagguuucaaauaaaagguguggaacugaagucuggcuauaaagauuggauccucuggauuucauucgccaucaguugcuuucugcuuugugucgcacuguugggguucauuaugugggccugccagaagggaaauauccgguguaacauaugcauuuga

SEQ ID NO: 135073 - RNA, 1701 nt, Artificial Sequence
  derived and/or modified sequence opt3 from hemagglutinin__InfluenzaA__ALA08582
augaagaccaucauugcccugagcuacauacucugccuuguguucgcucagaaacugcccgagaacgacaauuccacagcaacuuuguguuuaggccaccaugccgucccuaacgggacgaucguuaagaccauuacaaaugauagaaucgaagugacuaacgcgaccgagcugguacaaaauucuucaauuggagaaaucugcgacaguccacaccagauacuagaugguaaaaacuguacacucaucgacgcucugcuuggcgauccgcagugcgacggguuucagaauaagaaaugggaucuguucguggagaggagcaaggccuauuccaacuguuaccccuaugacgucccugauuacgcaucuuugcggucgcucguggccucaagcggaacccuggaauuuaaugacgagaguuucaacugggcuggcguuacucaaaaugguacauccucugcaugcauucgcgggagcaacuccucauuuuucagucgacugaauuggcucacccauagcaacuuuaaguauccagccuuaaaugugacgaugcccaacaacgagcaguucgauaaacuguacaucuggggaguccaccauccuggcacugacaaggaucagauuuuucuuuaugcucagucuuccggccguaucaccgugucaacaaaaagaagccaacaggccguaauaccaaauauugggaguaggccccggauccgcaacauuccuucuagaaucuccaucuacuggacuauuguuaagccaggagacauauugcugaucaauagcaccgguaaccuaauugcgccgaggggcuacuucaaaauccggucggggaagucuuccauaaugcgcucagacgcacccauuggaaaguguaaaagugaaugcaucacaccuaauggcagcaucccaaacgauaagcccuuucagaaugugaaccgaauuaccuauggugccuguccuagauacgucaaacaguccacgcucaagcuggcuacugggaugaggaaugugccagagaaacaaacacggggaaucuucggcgccauugcaggcuuuauagaaaacgggugggagggaaugaaggacgguugguauggcuuccgucaccaaaauucugaggggcgcggacaggcugccgaucuuaaaagcacccaggcggccaucgaccagauuaacggcaagcugaauagauugaucgguaagacuaacgaaaaauuccaccagaucgagaaggaauuuucagagguggaagggaggauucaggaucucgagaaauacgucgaggacacaaagauagaucuguggaguuauaaugcagaauuacugguugcucucgagaaccaacauaccaucgaccuuacggauuccgaaaugaacaaacuguucgagaagaccaagaaacaguugcgggaaaaugccgaggacaugggcaacggaugcuuuaagauuuaccacaaaugugauaaugcuugcaucggcagcauucgaaacgggacauaugaccaugacguguaccgcgaugaggcccuaaauaacagauuccagaucaagggaguagaacugaaaucugguuacaaggacuggauacucuggaucucauuugcaauuaguugcuuccugcuuuguguggcccuguugggcuuuaucaugugggcuugccagaaggggaauauuagguguaacaucugcauauga

SEQ ID NO: 135074 - RNA, 1701 nt, Artificial Sequence; identical to SEQ ID NO: 135073
  derived and/or modified sequence opt3 from hemagglutinin__InfluenzaA__ALA08583

SEQ ID NO: 135075 - RNA, 1701 nt, Artificial Sequence; identical to SEQ ID NO: 135073
  derived and/or modified sequence opt3 from hemagglutinin__InfluenzaA__ALA08584

SEQ ID NO: 135076 - RNA, 1701 nt, Artificial Sequence; identical to SEQ ID NO: 135073
  derived and/or modified sequence opt3 from hemagglutinin__InfluenzaA__ALA08585

SEQ ID NO: 135077 - RNA, 1701 nt, Artificial Sequence; identical to SEQ ID NO: 134457
  derived and/or modified sequence opt3 from hemagglutinin__InfluenzaA__ALA08586

SEQ ID NO: 135078 - RNA, 1701 nt, Artificial Sequence; identical to SEQ ID NO: 135073
  derived and/or modified sequence opt3 from hemagglutinin__InfluenzaA__ALA08587

SEQ ID NO: 135079 - RNA, 1701 nt, Artificial Sequence; identical to SEQ ID NO: 134457
  derived and/or modified sequence opt3 from hemagglutinin__InfluenzaA__ALA08588

SEQ ID NO: 135080 - RNA, 1701 nt, Artificial Sequence; identical to SEQ ID NO: 134457
  derived and/or modified sequence opt3 from hemagglutinin__InfluenzaA__ALA08589

SEQ ID NO: 135081 - RNA, 1701 nt, Artificial Sequence; identical to SEQ ID NO: 135073
  derived and/or modified sequence opt3 from hemagglutinin__InfluenzaA__ALA08590

SEQ ID NO: 135082 - RNA, 1701 nt, Artificial Sequence; identical to SEQ ID NO: 134457
  derived and/or modified sequence opt3 from hemagglutinin__InfluenzaA__ALA08591

SEQ ID NO: 135083 - RNA, 1701 nt, Artificial Sequence; identical to SEQ ID NO: 135014
  derived and/or modified sequence opt3 from hemagglutinin__InfluenzaA__ALA08592

SEQ ID NO: 135084 - RNA, 1701 nt, Artificial Sequence
  derived and/or modified sequence opt3 from hemagglutinin__InfluenzaA__ALA08594
augaagaccaucauugcccugagcuacauacucugccuuguguucgcucagaaacugcccgagaacgacaauuccacagcaacuuuguguuuaggccaccaugccgucccuaacgggacgaucguuaagaccauuacaucugauagaaucgaagugacuaaugcgaccgagcugguacaaaacucaaguauuggagaaaucugcgacagcccacaccagauacuagaugguaaaaauuguacacucaucgacgcucugcuuggcgauccgcagugcgacggguuucagaacaagaaaugggaucuguucguggagagguccaaggccuauucuaauuguuaccccuaugacgucccugauuacgcaucguugcggucacucguggccagcaguggaacccuggaauuuaacgacgaguccuucaauugggcuggcguuacucaaaacgguacaucuagcgcaugcauucgcggguccaauucaaguuucuuuagccgacugaacuggcucacccauucuaauuuuaaguauccagccuuaaacgugacgaugcccaauaacgagcaguucgauaaacuguacaucuggggaguccaccauccuggcacugacaaggaucagauuuuucuuuaugcucaguccucaggccguaucaccgugagcacaaaaagaagucaacaggccguaauaccaaacauugggucuaggccccggauccgcaauauuccuuccagaaucagcaucuacuggacuauuguuaagccaggagacauauugcugaucaacucgaccgguaaucuaauugcgccgaggggcuacuucaaaauccggucugggaaguccucaauaaugcgcagugacgcacccauuggaaaguguaaaagcgaaugcaucacaccuaacggcuccaucccaaaugauaagcccuuucagaacgugaaucgaauuaccuauggugccuguccuagauacgucaaacagucuacgcucaagcuggcuacugggaugaggaacgugccagagaaacaaacacggggaaucuucggcgccauugcaggcuuuauagaaaaugggugggagggaaugaaggacgguugguauggcuuccgucaccagaacagcgaggggcgcggacaggcugccgaucuuaaaucaacccaagcggccaucgaccagauuaauggcaagcugaacagauugaucgguaagacuaaugaaaaauuccaccagaucgagaaggaauuuagugagguggaagggaggauucaggaucucgagaaauacgucgaggacacaaagauagaucugugguccuauaacgcagaauuacugguugcucucgagaaucaacauaccaucgaccuuacggauagcgaaaugaacaaacuguucgagaagaccaagaaacaguugcgggaaaacgccgaggacaugggcaauggaugcuuuaagauuuaccacaaaugugauaacgcuugcaucggcucuauucgaaaugggacauaugaccaugacguguaccgcgaugaggcccuaaacaauagauuccagaucaagggaguagaacugaaaucagguuacaaggacuggauacucuggaucaguuuugcaaugagcugcuuccugcuuuguguggcccuguugggcuuuauuaugugggcuugccagaaggggaacaucagguguaauauuugcaucuga

SEQ ID NO: 135085 - RNA, 1701 nt, Artificial Sequence; identical to SEQ ID NO: 134457
  derived and/or modified sequence opt3 from hemagglutinin__InfluenzaA__ALA08595

SEQ ID NO: 135086 - RNA, 1701 nt, Artificial Sequence; identical to SEQ ID NO: 134457
  derived and/or modified sequence opt3 from hemagglutinin__InfluenzaA__ALA08596

SEQ ID NO: 135087 - RNA, 1701 nt, Artificial Sequence
  derived and/or modified sequence opt3 from hemagglutinin__InfluenzaA__ALA08597
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacucaagcuggccaccgggaugcggaacgugccagagaaacagacucguggaauuuuuggcgcuauagccggcuucaucgaaaaugggugggagggaaugguggacgguugguacggcuuucgccaccaaaacucugaggggagaggacaggcagcugaucuuaagagcacacaggccgcgauugaccaaaucaauggcaaacugaacagguugaucgguaagaccaaugaaaaauuccaucagauugagaaggaauuuucagaggucgaagggcggauacaggaucucgagaaguauguugaggacacgaaaaucgaucuguggaguuacaacgccgaauuacugguggcacucgagaaucagcacaccauugaccuuacagauuccgaaaugaacaagcuguuugagaaaacuaagaaacaauugcgagaaaacgcugaggacaugggcaauggaugcuucaagaucuaucauaagugugauaacgccugcauuggcagcauccgcaaugggaccuacgaccacaacguauacagagacgaggcucuaaauaacagguuucagauaaaaggaguggaacugaagucugguuauaaagauuggauccucuggauuucauucgccaucaguugcuuucugcuuugugucgcacuguugggcuucauuaugugggccugccagaaugggaacauccgguguaauauaugcauuuga

SEQ ID NO: 135088 - RNA, 1701 nt, Artificial Sequence
  derived and/or modified sequence opt3 from hemagglutinin__InfluenzaA__ALA08598
augaagaccaucauugccagcuccuacauacugugccucguguucgcucagaaaauccccggcaacgacaauucuacagcaacucuuugucuggggcaccaugccgucccuaacggaacgauuguuaagaccaucacaaaugauagaauugaggugacuaacgcgaccgaauugguacaaaauucaaguaucggugagauaugcgacagcccacaccagaucuuagauggcgaaaacuguacacugauugacgcucuacucggggauccgcagugcgacggauuucagaauaaaaagugggaucuguucguggagagguccaaagccuauucuaacuguuaccccuaugacgucccugauuacgcaucgcuucggucacugguggccagcaguggcaccuuggaauuuaauaacgaguccuucaauuggacugguguuacacaaaacgggaccucuagcgcuugcauccgccgauccucaaguagcuuuuucucucgucucaauuggcugacgcaucugaacuauacuuacccagcacucaaugugaccaugcccaacaacgagcaguuugacaaguuauauauuuggggaguccaccauccuggcacagauaaggaccagaucuuccuguacgcccaguccucaggcagaauaacugugagcaccaaaaggagucaacaggcuguaauuccaaauaucgggucucggccccgcauuagagauaucccuuccaggaucagcauuuacuggacaauaguuaagccaggagacauccuuuugauuaacucgaccgguaaucugaucgccccgcggggcuauuuuaaaauacgcucugggaaguccucaauuaugcgaagugacgcgcccaucggaaaauguaagagcgaaugcaucacgccuaacggcuccauuccaaaugauaagcccuuccagaacgugaauagaaucacuuacggugcauguccuagguaugucaaacacucuacacuaaagcucgccaccgggaugcggaacgugccagagaaacagacucguggaauuuuuggcgcuauagccggcuucaucgaaaaugggugggagggaaugguggacgguugguacggcuuucgccaccaaaacagcgaggggagaggacaggcagcugaucugaagucaacacaggccgcgauugaccaaaucaauggcaaacuuaacaggcugaucgguaagaccaaugaaaaauuccaucagauugagaaggaguucagugaagucgaagggcggauacaggauuuggagaaguauguugaggacacgaaaaucgaucucugguccuacaacgccgaacuguuaguggcacuggagaaucagcacaccauugaccucacagauagcgaaaugaacaaacuuuuugagaagacuaagaaacaacugcgagaaaacgcugaggacaugggcaauggaugcuucaagaucuaucauaagugugauaacgccugcauuggcucuauccgcaaugggaccuacgaccacaacguauacagagacgaggcuuugaauaacagguuucagauaaaaggaguggaacuaaagucagguuauaaagauuggauccuguggauuaguuucgccaucagcugcuuucuccugugugucgcacuucugggcuucauuaugugggccugccagaaggggaauauccgguguaacauaugcauuuga

SEQ ID NO: 135089 - RNA, 1701 nt, Artificial Sequence; identical to SEQ ID NO: 134457
  derived and/or modified sequence opt3 from hemagglutinin__InfluenzaA__ALA08599

SEQ ID NO: 135090 - RNA, 1701 nt, Artificial Sequence
  derived and/or modified sequence opt3 from hemagglutinin__InfluenzaA__ALA08600
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauagauacccagcauuaaaugugacuaugcccaacaacgagcaguuugacaagcuguauauuuggggaguccaccauccuggcaccgauaaggaccagaucucucuuuacgcccaguccucaggcaggauaacagugagcacuaaacggagucaacaggcuguaauuccaaauaucgggucucgccccagaauuagggauaucccuucccggaucagcauuuacuggaccauaguuaagccaggagacaucuugcugauuaacucgacagguaaucuaaucgccccgcgcggcuauuucaaaauacgaucugggaaguccucaauuaugagaagugacgcgcccaucggaaaauguaagagcgaaugcaucaccccuaacggcuccauuccaaaugauaagcccuuucagaacgugaauaggaucacguacggugcauguccucgguaugucaaacacucuacucucaagcuggccacagggaugcguaacgugccagagaaacagacccgcggaauuuucggcgcuauagccggcuuuaucgaaaaugggugggagggaaugguggacgguugguacggcuucagacaccaaaacagcgaggggaggggacaggcagcugaucuuaagucaacucaggccgcgauugaccaaaucaauggcaaacugaaccgguugaucgguaagacaaaugaaaaauuucaucagauugagaaggaauuuagugaggucgaagggcgaauacaggaucucgagaaguauguugaggacaccaaaaucgaucugugguccuacaacgccgaauuacugguggcacucgagaaucagcacacgauugaccuuaccgauagcgaaaugaacaagcuguucgagaaaacaaagaaacaauugcgcgaaaacgcugaggacaugggcaauggaugcuuuaagaucuaucauaagugugauaacgccugcauuggcucuaucagaaaugggacuuacgaccacaacguauacagggacgaggcucuaaauaaccgguuccagauaaaaggaguggaacugaagucagguuauaaagauuggauccucuggauuaguuuugccaucagcugcuuccugcuuugugucgcacuguugggcuuuauuaugugggccugccagaaggggaauauccgcuguaacauaugcauuuga

SEQ ID NO: 135091 - RNA, 1701 nt, Artificial Sequence; identical to SEQ ID NO: 134457
  derived and/or modified sequence opt3 from hemagglutinin__InfluenzaA__ALA08601

SEQ ID NO: 135092 - RNA, 1701 nt, Artificial Sequence
  derived and/or modified sequence opt3 from hemagglutinin__InfluenzaA__ALA08602
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacgauuuucagaauaaaaagugggaccuuuucguggagaggagcaaagccuauuccaacuguuaccccuaugaugucccugacuacgcaucucugcggucguugguggccucaagcggaacccucgaauuuaauaacgagaguuucaauuggacuggcguuacacaaaacgguaccuccucugcuugcauccgccgaagcuccucaaguuucuucagccgucugaauuggcugacgcaucucaacuauacuuacccagcauuaaaugugaccaugcccaacaacgagcaguuugauaagcuguauauuuggggaguccaccauccugggacagacaaggaucagaucucucuuuacgcccaguccucaggcagaauaacugugagcaccaaaaggagucaacaggcuguaauuccaaauaucggcucucggccccgcauuagagacaucccuuccaggaucagcauuuacuggacaauaguuaagccaggggacaucuugcugauuaacucgaccggaaaucuaaucgccccgcgggguuauuucaaaauacgcucuggcaaguccucaauuaugcgaagugaugcgcccaucgggaaauguaagagcgaaugcaucacgccuaacggauccauuccaaaugacaagcccuuucagaacgugaauagaaucacuuacggcgcauguccuagguaugucaaacacucuacacucaagcuggccaccgguaugcggaacgugccagagaaacagacucgugggauuuucggagcuauagccggcuuuaucgaaaauggcugggaggggaugguggauggaugguacgguuuccgccaccaaaacagcgagggcagagggcaggcagcugaccuuaagucaacacaggccgcgauugaucaaaucaauggaaaacugaacagguugaucggcaagaccaaugaaaaauuucaucagauugagaaggaauuuagugaggucgaaggucggauacaggaccucgagaaguauguugaggauacgaaaaucgaccugugguccuacaacgccgaauuacugguggcacucgagaaucagcacaccauugaucuuacagacagcgaaaugaacaagcuguucgagaaaacuaagaaacaauugcgagaaaacgcugaggauauggggaauggcugcuuuaagaucuaucauaagugugacaacgccugcauuggaucuauccgcaauggcaccuacgaccacaacguauacagagaugaggcucuaaauaacagguuccagauaaaagggguggaacugaagucaggauauaaagacuggauccucuggauuaguuuugccaucagcugcuuccugcuuugugucgcacuguuggguuuuauuaugugggccugccagaagggcaauauccgguguaacauaugcauuuga

SEQ ID NO: 135093 - RNA, 1701 nt, Artificial Sequence
  derived and/or modified sequence opt3 from hemagglutinin__InfluenzaA__ALA08603
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauauuuacccagcauuaaaugugacuaugcccaacaacgagcaguuugacaagcuguauaucuggggaguccaccauccuggcaccgauaaggaccagauauuccuuuacgcccagucuuccggcagaauuacagugucaacuaaaaggagccaacaggcuguaaucccaaauauugggagucggccccgcaucagagauaucccuucuaggauuuccauauacuggaccaucguuaagccaggagacauuuugcugaucaacagcacagguaaucuaauagccccgcggggcuauuuuaaaauucgcucggggaagucuuccaucaugcgaucagacgcgcccaucggaaaauguaagagugaaugcauuaccccuaacggcagcaucccaaaugauaagcccuuccagaacgugaauagaauuacguacggugcauguccuagguaugucaaacacuccacucucaagcuggccacagggaugcggaacgugccagagaaacagacccguggaauauuuggcgcuaucgccggcuucauugaaaaugggugggagggaaugguggacgguugguacggcuuucgccaccaaaacucugaggggagaggacaggcagcugaucuuaagagcacucaggccgcgaucgaccaaaucaauggcaaacugaacagguugauugguaagacaaaugaaaaauuccaucagauagagaaggaauuuucagaggucgaagggcggauccaggaucucgagaaguauguugaggacaccaaaauugaucuguggaguuacaacgccgaauuacugguggcacucgagaaucagcacacgaucgaccuuaccgauuccgaaaugaacaagcuguuugagaaaacaaagaaacaauugcgagaaaacgcugaggacaugggcaauggaugcuucaagauuuaucauaagugugauaacgccugcaucggcagcauacgcaaugggacuuacgaccacaacguauacagagacgaggcucuaaauaacagguuucagaucaaaggaguggaacugaagucugguuauaaagauuggauucucuggaucucauucgccauuaguugcuuucugcuuugugucgcacuguugggcuucaucaugugggccugccagaaggggaauauacgguguaacauuugcaucuga

SEQ ID NO: 135094 - RNA, 1701 nt, Artificial Sequence; identical to SEQ ID NO: 134457
  derived and/or modified sequence opt3 from hemagglutinin__InfluenzaA__ALA08605

SEQ ID NO: 135095 - RNA, 1701 nt, Artificial Sequence; identical to SEQ ID NO: 134457
  derived and/or modified sequence opt3 from hemagglutinin__InfluenzaA__ALA08606

SEQ ID NO: 135096 - RNA, 1701 nt, Artificial Sequence; identical to SEQ ID NO: 135072
  derived and/or modified sequence opt3 from hemagglutinin__InfluenzaA__ALA08607

SEQ ID NO: 135097 - RNA, 1701 nt, Artificial Sequence
  derived and/or modified sequence opt3 from hemagglutinin__InfluenzaA__ALA08609
augaagaccaucauugcccugggcuacauacucugccuuguguucgcucagaaaauccccgggaacgacaauagcacagcaacucuguguuugggacaccaugccgucccuaacgguacgauuguuaagaccaucacaaaugauagaauugaggugacuaacgcgaccgaauuaguacaaaauuccucuaucggcgagauaugcgacucaccacacaaaauccuggauggggaaaacuguacacuaauugacgcucuccugggagauccgcagugcgacggcuuucagaauaagaaaugggaucuuuucguggagaggaguaaggccuauagcaacuguuaccccuaugacgucccugauuacgcaucccugcggucuuugguggccucgucagguacccucgaauuuaauaacgagagcuucaauuggacugggguuacacagaacggaaccaguuccgcuugcauccgccgaucuagcuccucauuuuucagucgucugaauuggcugacgcaucucaacuauacuuacccagcauuaaaugugaccaugcccaacaacgagcaauuugacaagcuguauauuuggggcguccaccauccuggcacagauaaagaccagaucuuccuuuacgcccagagcucugggagaauaacuguguccaccaagaggucacagcaagcuguaauuccaaauaucggaagccggccccgcauuagagauaucccuaguaggaucucuauuuacuggacaauaguuaaaccaggugacaucuugcugauuaacuccaccggcaaucuaaucgccccgcggggguauuuuaagauacgcagcggaaaaucgucuauuaugcgauccgacgcgcccaucggcaaguguaagucagaaugcaucacgccuaacgguaguauuccaaaugauaaacccuuccagaacgugaauagaaucacuuacggggcauguccuagguaugucaagcacagcacacucaaacuggccaccggaaugcggaacgugccagagaagcagacucguggcauuuuuggcgcuauagccggguucaucgaaaauggaugggaggguaugguggacggcugguacggguuucgccaccagaacuccgagggaagaggccaagcagcugaucuuaaaucuacacaggccgcgauugaccagaucaaugguaagcugaacagguugaucgggaaaaccaaugaaaaguuccaucaaauugagaaggaguucagcgaagucgaaggccggauacaggaucucgacaaauauguugaggauacgaagaucgaccuguggucauacaacgccgaguuacugguggcacucgaaaaucagcacaccauugaucuuacagacagugagaugaacaaacuguuugaaaagacuaaaaagcaguugcgagagaacgcugaagauaugggaaauggcugcuucaagaucuaucauaaaugugacaacgccugcauuggguccauccgcaauggaaccuacgaccacaacguauacagagaugaggcucuaaauaacagguuucaaauaaaggguguggagcugaaaagcggcuauaaggacuggauccucuggauuucuuucgccaucucaugcuuucugcuuugugucgcacuguugggguucauuaugugggccugccagaaaggaaauauccgguguaacauaugcauuuga

SEQ ID NO: 135098 - RNA, 1701 nt, Artificial Sequence; identical to SEQ ID NO: 135014
  derived and/or modified sequence opt3 from hemagglutinin__InfluenzaA__ALA08610

SEQ ID NO: 135099 - RNA, 1701 nt, Artificial Sequence
  derived and/or modified sequence opt3 from hemagglutinin__InfluenzaA__ALA08611
augaagaucauuauagcccugagcuacauccucugccuuguguucgcucagaaaauucccggcaacgacaauuccaccgcaacacuguguuuggggcaccaugccgucccuaacggaacuaucguuaagacgauuaccaaugauagaaucgaggugacaaacgcgacugaauuaguacaaaauucuucaauaggugagaucugcgacaguccacacaggauucuggauggcgaaaacuguacccuaaucgacgcucuccugggggauccgcagugcgacggauuucagaauaaaaagugggaucuuuucguggagcggagcaaagccuauuccaacuguuaccccuaugacgucccugauuacgcaucucugcgcucguugguggccucaagcggcacacucgaauuuaauaacgagaguuucaauuggaccgguguuacucagaacgggacauccucugcuugcauucgacguagcuccucaaguuucuucagcagacugaauuggcugacccaucucaacuauacguacccagcauuaaaugugacuaugcccaacaacgagcaauuugacaagcuguauaucuggggaguccaccauccuggcaccgauaaggaccagauauuccuuuacgcccagucuuccggcaggauuacagugucaacuaaacggagccagcaagcuguaaucccaaauauugggagucgccccagaaucagggauaucccuucucggauuuccauauacuggaccaucguuaagccaggagacauuuugcugaucaacagcacagguaaucuaauagccccgcgcggcuauuuuaaaauucgaucggggaagucuuccaucaugagaucagacgcgcccaucggaaaauguaagagugaaugcauuaccccuaacggcagcaucccaaaugauaagcccuuccagaacgugaauaggauuacguacggugcauguccucgguaugucaaacacuccacucucaagcuggccacagggaugcguaacgugccagagaaacagacccgcggaauauuuggcgcuaucgccggcuucauugaaaaugggugggagggaaugguggacgguugguacggcuuuagacaccagaacucugaggggaggggacaagcagcugaucuuaagagcacucaggccgcgaucgaccagaucaauggcaaacugaaccgguugauugguaagacaaaugaaaaauuccaucaaauagagaaggaauuuucagaggucgaagggcgaauccaggaucucgagaaguauguugaggacaccaaaauugaucuguggaguuacaacgccgaauuacugguggcacucgagaaucagcacacgaucgaccuuaccgauuccgaaaugaacaagcuguuugagaaaacaaagaaacaguugcgcgaaaacgcugaggacaugggcaauggaugcuucaagauuuaucauaagugugauaacgccugcaucggcagcauaagaaaugggacuuacgaccacaacguauacagggacgaggcucuaaauaaccgguuucaaaucaaaggaguggaacugaagucugguuauaaagauuggauucucuggaucucauucgccauuaguugcuuucugcuuugugucgcacuguugggcuucaucaugugggccugccagaaggggaauauacgcuguaacauuugcaucuga

SEQ ID NO: 135100 - RNA, 1701 nt, Artificial Sequence; identical to SEQ ID NO: 135072
  derived and/or modified sequence opt3 from hemagglutinin__InfluenzaA__ALA08612

SEQ ID NO: 135101 - RNA, 1701 nt, Artificial Sequence; identical to SEQ ID NO: 134457
  derived and/or modified sequence opt3 from hemagglutinin__InfluenzaA__ALA08614

SEQ ID NO: 135102 - RNA, 1701 nt, Artificial Sequence; identical to SEQ ID NO: 134457
  derived and/or modified sequence opt3 from hemagglutinin__InfluenzaA__ALA08615

SEQ ID NO: 135103 - RNA, 1701 nt, Artificial Sequence; identical to SEQ ID NO: 134457
  derived and/or modified sequence opt3 from hemagglutinin__InfluenzaA__ALA08616

SEQ ID NO: 135104 - RNA, 1701 nt, Artificial Sequence; identical to SEQ ID NO: 134997
  derived and/or modified sequence opt3 from hemagglutinin__InfluenzaA__ALA08617

SEQ ID NO: 135105 - RNA, 1701 nt, Artificial Sequence
  derived and/or modified sequence opt3 from hemagglutinin__InfluenzaA__ALA08619
augaagaccgugaucgcccugagcuacauucucugccuugucuucgcucagaaaauacccggcaacgacaauuccacagcaacucuguguuuggggcaccaugccguuccuaacggaacgaucgugaagaccauuacaaaugauagaaucgagguaacuaacgcgaccgaauuagugcaaaauucuucaauuggugagaucugcgacaguccacaccagauacuggauggcgaaaacuguacacuaaucgacgcucuccugggggauccgcagugcgacggauuucagaauaaaaagugggaucuuuucgucgagaggagcaaagccuauuccaacuguuaccccuaugacgugccugauuacgcaucucugcggucguugauugccucaagcggcacccucgaauuuaauaacgagaguuucaauuggacugguguuacacaaaacgggaccuccucugcuugcauccgcaagagcuccucaaguuucuuuagccgacugaauuggcugacgcaucucaacuauacuuacccagcauuaaaugugaccaugcccaacaacgagcaguuugacaagcuguauauuuggggaguccaccauccuggcacagauaaagaccagaucuuccuuuacgcccguucuuccggcagaauaacugugucaaccaagaggagccagcaagcuguaauuccaaauaucgggagucggccccgcauuagagauaucccuucuaggaucuccauuuacuggacaauaguuaaaccaggagacaucuugcugauuaacagcaccgguaaucuaaucgccccgcggggcuauuuuaagauacgcucggggaaaucuuccauuaugcgaucagacgcgcccaucggaaaguguaagagugaaugcaucacgccuaacggcagcauuccaaaugagaaacccuuccagaacgugaauagaaucacuuacggugcauguccuagguaugucaagcacuccacacucaaacuggccaccgggaugcggaacgugccagaaaagcagacucguggaauuuuuggcgcuauagccggcuucaucgagaaugggugggagggaaugguggaugguugguacggcuuucgccaccagaacucugaagggagaggacaagcagcugaccuuaaaagcacacaggccgcgauugaucagaucaauggcaagcugaacagguugaucgguaaaaccaaugagaaguuccaucaaauugaaaaggaguucucagaagucgaggggcggauacaggaccucgagaaauauguugaagauacgaagaucgaccuguggaguuacaacgccgaguuacugguggcacucgaaaaucagcacaccauugaucuuacagacuccgagaugaacaaacuguuugaaaagacuaaaaagcaguugcgagagaacgcugaggauaugggcaauggaugcuucaagaucuaucauaaaugugacaacgccugcauuggcagcauccgcaaugggauauacgaucacaacguauacagagacgaagcucuaaauaacagguuucaaaucaagggaguggagcugaaaucugguuauaaggacuggauucucuggaucucauucgccauuaguugcuuucugcuuugugucgcacuguugggcuucaucaugugggccugccagaaagggaauauacgguguaacauuugcaucuga

SEQ ID NO: 135106 - RNA, 1701 nt, Artificial Sequence; identical to SEQ ID NO: 135072
  derived and/or modified sequence opt3 from hemagglutinin__InfluenzaA__ALA08620

SEQ ID NO: 135107 - RNA, 1701 nt, Artificial Sequence; identical to SEQ ID NO: 135063
  derived and/or modified sequence opt3 from hemagglutinin__InfluenzaA__ALA08621

SEQ ID NO: 135108 - RNA, 1701 nt, Artificial Sequence
  derived and/or modified sequence opt3 from hemagglutinin__InfluenzaA__ALA08622
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauaaguacccagcauuaaaugugacuaugcccaacaacgagcaguuugacaagcuguauauuuggggaguccaccauccuggcaccgauaaagaccagaucuuccuuuacgcccagucuuccggcagaauaacagugucaacuaagaggagccaacaggcuguaauuccaaauaucgggagucggccccgcauuagagauaucccuucuaggaucuccauuuacuggaccauaguuaaaccaggagacaucuugcugauuaacagcacagguaaucuaaucgccccgcggggcuauuuuaagauacgcucggggaaaucuuccauuaugcgaucagacgcgcccaucggaaaguguaagagugaaugcaucaccccuaacggcagcauuccaaaugauaaacccuuccagaacgugaauagaaucacguacggugcauguccuagguaugucaagcacuccacucucaaacuggccacagggaugcggaacgugccagagaagcagacccguggaauuuuuggcgcuauagccggcuucaucgaaaaugggugggagggaaugguggacgguugguacggcuuucgccaccaaaacucugaggggagaggacaggcagcugaucuuaaaagcacucaggccgcgauugaccaaaucaauggcaagcugaacagguugaucgguaaaacaaaugaaaaguuccaucagauugagaaggaauuuucagaggucgaagggcggauacaggaucucgagaaauauguugaggacaccaagaucgaucuguggaguuacaacgccgaauuacugguggcacucgagaaucagcacacgauugaccuuaccgauuccgaaaugaacaaacuguuugagaagacuaaaaagcaauugcgagaaaacgcugaggacaugggcaauggaugcuucaagaucuaucauaaaugugauaacgccugcauuggcagcauccgcaaugggacauacgaccacaacguauacagagacgaggcucuaaauaacagguuucagauaaagggaguggaacugaaaucugguuauaaggauuggauccucuggauuucauucgccaucaguugcuuucugcuuugugucgcacuguugggcuucauuaugugggccugccagaaagggaauauccgguguaacauaugcauuuga

SEQ ID NO: 135109 - RNA, 1701 nt, Artificial Sequence; identical to SEQ ID NO: 134457
  derived and/or modified sequence opt3 from hemagglutinin__InfluenzaA__ALA08623

SEQ ID NO: 135110 - RNA, 1701 nt, Artificial Sequence; identical to SEQ ID NO: 135063
  derived and/or modified sequence opt3 from hemagglutinin__InfluenzaA__ALA08624

SEQ ID NO: 135111 - RNA, 1701 nt, Artificial Sequence; identical to SEQ ID NO: 134457
  derived and/or modified sequence opt3 from hemagglutinin__InfluenzaA__ALA08625

SEQ ID NO: 135112 - RNA, 1701 nt, Artificial Sequence; identical to SEQ ID NO: 134457
  derived and/or modified sequence opt3 from hemagglutinin__InfluenzaA__ALA08626

SEQ ID NO: 135113 - RNA, 1701 nt, Artificial Sequence; identical to SEQ ID NO: 134457
  derived and/or modified sequence opt3 from hemagglutinin__InfluenzaA__ALA08627

SEQ ID NO: 135114 - RNA, 1701 nt, Artificial Sequence; identical to SEQ ID NO: 135001
  derived and/or modified sequence opt3 from hemagglutinin__InfluenzaA__ALA08629

SEQ ID NO: 135115 - RNA, 1701 nt, Artificial Sequence
  derived and/or modified sequence opt3 from hemagglutinin__InfluenzaA__ALA08630
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuauacuuacccagcauuaaaugugaccaugcccaacaacgagcaguuugacaagcuguauauuuggggaguccaccauccuggcacagauaaagaccagaucuuccuuuacgcccguucuuccggcagaauaacugugucaaccaagaggagccagcaagcuguaauuccaaauaucgggagucggccccgcauuagagauaucccuucuaggaucuccauuuacuggacaauaguuaaaccaggagacaucuugcugauuaacagcaccgguaaucuaaucgccccgcggggcuauuuuaagauacgcucggggaaaucuuccauuaugcgaucagacgcgcccaucggaaaguguaagagugaaugcaucacgccuaacggcagcauuccaaaugauaaacccuuccagaacgugaauagaaucacuuacggugcauguccuagguaugucaagcacuccacacucaaacuggccaccgggaugcggaacgugccagagaagcagacucguggaauuuuuggcgcuauagccggcuucaucgaaaaugggugggagggaaugguggacgguugguacggcuuucgccaccagaacucugaggggagaggacaagcagcugaucuuaaaagcacacaggccgcgauugaccagaucaauggcaagcugaacagguugaucgguaaaaccaaugaaaaguuccaucaaauugagaaggaauuuucagaggucgaagggcggauacaggaucucgagaaauauguugaggacacgaagaucgaucuguggaguuacaacgccgaauuacugguggcacucgagaaucagcacaccauugaccuuacagauuccgaaaugaacaaacuguuugagaagacuaaaaagcaguugcgagaaaacgcugaggacaugggcaauggaugcuucaagaucuaucauaaaugugauaacgccugcauuggcagcauccgcaaugggaccuacgaccacaacguauacagagacgaggcucuaaauaacagguuucaaauaaagggaguggaacugaaaucugguuauaaggauuggauccucuggauuucauucgccaucaguugcuuucugcuuugugucgcacuguugggcuucauuaugugggccugccagaaagggaauauccgguguaacauaugcauuuga

SEQ ID NO: 135116 - RNA, 1701 nt, Artificial Sequence
  derived and/or modified sequence opt3 from hemagglutinin__InfluenzaA__ALA08631
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaaggagcaguuugacaagcuguauauuuggggaguccaccauccuggcacagauaaagaccagaucuuccuuuacgcccagucuuccggcagaauaacugugucaaccaagaggagccaacaggcuguaauuccaaacaucgggagucggccccgcauuagagauaucccuucuaggaucuccauuuacuggacaauaguuaaaccaggagacaucuugcugauuaauagcaccgguaaccuaaucgccccgcggggcuauuuuaagauacgcucggggaaaucuuccauuaugcgaucagacgcgcccaucggaaaguguaagagugaaugcaucacgccuaauggcagcauuccaaacgauaaacccuuccagaaugugaacagaaucacuuacggugcauguccuagguaugucaagcacuccacacucaaacuggccaccgggaugcggaaugugccagagaagcagacucguggaauuuuuggcgcuauagccggcuucaucgaaaacgggugggagggaaugguggacgguugguacggcuuucgccaccaaaauucugaggggagaggacaggcagcugaucuuaaaagcacacaggccgcgauugaccaaaucaacggcaagcugaauagguugaucgguaaaaccaacgaaaaguuccaucagauugagaaggaauuuucagaggucgaagggcggauacaggaucucgagaaauauguugaggacacgaagaucgaucuguggaguuacaaugccgaauuacugguggcacucgagaaccagcacaccauugaccuuacagauuccgaaaugaauaaacuguuugagaagacuaaaaagcaauugcgagaaaacgcugaggacaugggcaacggaugcuucaagaucuaucauaaaugugauaaugccugcauuggcagcauccgcaacgggaccuacgaccacaauguauacagagacgaggcucuaaacaauagguuucagauaaagggaguggaacugaaaucugguuauaaggauuggauccucuggauuucauucgccaucaguugcuuucugcuuugugucgcacuguugggcuucauuaugugggccugccagaaagggaacauccgguguaauauaugcauuuga

SEQ ID NO: 135117 - RNA, 1701 nt, Artificial Sequence
  derived and/or modified sequence opt3 from hemagglutinin__InfluenzaA__ALA08632
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaagggagccaacaggcuguaauuccaaauguuggaaguaggccccggauccgcgauauuccuucuagaaucuccaucuacuggacaauugugaagccaggugacauauugcugaucaacagcaccggcaaucuaauugccccgaggggguauuuuaaaauccggucgggaaagucuuccauaaugcgcucagacgcgcccauuggcaaauguaagagugaaugcaucacgccuaacgguagcaucccaaaugauaagcccuuccagaacgucaaucgaauuacuuacggggcauguccuagauaugugaaacacuccacacucaagcuggccaccggaaugaggaacgugccagagaaacagacucggggcaucuuuggcgcuauugccggguucauagaaaauggaugggaggguauggucgacggcugguacggguuucgucaccaaaacucugagggacgcggccaggcagcugaucuuaagagcacacaggccgcgaucgaccaaauuaaugguaaacugaacagauugaucgggaagaccaaugaaaaauuccaucagaucgagaaggaauuuucagagguugaaggcaggauucaggaucucgagaaguauguggaggacacgaaaauagaucuguggaguuacaacgccgaauuacugguagcacucgagaaucagcacaccaucgaccuuacagauuccgaaaugaacaagcuguuugagaaaacuaagaaacaauugcgggaaaacgcugaggacaugggaaauggcugcuucaagauuuaucauaagugugauaacgccugcaucgggagcauucgaaauggaaccuacgaccacaacguguaccgcgacgaggcucuaaauaacagauuucagaucaaaggugucgaacugaagucuggcuauaaagauuggauacucuggaucucauucgccauuaguugcuuucugcuuuguguggcacuguugggguucaucaugugggccugccagaagggaaauauuagguguaacaucugcauauga

SEQ ID NO: 135118 - RNA, 1701 nt, Artificial Sequence; identical to SEQ ID NO: 135014
  derived and/or modified sequence opt3 from hemagglutinin__InfluenzaA__ALA08634

SEQ ID NO: 135119 - RNA, 1701 nt, Artificial Sequence; identical to SEQ ID NO: 134457
  derived and/or modified sequence opt3 from hemagglutinin__InfluenzaA__ALA08635

SEQ ID NO: 135120 - RNA, 1701 nt, Artificial Sequence
  derived and/or modified sequence opt3 from hemagglutinin__InfluenzaA__ALA08636
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaauccaccauccuggcacagauaaggaccagauauuccuuuacgcccagucuuccggcagaauuacugucucaaccaaaaggagccaacaggcugugaucccaaauauugggagucggccccgcaucagagauaucccuucuaggauuuccauauacuggacaaucguaaagccaggagacauuuugcugaucaacagcaccgguaaucuaauagccccgcggggcuauuuuaaaauucgcucggggaagucuuccaucaugcgaucagacgcgcccaucggaaaauguaagagugaaugcauuacgccuaacggcagcaucccaaaugauaagcccuuccagaacguuaauagaauuacuuacggugcauguccuagguaugugaaacacuccacacucaagcuggccaccgggaugcggaacgucccagagaaacagacucguggaauauuuggcgcuaucgccggcuucauugaaaaugggugggagggaaugguggacgguugguacggcuuucgccaccaaaacucugaggggagaggacaggcagcugaucuuaagagcacacaggccgcgaucgaccaaaucaauggcaaacugaacagguugauugguaagaccaaugaaaaauuccaucagauagagaaggaauuuucagagguggaagggcggauccaggaucucgagaaguaugucgaggacacgaaaauugaucuguggaguuacaacgccgaauuacugguugcacucgagaaucagcacaccaucgaccuuacagauuccgaaaugaacaagcuguuugagaaaacuaagaaacaauugcgagaaaacgcugaggacaugggcaauggaugcuucaagauuuaucauaagugugauaacgccugcaucggcagcauacgcaaugggaccuacgaccacaacguguacagagacgaggcucuaaauaacagguuucagaucaaaggaguagaacugaagucugguuauaaagauuggauucucuggaucucauucgccauuaguugcuuucugcuuuguguggcacuguugggcuucaucaugugggccugccagaaggggaauauacgguguaacauuugcaucuga

SEQ ID NO: 135121 - RNA, 1701 nt, Artificial Sequence; identical to SEQ ID NO: 135014
  derived and/or modified sequence opt3 from hemagglutinin__InfluenzaA__ALA08637

SEQ ID NO: 135122 - RNA, 1701 nt, Artificial Sequence
  derived and/or modified sequence opt3 from hemagglutinin__InfluenzaA__ALA08638
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcggaagcaauuccucauuuuucagucgacugaacuggcugacgcauagcaauuuuaaguauccagcacucaacgugacuaugcccaacaaugagcaguucgacaaguuauacauuuggggcguccaccauccuggcaccgauaaagaccagaucuuucuguaugcccagucuuccgggcguauaacagugucaacuaagagaagccaacaggcuguaauuccaaacaucggaaguaggccccggauucgcgauaucccuucuagaaucuccauuuacuggaccauaguuaaaccaggugacauccuuuugauuaauagcacaggcaaccugaucgccccgaggggguacuucaagauacggucgggaaaaucuuccauuaugcgcucagacgcgcccaucggcaaguguaagagugaaugcaucaccccuaaugguagcauuccaaacgauaaacccuuucagaaugugaaccgaaucacguauggggcauguccuagauacgucaagcacuccacucuaaaacucgccacaggaaugaggaaugugccagagaagcagacccggggcauuuucggcgcuauagccggguuuaucgaaaacggaugggaggguaugguggacggcugguauggguuccgucaccaaaauucugagggacgcggccaggcagcugaucugaaaagcacucaggccgcgauugaccaaaucaacgguaaacuuaauagacugaucgggaaaacaaacgaaaaguuccaucagauugagaaggaauuuucagaggucgaaggcaggauacaggauuuggagaaauacguugaggacaccaagaucgaucucuggaguuauaaugccgaacuguuaguggcacuggagaaccagcacacgauugaccucaccgauuccgaaaugaacaaacuuuucgagaagacaaagaagcaacugcgggaaaaugcugaggacaugggaaacggcugcuuuaagaucuaccauaaaugugauaaugccugcauugggagcauccgaaacggaacuuaugaccacaauguauaccgcgacgaggcuuugaacaauagauuccagauaaaggguguggaacuaaaaucuggcuacaaggauuggauccuguggauuucauuugccaucaguugcuuccuccugugugucgcacuucugggguuuauuaugugggccugccagaaaggaaacaucagguguaauauaugcauuuga

SEQ ID NO: 135123 - RNA, 1701 nt, Artificial Sequence; identical to SEQ ID NO: 135014
  derived and/or modified sequence opt3 from hemagglutinin__InfluenzaA__ALA08639

SEQ ID NO: 135124 - RNA, 1701 nt, Artificial Sequence; identical to SEQ ID NO: 135014
  derived and/or modified sequence opt3 from hemagglutinin__InfluenzaA__ALA08640

SEQ ID NO: 135125 - RNA, 1701 nt, Artificial Sequence; identical to SEQ ID NO: 135014
  derived and/or modified sequence opt3 from hemagglutinin__InfluenzaA__ALA08641

SEQ ID NO: 135126 - RNA, 1701 nt, Artificial Sequence; identical to SEQ ID NO: 135014
  derived and/or modified sequence opt3 from hemagglutinin__InfluenzaA__ALA08642

SEQ ID NO: 135127 - RNA, 1701 nt, Artificial Sequence; identical to SEQ ID NO: 135014
  derived and/or modified sequence opt3 from hemagglutinin__InfluenzaA__ALA08643

SEQ ID NO: 135128 - RNA, 1701 nt, Artificial Sequence; identical to SEQ ID NO: 134457
  derived and/or modified sequence opt3 from hemagglutinin__InfluenzaA__ALA08644

SEQ ID NO: 135129 - RNA, 1701 nt, Artificial Sequence
  derived and/or modified sequence opt3 from hemagglutinin__InfluenzaA__ALA08645
augaagaccaucauugcccugagcuacauacucugccuuguguucgcucagaaacugcccgagaacgacaauuccacagcaacuuuguguuuaggccaccaugccgucccuaacgggacgaucguuaagaccauuacaucugauagaaucgaagugacuaaugcgaccgagcugguacaaaacucaaguauuggagaaaucugcgacagcccacaccagauacuagaugguaaaaauuguacacucaucgacgcucugcuuggcgauccgcagugcgacggguuucagaacaagaaaugggaucuguucguggagagguccaaggccuauucuaauuguuaccccuaugacgucccugauuacgcaucguugcggucacucguggccagcaguggaacccuggaauuuaacgacgaguccuucaauugggcuggcguuacucaaaacgguacaucuagcgcaugcauucgcggguccaauucaaguuucuuuagccgacugaacuggcucacccauucuaauuuuaaguauccagccuuaaacgugacgaugcccaauaacgagcaguucgauaaacuguacaucuggggaguccaccauccuggcacugacaaggaucagauuuuucuuuaugcucaguccucaggccguaucaccgugagcacaaaaagaagucaacaggccguaauaccaaacauugggucuaggccccggauccgcaauauuccuuccagaaucagcaucuacuggacuauuguuaagccaggagacauauugcugaucaacucgaccgguaaucuaauugcgccgaggggcuacuucaaaauccggucugggaaguccucaauaaugcgcagugacgcacccauuggaaaguguaaaagcgaaugcaucacaccuaacggcuccaucccaaaugauaagcccuuucagaacgugaaucgaauuaccuauggugccuguccuagauacgucaaacagucuacgcucaagcuggcuacugggaugaggaacgugccagagaaacaaacacggggaaucuucggcgccauugcaggcuuuauagaaaaugggugggagggaaugaaggacgguugguauggcuuccgucaccagaacagcgaggggcgcggacaggcugccgaucuuaaaucaacccaagcggccaucgaccagauuaauggcaagcugaacagauugaucgguaagacuaaugaaaaauuccaccagaucgagaaggaauuuagugagguggaagggaggauucaggaucucgagaaauacgucgaggacacaaagauagauaucugguccuauaacgcagaacuguuaguugcucuggagaaucaacauaccauugaccucacggauagcgaaaugaacaaacuuuucgagaagaccaagaaacagcugcgggaaaacgccgaggacaugggcaauggaugcuuuaagaucuaccacaaaugugauaacgcuugcauuggcucuauccgaaaugggacauaugaccaugacguguaccgcgaugaggccuugaacaauagauuccagauaaagggaguagaacuaaaaucagguuacaaggacuggauccuguggauuaguuuugcaaucagcugcuuccuccuguguguggcccuucugggcuuuauuaugugggcuugccagaaggggaacaucagguguaauauaugcauuuga

SEQ ID NO: 135130 - RNA, 1701 nt, Artificial Sequence; identical to SEQ ID NO: 134457
  derived and/or modified sequence opt3 from hemagglutinin__InfluenzaA__ALA08646

SEQ ID NO: 135131 - RNA, 1701 nt, Artificial Sequence; identical to SEQ ID NO: 134457
  derived and/or modified sequence opt3 from hemagglutinin__InfluenzaA__ALA08647

SEQ ID NO: 135132 - RNA, 1701 nt, Artificial Sequence; identical to SEQ ID NO: 135014
  derived and/or modified sequence opt3 from hemagglutinin__InfluenzaA__ALA08648

SEQ ID NO: 135133 - RNA, 1701 nt, Artificial Sequence
  derived and/or modified sequence opt3 from hemagglutinin__InfluenzaA__ALA08650
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugagagaauugaagugacuaacgcgaccgaguuaguacaaaauucuucaaucggugaaauaugcgauaguccacaccagauccuggacggcgagaacuguacacuaauugaugcucuccugggggacccgcagugcgauggauuucagaauaaaaagugggaccuuuucguggaaaggagcaaagccuauuccaacuguuaccccuaugaugucccugacuacgcaucucugcggucguugguggccucaagcggcacccucgaguuuaauaacgagaguuucaauuggacugguguuacacaaaacgggaccuccucugcuugcauccgccgaagcuccucaaguuucuuuagccgucugaauuggcugacgcaucucaacuauacuuacccagcauuaaaugugaccaugcccaacaacgaacaguuugauaagcuguauauuuggggaguccaccauccuggcacagacaaggaucagaucuuccuuuacgcccagucuuccggcagaauaacugugucaaccaaaaggagccaacaggcuguaauuccaaauaucgggagucggccccgcauuagagacaucccuucuaggaucuccauuuacuggacaauaguuaagccaggagauaucuugcugauuaacagcaccgguaaucuaaucgccccgcggggcuauuuuaaaauacgcucggggaagucuuccauuaugcgaucagacgcgcccaucggaaaauguaagagugagugcaucacgccuaacggcagcauuccaaaugacaagcccuuccagaacgugaauagaaucacuuacggugcauguccuagguaugucaaacacuccacacucaagcuggccaccgggaugcggaacgugccagaaaaacagacucguggaauuuuuggcgcuauagccggcuucaucgagaaugggugggagggaaugguggaugguugguacggcuuucgccaccaaaacucugaagggagaggacaggcagcugaccuuaagagcacacaggccgcgauugaucaaaucaauggcaaacugaacagguugaucgguaagaccaaugagaaauuccaucagauugaaaaggaguucucagaagucgaggggcggauacaggaccucgagaaguauguugaagauacgaaaaucgaccuguggaguuacaacgccgaguuacugguggcacucgaaaaucagcacaccauugaucuuacagacuccgagaugaacaagcuguuugagaaaacuaagaaacaauugcgagaaaacgcugaggauaugggcaauggaugcuucaagaucuaucauaagugugacaacgccugcauuggcagcauccgcaaugggaccuacgaucacaacguauacagagacgaagcucuaaauaacagguuucagauaaaaggaguggagcugaagucugguuauaaagacuggauccucuggauuucauucgccaucaguugcuuucugcuuugugucgcacuguugggcuucauuaugugggccugccagaaggggaauauccgguguaacauaugcauuuga

SEQ ID NO: 135134 - RNA, 1701 nt, Artificial Sequence; identical to SEQ ID NO: 135014
  derived and/or modified sequence opt3 from hemagglutinin__InfluenzaA__ALA08652

SEQ ID NO: 135135 - RNA, 1701 nt, Artificial Sequence; identical to SEQ ID NO: 134457
  derived and/or modified sequence opt3 from hemagglutinin__InfluenzaA__ALA08653

SEQ ID NO: 135136 - RNA, 1701 nt, Artificial Sequence
  derived and/or modified sequence opt3 from hemagglutinin__InfluenzaA__ALA08654
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacucaagcuggccaccgggaugcggaacgugccagagaaacagacucguggaauuuuuggcgcuauagccggcuucaucgaaaaugggugggagggaaugguggacgguugguacggcuuucgccaccaaaacucugaggggagaggacaggcagcugaucuuaagagcacacaggccgcgauugaccaaaucaauggcaaacugaacagguugaucgguaagaccaaugaaaaauuccaucagauugagaaggaauuuucagaggucgaagggcggauacaggaucucgagaaguauguugaggacacgaaaaucgaucuguggaguuacaacgccgaauuacugguggcacucgagaaucagcacaccauugaccuuacagauuccgaaaugaacaagcuguuugagaaaacuaagaaacaauugcgagaaaacgcugaggacaugggcaauggaugcuucaagaucuaucauaagugugauaacgccugcauuggcagcauccgcaaugggaccuacgaccacaacguauacagagacgaggcucuaaauaacagguuucagauaaaaggaguggaacugaagucugguuauaaagauuggauccucuggauuucauucgccaagaguugcuuucugcuuugugucgcacuguugggcuucaucaugugggccugccagaaagggaauauucgguguaacaucugcauauga

SEQ ID NO: 135137 - RNA, 1701 nt, Artificial Sequence; identical to SEQ ID NO: 135014
  derived and/or modified sequence opt3 from hemagglutinin__InfluenzaA__ALA08655

SEQ ID NO: 135138 - RNA, 1701 nt, Artificial Sequence; identical to SEQ ID NO: 135014
  derived and/or modified sequence opt3 from hemagglutinin__InfluenzaA__ALA08656

SEQ ID NO: 135139 - RNA, 1701 nt, Artificial Sequence
  derived and/or modified sequence opt3 from hemagglutinin__InfluenzaA__ALA08657
augaagaccaucauugcccugagcuacauacucugccuuguguucgcucagaaacugcccgagaacgacaauuccacagcaacuuuguguuuaggccaccaugccgucccuaacgggacgaucguuaagaccauuacaucugauagaaucgaagugacuaaugcgaccgagcugguacaaaacucaaguauuggagaaaucugcgacagcccacaccagauacuagaugguaaaaauuguacacucaucgacgcucugcuuggcgauccgcagugcgacggguuucagaacaagaaaugggaucuguucauugagagguccaaggccuauucuaauuguuaccccuaugacgugccugauuacgcaucguugcggucacucgucgccagcaguggaacccuggaauuuaacgacgaguccuucaauugggcuggcgugacucaaaacgguacaucuagcgcaugcauccgcggguccaauucaaguuucuuuagccgacugaacuggcucacccauucuaauuuuaaguauccagccuuaaacguuacgaugcccaauaacgagcaguucgauaaacuguacauuuggggagugcaccauccuggcacugacaaggaucagaucuuucuuuaugcucaguccucaggccguauaaccgucagcacaaaaagaagucaacaggccgugauuccaaacaucgggucuaggccccggauucgcaauaucccuuccagaaucagcauuuacuggacuauaguaaagccaggagacaucuugcugauuaacucgaccgguaaucuaaucgcgccgaggggcuacuucaaaauacggucugggaaguccucaauuaugcgcagugacgcacccaucggaaaguguaaaagcgaaugcaucacaccuaacggcuccauuccaaaugauaagcccuuucagaacguuaaucgaaucaccuauggugccuguccuagauacgugaaacagucuacgcucaagcuggcuacugggaugaggaacgucccagagaaacaaacacggggaauuuucggcgccauagcaggcuuuaucgaaaaugggugggagggaaugaaggacgguugguauggcuuccgucaccagaacagcgaggggcgcggacaggcugccgaucuuaaaucaacccaagcggccauugaccagaucaauggcaagcugaacagauugaucgguaagacuaaugaaaaauuccaccagauugagaaggaauuuagugagguggaagggaggauacaggaucucgagaaauacguggaggacacaaagaucgaucugugguccuauaacgcagaauuacuggucgcucucgagaaucaacauaccauugaccuuacggauagcgaaaugaacaaacuguucgagaagaccaagaaacaguugcgggaaaacgccgaggacaugggcaauggaugcuuuaagaucuaccacaaaugugauaacgcuugcauuggcucuauccgaaaugggacauaugaccaugacguuuaccgcgaugaggcccuaaacaauagauuccagauaaagggaguggaacugaaaucagguuacaaggacuggauccucuggauuaguuuugcaaucagcugcuuccugcuuuguguagcccuguugggcuuuauuaugugggcuugccagaaggggaacaucagguguaauauaugcauuuga

SEQ ID NO: 135140 - RNA, 1701 nt, Artificial Sequence; identical to SEQ ID NO: 135014
  derived and/or modified sequence opt3 from hemagglutinin__InfluenzaA__ALA08658

SEQ ID NO: 135141 - RNA, 1701 nt, Artificial Sequence; identical to SEQ ID NO: 135001
  derived and/or modified sequence opt3 from hemagglutinin__InfluenzaA__ALA08659

SEQ ID NO: 135142 - RNA, 1701 nt, Artificial Sequence
  derived and/or modified sequence opt3 from hemagglutinin__InfluenzaA__ALA08660
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacgggacacucaagcuggccaccggaaugcggaacgugccagagaaacagacucguggcauuuuuggcgcuauagccggguucaucgaaaauggaugggaggguaugguggacggcugguacggguuucgccaccaaaacuccgagggaagaggccaggcagcugaucuuaagucuacacaggccgcgauugaccaaaucaaugguaaacugaacagguugaucgggaagaccaaugaaaaauuccaucagauugagaaggaauuuagcgaggucgaaggccggauacaggaucucgagaaguauguugaggacacgaaaaucgaucuguggucauacaacgccgaauuacugguggcacucgagaaucagcacaccauugaccuuacagauagugaaaugaacaagcuguuugagaaaacuaagaaacaauugcgagaaaacgcugaggacaugggaaauggcugcuucaagaucuaucauaagugugauaacgccugcauuggguccauccgcaauggaaccuacgaccacaacguauacagagacgaggcucuaaauaacagguuucagauaaaagguguggaacucaagagcggcuauaaagauuggauccuguggauuucuuucgccaucucaugcuuucugcuuugugucgcacuguugggguucauuaugugggccugccagaagggaaauauccgguguaacauaugcauuuga

SEQ ID NO: 135143 - RNA, 1701 nt, Artificial Sequence
  derived and/or modified sequence opt3 from hemagglutinin__InfluenzaA__ALA08662
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacucucggggaagucuuccauuaugcgcucagacgcgcccaucggaaaauguaagagugaaugcaucacgccuaacggcagcauuccaaaugauaagcccuuccagaacgugaaucgaaucacuuacggugcauguccuagauaugucaaacacuccacacugaagcuggccaccgggaugaggaacgugccagagaaacagacucggggaauuuuuggcgcuauagccggcuucaucgaaaaugggugggagggaaugguggacgguugguacggcuuucgucaccaaaacucugaggggcgcggacaggcagcugaucuuaagagcacacaggccgcgauugaccaaaucaauggcaaauugaacagacucaucgguaagaccaaugaaaaauuccaucagauugagaaggaauuuucagaggucgaagggaggauacaggaucuggagaaguauguugaggacaguaaaaucgauuuaugguccuacaacgccgaacugcucguggcacuugagaaucagcacacgauugaccugaccgauagcgaaaugaacaaguuguuugagaaaacaaagaaacaacuacgggaaaacgcugaggacaugggcaauggaugcuucaagaucuaucauaagugugauaacgccugcauuggcucuauccgaaaugggacuuacgaccacaacguauaccgcgacgaggcucugaauaacagauuucagauaaaaggaguggaacucaagucagguuauaaagauuggauccuguggauuaguuucgccaucagcugcuuucuucugugugucgcauugcucggcuucauuaugugggccugccagaaggggaauaucagguguaacauaugcauuuga

SEQ ID NO: 135144 - RNA, 1701 nt, Artificial Sequence; identical to SEQ ID NO: 135115
  derived and/or modified sequence opt3 from hemagglutinin__InfluenzaA__ALA08663

SEQ ID NO: 135145 - RNA, 1701 nt, Artificial Sequence; identical to SEQ ID NO: 135143
  derived and/or modified sequence opt3 from hemagglutinin__InfluenzaA__ALA08665

SEQ ID NO: 135146 - RNA, 1701 nt, Artificial Sequence
  derived and/or modified sequence opt3 from hemagglutinin__InfluenzaA__ALA08666
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggauucaggaccuggagaaauacguugaggauacaaagauagacuuauggucauauaacgcagaacugcucguggcucuugagaaccaacauaccaucgaucugacggacagugaaaugaauaaauuguucgagaagaccaaaaagcagcuacgggaaaacgccgaggauaugggaaauggcugcuuuaagauuuaccacaaaugugacaacgcuugcaucggguccauucgaaauggaacauaugaucaugacguauaccgcgacgaggcccugaacaauagauuccagaucaaggguguggaacucaaaagcggcuacaaggauuggauacuguggaucucuuuugcaaugucaugcuuccuucugugugucgccuugcucggguuuauuaugugggcuugccagaaaggaaacaucagguguaauauuugcaucuga

SEQ ID NO: 135147 - RNA, 1701 nt, Artificial Sequence
  derived and/or modified sequence opt3 from hemagglutinin__InfluenzaA__ALA08667
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuauaaguacccagcauuaaaugugacuaugcccaacaacgagcaguuugacaaacuguauauuuggggaguccaccauccuggcaccgauaaggaccagaucuuccuuuacgcccguucuuccggcagaauaacagugucaacuaaaaggagccagcaagcuguaauuccaaauaucgggagucggccccgcauuagagauaucccuucuaggaucuccauuuacuggaccauaguuaagccaggagacaucuugcugauuaacagcacagguaaucuaaucgccccgcggggcuauuuuaaaauacgcucggggaagucuuccauuaugcgaucagacgcgcccaucggaaaguguaaaagugaaugcaucaccccuaacggcagcauuccaaaugauaagcccuuccagaacgugaauagaaucacguacggugcauguccuagguaugucaaacacuccacucucaagcuggccacagggaugcggaacgugccagagaaacagacccguggaauuuuuggcgcuauagccggcuucaucgaaaaugggugggagggaaugguggacgguugguacggcuuucgccaccagaacucugaggggagaggacaagcagcugaucuuaagagcacucaggccgcgauugaccagaucaauggcaaacugaacagguugaucgguaagacaaaugaaaaguuccaucaaauugagaaagaauuuucagaggucgaagggcggauacaggaucucgagaaguauguugaggacaccaaaaucgaucuguggaguuacaacgccgaauuacugguggcacucgagaaucagcacacgauugaccuuaccgauuccgaaaugaacaagcuguuugagaaaacaaagaagcaguugcgagaaaacgcugaggacaugggcaauggaugcuucaaaaucuaucauaagugugauaacgccugcauuggcagcauccgcaaugggacuuacgaccacaacguauacagagacgaggcucuaaauaacagguuucaaauaaaaggaguggaacugaagucugguuauaaagauuggauccucuggauuucauucgccaucaguugcuuucugcuuugugucgcacuguugggcuucauuaugugggccugccagaaggggaauauccgguguaacauaugcauuuga

SEQ ID NO: 135148 - RNA, 1701 nt, Artificial Sequence
  derived and/or modified sequence opt3 from hemagglutinin__InfluenzaA__ALA08668
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacucaagcuggccaccgggaugcggaacgugccagagaaacagacucguggaauuuuuggcgcuauagccggcuucaucgaaaaugggugggagggaaugguggacgguugguacggcuuucgccaccaaaacucugaggggagaggacaggcagcugaucuuaagagcacacaggccgcgauugaccaaaucaauggcaaacugaacagguugaucgguaagaccaaugaaaaauuccaucagauugagaaggaauuuucagaggucgaagggcggauacaggaucucgagaaguauguugaggacacgaaaaucgaucuguggaguuacaacgccgaauuacugguggcacucgagaaucagcacaccauugaccuuacagauuccgaaaugaacaagcuguuugagaaaacuaagaaacaauugcgagaaaacgcugaggacaugggcaauggaugcuucaagaucuaucauaagugugauaacgccugcauuggcagcauccgcaaugggaccuacgaccacaacguauacagagacgaggcuauaaauaacagguuucagaucaaaggaguggaacuaaagucugguuauaaagauuggauucuguggaucucauucgccauuaguugcuuucuccugugugucgcacuucugggcuucaucaugugggccugccagaaggggaauauacgguguaacauuugcaucuga

SEQ ID NO: 135149 - RNA, 1701 nt, Artificial Sequence; identical to SEQ ID NO: 135115
  derived and/or modified sequence opt3 from hemagglutinin__InfluenzaA__ALA08669

SEQ ID NO: 135150 - RNA, 1701 nt, Artificial Sequence; identical to SEQ ID NO: 135008
  derived and/or modified sequence opt3 from hemagglutinin__InfluenzaA__ALA08670

SEQ ID NO: 135151 - RNA, 1701 nt, Artificial Sequence; identical to SEQ ID NO: 135115
  derived and/or modified sequence opt3 from hemagglutinin__InfluenzaA__ALA08671

SEQ ID NO: 135152 - RNA, 1701 nt, Artificial Sequence; identical to SEQ ID NO: 135115
  derived and/or modified sequence opt3 from hemagglutinin__InfluenzaA__ALA08672

SEQ ID NO: 135153 - RNA, 1701 nt, Artificial Sequence; identical to SEQ ID NO: 135008
  derived and/or modified sequence opt3 from hemagglutinin__InfluenzaA__ALA08673

SEQ ID NO: 135154 - RNA, 1701 nt, Artificial Sequence; identical to SEQ ID NO: 135115
  derived and/or modified sequence opt3 from hemagglutinin__InfluenzaA__ALA08674

SEQ ID NO: 135155 - RNA, 1701 nt, Artificial Sequence; identical to SEQ ID NO: 134457
  derived and/or modified sequence opt3 from hemagglutinin__InfluenzaA__ALA08675

SEQ ID NO: 135156 - RNA, 1701 nt, Artificial Sequence; identical to SEQ ID NO: 135115
  derived and/or modified sequence opt3 from hemagglutinin__InfluenzaA__ALA08676

SEQ ID NO: 135157 - RNA, 1701 nt, Artificial Sequence; identical to SEQ ID NO: 135115
  derived and/or modified sequence opt3 from hemagglutinin__InfluenzaA__ALA08677

SEQ ID NO: 135158 - RNA, 1701 nt, Artificial Sequence; identical to SEQ ID NO: 135115
  derived and/or modified sequence opt3 from hemagglutinin__InfluenzaA__ALA08678

SEQ ID NO: 135159 - RNA, 1701 nt, Artificial Sequence; identical to SEQ ID NO: 135115
  derived and/or modified sequence opt3 from hemagglutinin__InfluenzaA__ALA08679

SEQ ID NO: 135160 - RNA, 1701 nt, Artificial Sequence; identical to SEQ ID NO: 135115
  derived and/or modified sequence opt3 from hemagglutinin__InfluenzaA__ALA08680

SEQ ID NO: 135161 - RNA, 1701 nt, Artificial Sequence; identical to SEQ ID NO: 135014
  derived and/or modified sequence opt3 from hemagglutinin__InfluenzaA__ALA08681

SEQ ID NO: 135162 - RNA, 1701 nt, Artificial Sequence; identical to SEQ ID NO: 135093
  derived and/or modified sequence opt3 from hemagglutinin__InfluenzaA__ALA08682

SEQ ID NO: 135163 - RNA, 1701 nt, Artificial Sequence; identical to SEQ ID NO: 135014
  derived and/or modified sequence opt3 from hemagglutinin__InfluenzaA__ALA08683

SEQ ID NO: 135164 - RNA, 1701 nt, Artificial Sequence
  derived and/or modified sequence opt3 from hemagglutinin__InfluenzaA__ALA08684
augaagaccaucauugcccugagccacauacucugccuuguguucgcucagaaaauccccggcaacgacaauuccacagcaacucuguguuuggggcaucacgccgucccuaacggaacgauuguuaagaccaucacaaaugauagaauugaggugacuaacgcgaccgaauuaguacaaaauucuucaaucggugagauaugcgacaguccacaucagauccuggauggcgaaaacuguacacuaauugacgcucuccugggggauccgcagugcgacggauuucagaauaaaaagugggaucuuuucguggagaggagcaaagccuacuccaacuguuaucccuacgacgucccugauuaugcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaccucaacuacaaguauccagcauuaaaugugacuaugcccaacaacgagcaguuugacaagcuguacauuuggggaguccaucacccuggcaccgauaaagaccagaucuuccuuuaugcccagucuuccggcagaauaacagugucaacuaaggggagccaacaggcuguaauuccaaauaucggaaguaggccccggauucgcgauaucccuucuagaaucuccauuuacuggaccauaguuaaaccaggugacaucuugcugauuaacagcacaggcaaucuaaucgccccgaggggguacuuuaagauacggucgggaaaaucuuccauuaugcgcucagacgcgcccaucggcaaguguaagagugaaugcaucaccccuaacgguagcauuccaaaugauaaacccuuccagaacgugaaucgaaucacguauggggcauguccuagauacgucaagcacuccacucucaaacuggccacaggaaugaggaacgugccagagaagcagacccggggcauuuuuggcgcuauagccggguucaucgaaaauggaugggaggguaugguggacggcugguauggguuucgucaucaaaacucugagggacgcggccaggcagcugaucuuaaaagcacucaggccgcgauugaccaaaucaaugguaagcugaacagauugaucgggaaaacaaaugaaaaguuccaccagauugagaaggaauuuucagaggucgaaggcaggauacaggaucucgagaaauacguugaggacaccaagaucgaucuguggaguuauaacgccgaauuacugguggcacucgagaaucagcauacgauugaccuuaccgauuccgaaaugaacaaacuguuugagaagacuaaaaagcaauugcgggaaaacgcugaggacaugggaaauggcugcuucaagaucuaccacaaaugugauaacgccugcauugggagcauccgaaauggaacauaugaccacaacguauaccgcgacgaggcucuaaauaacagauuucagauaaaggguaucgaacugaaaucuggcuacaaggauuggauucucuggaucucauucgccauuaguugcuuucugcuuuguguggcacuguugggguucaucaugugggccugccagaaaggaaauauaagguguaacauuugcaucuga

SEQ ID NO: 135165 - RNA, 1701 nt, Artificial Sequence; identical to SEQ ID NO: 134457
  derived and/or modified sequence opt3 from hemagglutinin__InfluenzaA__ALA08686

SEQ ID NO: 135166 - RNA, 1701 nt, Artificial Sequence
  derived and/or modified sequence opt3 from hemagglutinin__InfluenzaA__ALA08687
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugaucgccucaagcggcacccucgaauuuaauaacgagaguuucaauuggacuggugugacacaaaacgggaccuccucugcuugcauucgccgaagcuccucaaguuucuucagccgucugaauuggcugacgcaucucaacuauacuuacccagcauuaaauguuaccaugcccaacaacgagcaguuugacaagcuguauaucuggggagugcaccauccuggcacagauaaggaccagauauuccuuuacgcccagucuuccggcagaauuacugucucaaccaaaaggagccaacaggcugugaucccaaauauugggagucggccccgcaucagagauaucccuucuaggauuuccauauacuggacaaucguaaagccaggagacauuuugcugaucaacagcaccgguaaucuaauagccccgcggggcuauuuuaaaauucgcucggggaagucuuccaucaugcgaucagacgcgcccaucggaaaauguaagagugaaugcauuacgccuaacggcagcaucccaaaugauaagcccuuccagaacguuaauagaauuacuuacggugcauguccuagguaugugaaacacuccacacucaagcuggccaccgggaugcggaacgucccagagaaacagacucguggaauauuuggcgcuaucgccggcuucauugaaaaugggugggagggaaugguggacgguugguacggcuuucgccaccaaaacucugaggggagaggacaggcagcugaucuuaagagcacacaggccgcgaucgaccaaaucaauggcaaacugaacagguugauugguaagaccaaugaaaaauuccaucagauagagaaggaauuuucagagguggaagggcggauccaggaucucgagaaguaugucgaggacacgaaaauugaucuguggaguuacaacgccgaauuacugguugcacucgagaaucagcacaccaucgaccuuacagauuccgaaaugaacaagcuguuugagaaaacuaagaaacaauugcgagaaaacgcugaggacaugggcaauggaugcuucaagauuuaucauaagugugauaacgccugcaucggcagcauacgcaaugggaccuacgaccacaacguguacagagacgaggcucuaaauaacagguuucagaucaaaggaguagaacugaagucugguuauaaagauuggauucucuggaucucauucgccauuaguugcuuucugcuuuguguggcacuguugggcuucaucaugugggccugccagaaggggaauauacgguguaacauuugcaucuga

SEQ ID NO: 135167 - RNA, 1701 nt, Artificial Sequence; identical to SEQ ID NO: 135108
  derived and/or modified sequence opt3 from hemagglutinin__InfluenzaA__ALA08688

SEQ ID NO: 135168 - RNA, 1701 nt, Artificial Sequence; identical to SEQ ID NO: 134457
  derived and/or modified sequence opt3 from hemagglutinin__InfluenzaA__ALE31612

SEQ ID NO: 135169 - RNA, 1701 nt, Artificial Sequence
  derived and/or modified sequence opt3 from hemagglutinin__InfluenzaA__ALE31613
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaagggagccaacaggcuguaauuccaaauaucggaaguaggccccggauucgcgauaucccuucuagaaucuccauuuacuggacaauaguuaagccaggugacaucuugcugauuagcucgaccggcaaccuaaucgccccgaggggguauuuuaaaauacggucuggaaaguccucaauuaugcgcagugacgcgcccaucggcaaauguaagagcgaaugcaucacgccuaaugguuccauuccaaacgauaagcccuuccagaaugugaaccgaaucacuuacggggcauguccuagauaugucaaacacucuacacucaagcuggccaccggaaugaggaaugugccagagaaacagacucggggcauuuuuggcgcuauagccggguucaucgaaaacggaugggaggguaugguggacggcugguacggguuucgucaccaaaauagcgagggacgcggccaggcagcugaucuuaagucaacacaggccgcgauugaccaaaucaacgguaaacugaauagauugaucgggaagaccaacgaaaaauuccaucagauugagaaggaauuuagugaggucgaaggcaggauacaggaucucgagaaguauguugaggacacgaaaaucgaucugugguccuacaaugccgaauuacugguggcacucgagaaccagcacaccauugaccuuacagauagcgaaaugaauaagcuguuugagaaaacuaagaaacaauugcgggaaaacgcugaggacaugggaaacggcugcuucaagaucuaucauaagugugauaaugccugcauugggucuauccgaaacggaaccuacgaccacaauguauaccgcgacgaggcucuaaacaauagauuucagauaaaagguguggaacugaagucaggcuauaaagauuggauccucuggauuaguuucgccaucagcugccugcuucugugugucgcauugcucggguuuauuaugugggccugccagaagggaaacaucagguguaauauaugcauuuga

SEQ ID NO: 135170 - RNA, 1701 nt, Artificial Sequence
  derived and/or modified sequence opt3 from hemagglutinin__InfluenzaA__ALE31614
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucgguaaaauaugcgacaguccacaccagauccuggauggcgagaacuguacacuaauugacgcucuccugggggauccgcagugcgacggauuucagaauaagaaaugggaucuuuucguggaaaggagcaaggccuauuccaacuguuaccccuaugacgucccugauuacgcaucucugcggucguugguggccucaagcggcacccucgaguuuaauaacgaaaguuucaauuggacugguguuacacaaaacgggaccuccucugcuugcauccgccgaagcuccucaaguuucuuuagccgucugaauuggcugacgcaucucaacuauacuuacccagcauuaaaugugaccaugcccaacaacgagcaguuugacaagcuguauauuuggggaguccaccauccuggcacagauaaagaccagaucuuccuuuacgcccagucuuccggcagaauaacugugucaaccaagaggagccaacaggcuguaauuccaaauaucgggagucggccccgcauuagagauaucccuucuaggaucuccauuuacuggacaauaguuaaaccaggagacaucuugcugauuaacagcaccgguaaucuaaucgccccgcggggcuauuuuaagauacgcucggggaaaucuuccauuaugcgaucagacgcgcccaucggaaaguguaagagugagugcaucacgccuaacggcagcauuccaaaugauaaacccuuccagaacgugaauagaaucacuuacggugcauguccuagguaugucaagcacuccacacucaaacuggccaccgggaugcggaacgugccagaaaagcagacucguggaauuuuuggcgcuauagccggcuucaucgagaaugggugggaaggaaugguggacgguugguacggcuuucgccaccaaaacucugaggggagaggacaggcagcugaucuuaaaagcacacaggccgcgauugaccaaaucaauggcaagcugaacagguugaucgguaaaaccaaugagaaguuccaucagauugaaaaggaguucucagaagucgaggggcggauacaggaucucgaaaaauauguugaggacacgaagaucgaucuguggaguuacaacgccgaguuacugguggcacucgaaaaucagcacaccauugaccuuacagauuccgagaugaacaaacuguuugaaaagacuaaaaagcaauugcgagagaacgcugaagacaugggcaauggaugcuucaagaucuaucauaaaugugauaacgccugcauuggcagcauccgcaaugggaccuacgaccacaacguauacagagacgaggcucuaaauaacagguuucagauaaagggaguggagcugaaaucugguuauaaggauuggauccucuggauuucauucgccaucaguugcuuucugcuuugugucgcacuguugggcuucauuaugugggccugccagaaagggaauauccgguguaacauaugcauuuga

SEQ ID NO: 135171 - RNA, 1701 nt, Artificial Sequence
  derived and/or modified sequence opt3 from hemagglutinin__InfluenzaA__ALE31615
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggauucaggaccuggagaaauacguugaggauacaaagauagacuuauggucauauaacgcagaacugcucguggcucuugagaaccaacauaccaucgaucugacggacagugaaaugaauaaauuguucgagaagaccaaaaagcagcuacgggaaaacgccgaggauaugggaaauggcugcuuuaagauuuaccacaaaugugacaacgcuugcaucgaguccauucgaaaugggacauaugaucaugacguauaccgcgacgaagcccugaacaauagauuccagaucaagggaguggagcucaaaagcgguuacaaggauuggauacuguggaucucuuuugcaauuucaugcuuccuucugugugucgccuugcucggcuuuaucaugugggcuugccagaaagggaacauuagguguaauaucugcauauga

SEQ ID NO: 135172 - RNA, 1701 nt, Artificial Sequence; identical to SEQ ID NO: 134457
  derived and/or modified sequence opt3 from hemagglutinin__InfluenzaA__ALE31616

SEQ ID NO: 135173 - RNA, 1701 nt, Artificial Sequence; identical to SEQ ID NO: 134457
  derived and/or modified sequence opt3 from hemagglutinin__InfluenzaA__ALE31617

SEQ ID NO: 135174 - RNA, 1701 nt, Artificial Sequence; identical to SEQ ID NO: 134457
  derived and/or modified sequence opt3 from hemagglutinin__InfluenzaA__ALE31618

SEQ ID NO: 135175 - RNA, 1701 nt, Artificial Sequence; identical to SEQ ID NO: 135115
  derived and/or modified sequence opt3 from hemagglutinin__InfluenzaA__ALE31619

SEQ ID NO: 135176 - RNA, 1701 nt, Artificial Sequence; identical to SEQ ID NO: 134457
  derived and/or modified sequence opt3 from hemagglutinin__InfluenzaA__ALE31620

SEQ ID NO: 135177 - RNA, 1701 nt, Artificial Sequence
  derived and/or modified sequence opt3 from hemagglutinin__InfluenzaA__ALE31622
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgugcccaucggaaaauguaagagugaaugcaucacgccuaacggcagcauuccaaaugauaagcccuuccagaacgucaauagaaucacuuacggugcguguccuagguaugugaaacacuccacacucaagcuggcaaccgggaugcggaacgugccagagaaacagacucguggaauuuuuggcgccauagcuggcuucaucgaaaaugggugggagggaauggucgacgguugguacggcuuucgccaccaaaacucugaggggagaggacaggccgcagaucuuaagagcacacaggcugccauugaccaaaucaauggcaaacugaacagguugaucgguaagaccaaugaaaaauuccaucagauugagaaggaauuuucagagguugaagggcggauacaggaucucgagaaguauguggaggacacgaaaaucgaucuguggaguuacaacgcggaauuacugguagcccucgagaaucagcacaccauugaccuuacagauuccgaaaugaacaagcuguuugagaaaacuaagaaacaauugcgagaaaacgcagaggacaugggcaauggaugcuucaagaucuaucauaagugugauaacgcuugcauuggcagcauccgcaaugggaccuacgaccacaacguguacagagacgaggcccuaaauaacagguuucagauaaaaggagucgaacugaagucugguuauaaagauuggauccucuggauuucauucgcuaucaguugcuuucugcuuuguguggcccuguugggcuucauuaugugggcaugccagaaggggaauauccgguguaacauaugcauuuga

SEQ ID NO: 135178 - RNA, 1701 nt, Artificial Sequence; identical to SEQ ID NO: 134457
  derived and/or modified sequence opt3 from hemagglutinin__InfluenzaA__ALE31623

SEQ ID NO: 135179 - RNA, 1701 nt, Artificial Sequence; identical to SEQ ID NO: 134457
  derived and/or modified sequence opt3 from hemagglutinin__InfluenzaA__ALE31625

SEQ ID NO: 135180 - RNA, 1701 nt, Artificial Sequence; identical to SEQ ID NO: 134457
  derived and/or modified sequence opt3 from hemagglutinin__InfluenzaA__ALE31626

SEQ ID NO: 135181 - RNA, 1701 nt, Artificial Sequence; identical to SEQ ID NO: 134457
  derived and/or modified sequence opt3 from hemagglutinin__InfluenzaA__ALE31627

SEQ ID NO: 135182 - RNA, 1701 nt, Artificial Sequence; identical to SEQ ID NO: 134457
  derived and/or modified sequence opt3 from hemagglutinin__InfluenzaA__ALE31628

SEQ ID NO: 135183 - RNA, 1701 nt, Artificial Sequence; identical to SEQ ID NO: 134457
  derived and/or modified sequence opt3 from hemagglutinin__InfluenzaA__ALE31629

SEQ ID NO: 135184 - RNA, 1701 nt, Artificial Sequence; identical to SEQ ID NO: 134457
  derived and/or modified sequence opt3 from hemagglutinin__InfluenzaA__ALE31632

SEQ ID NO: 135185 - RNA, 1701 nt, Artificial Sequence
  derived and/or modified sequence opt3 from hemagglutinin__InfluenzaA__ALE31634
augaagaccaucauugcccugagcuacauacucugccuugugcuggcucagaaaauccccggcaacgacaauuccacagcaacuuuguguuuagggcaccaugccgucccuaacggaacgauuguuaagaccaucacaaaugauagaauugaggugacuaacgcgaccgaacugguacaaaauucuucaaucggugagauaugcgacaguccacaccagauccuagauggcgaaaacuguacacucauugacgcucugcuuggggauccgcagugcgacggauuccagaauaaaaagugggaucuguuuguggagaggagcaaagccuauuccaacuguuaccccuaugacgucccugauuacgcaucuuugcggucgcucguggccucaagcggcacccuggaguucaauaacgaaaguuuuaauuggacugguguuacacaaaacgggaccuccucugcuugcauccgccgaagcuccucaaguuucuuuagccgucugaauuggcucacgcauuuaaacuauacuuacccagcacugaaugugaccaugcccaacaacgagcaguucgacaagcuguauauuuggggaguccaccauccuggcacagauaaggaccagaucuuuuuguacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacauccugcuaauuaacagcaccgguaaucucaucgccccgcggggcuauuucaaaauacgcucggggaagucuuccauuaugcgaucagacgcgcccaucggaaaauguaagagugaaugcaucacgccuaacggcagcauuccaaaugauaagcccuuucagaacgugaauagaaucacuuacggugcauguccuagguaugucaaacacuccacacugaaacuugccaccgggaugcggaacgugccagagaagcagacucguggaauuuucggcgcuauagccggcuuuaucgaaaaugggugggagggaaugguggacgguugguacggcuuccgccaccaaaacucugaggggagaggacaggcagcugaucuuaagagcacacaggccgcgauugaccaaaucaauggcaaauugaacaggcucaucgguaagaccaaugaaaaauuucaucagauugagaaggaguucucagaagucgaagggcggauacaggaucuggagaaguauguugaggacacgaaaaucgauuuauggaguuacaacgccgaacugcucguggcacuugagaaucagcacaccauugaccugacagauuccgaaaugaacaaguuguucgagaaaacuaagaaacaacuacgagaaaacgcugaggacaugggcaauggaugcuuuaagaucuaucauaagugugauaacgccugcauuggcagcauccgcaaugggaccuacgaccacaacguauacagagacgaggcucugaauaacagguuccagauaaaaggaguggaacucaagucugguuauaaagauuggauccuguggauuucauuugccaucaguugcuuccuucugugugucgcauugcucggcuuuauuaugugggccugccagaaggggaauauccgguguaacauaugcauuuga

SEQ ID NO: 135186 - RNA, 1701 nt, Artificial Sequence; identical to SEQ ID NO: 134457
  derived and/or modified sequence opt3 from hemagglutinin__InfluenzaA__ALE31635

SEQ ID NO: 135187 - RNA, 1701 nt, Artificial Sequence; identical to SEQ ID NO: 134457
  derived and/or modified sequence opt3 from hemagglutinin__InfluenzaA__ALE31636

SEQ ID NO: 135188 - RNA, 1701 nt, Artificial Sequence
  derived and/or modified sequence opt3 from hemagglutinin__InfluenzaA__ALE31638
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugguaagcccuuccagaacgugaauagaaucacuuacggggcauguccuagguaugucaaacacuccacacucaagcuggccaccggaaugcggaacgugccagagaaacagacucguggcauuuuuggcgcuauagccggguucaucgaaaauggaugggaggguaugguggauggcugguacggguuucgccaccaaaacucugagggaagaggccaggcagcugaccuuaagagcacacaggccgcgauugaucaaaucaaugguaaacugaacagguugaucgggaagaccaaugaaaaauuccaucagauugagaaggaauuuucagaggucgaaggccggauacaggaccucgagaaguauguugaggauacgaaaaucgaccuguggaguuacaacgccgaauuacugguggcacucgagaaucagcacaccauugaucuuacagacuccgaaaugaacaagcuguuugagaaaacuaagaaacaauugcgagaaaacgcugaggauaugggaaauggcugcuucaagaucuaucauaagugugacaacgccugcauugggagcauccgcaauggaaccuacgaucacaacguauacagagacgaggcucuaaauaacagguuucagauaaaagguguggaacugaagucuggcuauaaagacuggauccucuggauuucauucgccaucaguugcuuucugcuuugugucgcacuguugggguucauuaugugggccugccagaagggaaauauccgguguaacauaugcauuuga

SEQ ID NO: 135189 - RNA, 1701 nt, Artificial Sequence; identical to SEQ ID NO: 134457
  derived and/or modified sequence opt3 from hemagglutinin__InfluenzaA__ALE31639

SEQ ID NO: 135190 - RNA, 1701 nt, Artificial Sequence; identical to SEQ ID NO: 135008
  derived and/or modified sequence opt3 from hemagglutinin__InfluenzaA__ALE31640

SEQ ID NO: 135191 - RNA, 1701 nt, Artificial Sequence; identical to SEQ ID NO: 135014
  derived and/or modified sequence opt3 from hemagglutinin__InfluenzaA__ALE31641

SEQ ID NO: 135192 - RNA, 1701 nt, Artificial Sequence; identical to SEQ ID NO: 135014
  derived and/or modified sequence opt3 from hemagglutinin__InfluenzaA__ALE31642

SEQ ID NO: 135193 - RNA, 1701 nt, Artificial Sequence
  derived and/or modified sequence opt3 from hemagglutinin__InfluenzaA__ALE31643
augaagaccaucauugcccugagcuacauacucugccuuguguucgcucagaaacugcccgagaacgacaauuccacagcaacuuuguguuuaggccaccaugccgucccuaacgggacgaucguuaagaccauuacaucugauagaaucgaagugacuaaugcgaccgagcugguacaaaacucaaguauuggagaaaucugcgacagcccacaccagauacuagaugguaaaaauuguacacucaucgacgcucugcuuggcgauccgcagugcgacggguuucagaacaagaaaugggaucuguucguggagagguccaccgccuauucuaauuguuaccccuaugacgucccugauuacgcaucguugcggucacucguggccagcaguggaacucuggaauuuaacgacgaguccuucaauugggcuggcguuacacaaaacgguaccucuagcgcaugcauucgcggguccaauucaaguuucuuuagccgacugaacuggcucacgcauucuaauuuuaaguauccagccuuaaacgugacuaugcccaauaacgagcaguucgauaagcuguacaucuggggaguccaccauccuggcaccgacaaagaucagauuuuucuuuaugcucaguccucaggccguaucacagugagcacuaagagaagucaacaggccguaauaccaaacauugggucuaggccccggauccgcaauauuccuuccagaaucagcaucuacuggaccauuguuaaaccaggagacauauugcugaucaacucgacagguaaucuaauugcgccgaggggcuacuucaagauccggucugggaaauccucaauaaugcgcagugacgcacccauuggaaaguguaagagcgaaugcaucaccccuaacggcuccaucccaaaugauaaacccuuucagaacgugaaucgaauuacguauggugccuguccuagauacgucaagcagucuacucucaaacuggcuacagggaugaggaacgugccagagaagcaaacccggggaaucuucggcgccauugcaggcuuuauagaaaaugggugggagggaaugaaagacgguugguauggcuuccgucaccagaacagcgaggggcgcggacaggcugccgaucuuaagucaacucaagcggccaucgaccagauuaauggcaaacugaacagauugaucgguaagacaaaugaaaaguuccaccagaucgagaaagaauuuagugagguggaagggaggauucaggaucucgagaaguacgucgaggacaccaaaauagaucugugguccuauaacgcagaauuacugguugcucucgagaaucaacauacgaucgaccuuaccgauagcgaaaugaacaagcuguucgagaaaacaaagaagcaguugcgggaaaacgccgaggacaugggcaauggaugcuuuaaaauuuaccacaagugugauaacgcuugcaucggcucuauucgaaaugggacuuaugaccaugacguguaccgcgaugaggcccuaaacaauagauuccagaucaaaggaguagaacugaagucagguuacaaagacuggauacucuggaucaguuuugcaauuagcugcuuccugcuuuguguggcccuguugggcuuuaucaugugggcuugccagaaggggaacauuagguguaauaucugcauauga

SEQ ID NO: 135194 - RNA, 1701 nt, Artificial Sequence; identical to SEQ ID NO: 134457
  derived and/or modified sequence opt3 from hemagglutinin__InfluenzaA__ALE31644

SEQ ID NO: 135195 - RNA, 1701 nt, Artificial Sequence; identical to SEQ ID NO: 134457
  derived and/or modified sequence opt3 from hemagglutinin__InfluenzaA__ALE31645

SEQ ID NO: 135196 - RNA, 1701 nt, Artificial Sequence; identical to SEQ ID NO: 134457
  derived and/or modified sequence opt3 from hemagglutinin__InfluenzaA__ALE31646

SEQ ID NO: 135197 - RNA, 1701 nt, Artificial Sequence; identical to SEQ ID NO: 135014
  derived and/or modified sequence opt3 from hemagglutinin__InfluenzaA__ALE31647

SEQ ID NO: 135198 - RNA, 1701 nt, Artificial Sequence
  derived and/or modified sequence opt3 from hemagglutinin__InfluenzaA__ALE31648
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagccaucuggcagaauaacuguguccaccaaaaggucacaacaggcuguaauucccaauaucgggagccggccucgcauuagagauaucccaaguaggaucucuauuuacuggacaauaguuaagccgggagacaucuugcugauuaacuccaccgguaaucuaaucgcgccccggggcuauuuuaaaauacgcagcgggaagucgucuauuaugcgauccgacgccccuaucggaaaauguaagucagaaugcaucacgccaaacggcaguauucccaaugauaagccuuuccagaacgugaauagaaucacuuacggugcauguccaagguaugucaaacacagcacacucaagcuggccaccgggaugcggaacgugcccgagaaacagacucguggaauuuuuggcgcuauagccggcuucaucgaaaaugggugggagggaaugguggacgguugguacggcuuucgccaccaaaacuccgaggggagaggacaggcagcugaucuuaagucuacacaggccgcgaccgaccaaauuaauggcaaacugaacagguugaucgguaagacgaaugaaaaauuccaucagaucgagaaggaauuuagcgaggucgaagggcggauucaggaucucgagaaguauguugaggacaccaaaauagaucuguggucauacaacgccgaauuacugguggcacucgagaaucagcacacaaucgaccuuacugauagugaaaugaacaagcuguuugagaaaaccaagaaacaauugcgagaaaacgcugaggacaugggcaauggaugcuucaagauuuaucauaagugugauaacgccugcaucggcuccauucgcaaugggacauacgaccacaacguauacagagacgaggcucuaaauaacagguuucagaucaaaggaguggaacucaagagcgguuauaaagauuggauacuguggaucucuuucgccauuucaugcuuucugcuuugugucgcacuguugggcuucaucaugugggccugccagaaggggaauauucgguguaacaucugcauauga

SEQ ID NO: 135199 - RNA, 1701 nt, Artificial Sequence; identical to SEQ ID NO: 134457
  derived and/or modified sequence opt3 from hemagglutinin__InfluenzaA__ALE31649

SEQ ID NO: 135200 - RNA, 1701 nt, Artificial Sequence; identical to SEQ ID NO: 135014
  derived and/or modified sequence opt3 from hemagglutinin__InfluenzaA__ALE31650

SEQ ID NO: 135201 - RNA, 1701 nt, Artificial Sequence
  derived and/or modified sequence opt3 from hemagglutinin__InfluenzaA__ALE31652
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauaaguacccagcauuaaaugugacuaugcccaacaacgagcaguuugacaagcuguauauuuggggaguccaccauccuggcaccgauaaagaccagaucucucuuuacgcccaguccucaggcagaauaacagugagcacuaagaggagucaacaggcuguaauuccaaauaucgggucucggccccgcauuagagauaucccuuccaggaucagcauuuacuggaccauaguuaaaccaggagacaucuugcugauuaacucgacagguaaucuaaucgccccgcggggcuauuucaagauacgcucugggaaauccucaauuaugcgaagugacgcgcccaucggaaaguguaagagcgaaugcaucaccccuaacggcuccauuccaaaugauaaacccuuucagaacgugaauagaaucacguacggugcauguccuagguaugucaagcacucuacucucaaacuggccacagggaugcggaacgugccagagaagcagacccguggaauuuucggcgcuauagccggcuuuaucgaaaaugggugggagggaaugguggacgguugguacggcuuccgccaccaaaacagcgaggggagaggacaggcagcugaucuuaaaucaacucaggccgcgauugaccaaaucaauggcaagcugaacagguugaucgguaaaacaaaugaaaaguuucaucagauugagaaggaauuuagugaggucgaagggcggauacaggaucucgagaaauauguugaggacaccaagaucgaucugugguccuacaacgccgaauuacugguggcacucgagaaucagcacacgauugaccuuaccgauagcgaaaugaacaaacuguucgagaagacuaaaaagcaauugcgagaaaacgcugaggacaugggcaauggaugcuuuaagaucuaucauaaaugugauaacgccugcauuggcucuauccgcaaugggacauacgaccacaacguauacagagacgaggcucuaaauaacagguuccagauaaagggaguggaacugaaaucagguuauaaggauuggauccucuggauuaguuuugccaucagcugcuuccugcuuugugucgcacuguugggcuuuauuaugugggccugccagaaagggaauauccgguguaacauaugcauuuga

SEQ ID NO: 135202 - RNA, 1701 nt, Artificial Sequence; identical to SEQ ID NO: 135108
  derived and/or modified sequence opt3 from hemagglutinin__InfluenzaA__ALE31653

SEQ ID NO: 135203 - RNA, 1701 nt, Artificial Sequence; identical to SEQ ID NO: 134457
  derived and/or modified sequence opt3 from hemagglutinin__InfluenzaA__ALE31654

SEQ ID NO: 135204 - RNA, 1701 nt, Artificial Sequence; identical to SEQ ID NO: 134457
  derived and/or modified sequence opt3 from hemagglutinin__InfluenzaA__ALE31655

SEQ ID NO: 135205 - RNA, 1701 nt, Artificial Sequence
  derived and/or modified sequence opt3 from hemagglutinin__InfluenzaA__ALE31656
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggauaucuucguggagaggagcaaagccuauuccaacuguuaccccuaugacgucccugauuacgcaucucuucggucgcugguggccucaagcggcaccuuggaauuuaauaacgagaguuucaauuggacugguguuacacaaaacgggaccuccucugcuugcauucgccgaagcuccucaaguuucuucagccgucucaauuggcugacgcaucugaacuauacuuacccagcacucaaugugaccaugcccaacaacgagcaguuugacaaguuauauaucuggggaguccaccauccuggcacagauaaggaccagauauuccuguacgcccagucuuccggcagaauuacugugucaaccaaaaggagccaacaggcuguaaucccaaauauugggagucggccccgcaucagagauaucccuucuaggauuuccauauacuggacaaucguuaagccaggagacauucuuuugaucaacagcaccgguaaucugauagccccgcggggcuauuuuaaaauucgcucggggaagucuuccaucaugcgaucagacgcgcccaucggaaaauguaagagugaaugcauuacgccuaacggcagcaucccaaaugauaagcccuuccagaacgugaauagaauuacuuacggugcauguccuagguaugucaaacacuccacacuaaagcucgccaccgggaugcggaacgugccagagaaacagacucguggaauauuuggcgcuaucgccggcuucauugaaaaugggugggagggaaugauggacgguugguacggcuuucgccaccaaaacucugaggggagaggacaggcagcugaucuuaagagcacacaggccgcgaucgaccaaaucaauggcaaacuuaacaggcugauugguaagaccaaugaaaaauuccaucagauagagaaggaauuuucagagguggaagggcggauccaggauuuggagaaguaugucgaggacacgaaaauugaucucuggaguuacaacgccgaacuguuaguugcacuggagaaucagcacaccaucgaccucacagauuccgaaaugaacaagcuguuugagaaaacuaagaaacaacugcgagaaaacgcugaggacaugggcaauggaugcuucaagauuuaucauaagugugauaacgccugcaucggcagcauacgcaaugggaccuacgaccacaacguguacagagacgaggcuuugaauaacagguuucagaucaaaggaguagaacuaaagucugguuauaaagauuggauucuguggaucucauucgccauuaguugcuuucuccuguguguggcacuucugggcuucaucaugugggccugccagaaggggaauauacgguguaacauuugcaucuga

SEQ ID NO: 135206 - RNA, 1701 nt, Artificial Sequence
  derived and/or modified sequence opt3 from hemagglutinin__InfluenzaA__ALE31657
augaagaccaucauugcccugagcuacauacucugccuuguguccgcucagaaaauccccggcaacgacaauucuacagcaacucuguguuuggggcaccaugccgucccuaacggaacgauuguuaagaccaucacaaaugauagaauugaggugacuaacgcgaccgaauuaguacaaaauucaaguaucggugagauaugcgacagcccacaccagauccuggauggcgaaaacuguacacuaauugacgcucuccugggggauccgcagugcgacggauuccagaauaaaaagugggaucuuuuuguggagagguccaaagccuauucuaacuguuaccccuaugacgucccugauuacgcaucgcugcggucauugguggccagcaguggcacccucgaguucaauaacgaauccuuuaauuggacugguguuacacaaaacgggaccucuagcgcuugcauccgccgauccucaaguagcuucuuuucucgucugaauuggcugacgcaucucaacuauacuuacccagcauuaaaugugaccaugcccaacaacgagcaguucgacaagcuguauauuuggggaguccaccauccuggcacagauaaggaccagaucuuucuuuacgcccaguccucaggcagaauaacugugagcaccaaaaggagucaacaggcuguaauuccaaauaucgggucucggccccgcauuagagauaucccuuccaggaucagcauuuacuggacaauaguuaagccaggagacaucuugcugauuaacucgaccgguaaucuaaucgccccgcggggcuauuucaaaauacgcucugggaaguccucaauuaugcgaagugacgcgcccaucggaaaauguaagagcgaaugcaucacgccuaacggcuccauuccaaaugauaagcccuuucagaacgugaauagaaucacuuacggugcauguccuagguaugucaaacacucuacacucaagcuggccaccgggaugcggaacgugccagagaaacagacucguggaauuuucggcgcuauagccggcuuuaucgaaaaugggugggagggaaugguggacgguugguacggcuuccgccaccaaaacagcgaggggagaggacaggcagcugaucuuaagucaacacaggccgcgauugaccaaaucaauggcaaacugaacagguugaucgguaagaccaaugaaaaauuucaucagauugagaaggaguucagugaagucgaagggcggauacaggaucucgagaaguauguugaggacacgaaaaucgaucugugguccuacaacgccgaauuacugguggcacucgagaaucagcacaccauugaccuuacagauagcgaaaugaacaagcuguucgagaaaacuaagaaacaauugcgagaaaacgcugaggacaugggcaauggaugcuuuaagaucuaucauaagugugauaacgccugcauuggcucuauccgcaaugggaccuacgaccacaacguauacagagacgaggcucuaaauaacagguuccagauaaaaggaguggaacugaagucagguuauaaagauuggauccucuggauuaguuuugccaucagcugcuuccugcuuugugucgcacuguugggcuuuauuaugugggccugccagaaggggaauauccgguguaacauaugcauuuga

SEQ ID NO: 135207 - RNA, 1701 nt, Artificial Sequence; identical to SEQ ID NO: 134457
  derived and/or modified sequence opt3 from hemagglutinin__InfluenzaA__ALE31658

SEQ ID NO: 135208 - RNA, 1701 nt, Artificial Sequence; identical to SEQ ID NO: 135072
  derived and/or modified sequence opt3 from hemagglutinin__InfluenzaA__ALE31659

SEQ ID NO: 135209 - RNA, 1701 nt, Artificial Sequence; identical to SEQ ID NO: 135001
  derived and/or modified sequence opt3 from hemagglutinin__InfluenzaA__ALE31660

SEQ ID NO: 135210 - RNA, 1701 nt, Artificial Sequence
  derived and/or modified sequence opt3 from hemagglutinin__InfluenzaA__ALE31661
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaagagccaacaggcuguaauuccaaauaucgggaguaggccccggauucgcgauaucccuucuagaaucuccauuuacuggacaauaguuaaaccaggagacaucuugcugauuaacagcaccgguaaucuaaucgccccgaggggcuauuuuaagauacggucggggaaaucuuccauuaugcgcucagacgcgcccaucggaaaguguaagagugaaugcaucacgccuaacggcagcauuccaaaugauaaacccuuccagaacgugaaucgaaucacuuacggugcauguccuagauaugucaagcacuccacacucaaacuggccaccgggaugaggaacgugccagagaagcagacucggggaauuuuuggcgcuauagccggcuucaucgaaaaugggugggagggaaugguggacgguugguacggcuuucgucaccaaaacucugaggggcgcggacaggcagcugaucuuaaaagcacacaggccgcgauugaccaaaucaauggcaagcugaacagauugaucgguaaaaccaaugaaaaguuccaucagauugagaaggaauuuucagaggucgaagggaggauacaggaucucgagaaauauguugaggacacgaagaucgaucuguggaguuacaacgccgaauuacugguggcacucgagaaucagcacaccauugaccuuacagauuccgaaaugaacaaacuguuugagaagacuaaaaagcaauugcgggaaaacgcugaggacaugggcaauggaugcuucaagaucuaucauaaaugugauaacgccugcauuggcagcauccgaaaugggaccuacgaccacaacguauaccgcgacgaggcucuaaauaacagauuucagauaaagggaguggaacugaaaucugguuauaaggauuggauccucuggauuucauucgccaucaguugcuuucugcuuugugucgcacuguugggcuucauuaugugggccugccagaaagggaauaucagguguaacauaugcauuuga

SEQ ID NO: 135211 - RNA, 1701 nt, Artificial Sequence
  derived and/or modified sequence opt3 from hemagglutinin__InfluenzaA__ALE31662
augaagaccaucauugcccugagcuacauacucugccuuguguucgcucagaaaauccccggcaacgacaauuccacagcaacucuguguuuggggcaccaugccgucccuaacggaacgauuguuaagaccaucgcgaaugauagaauugaggugacaaacgcuacugaauuaguacaaaauucuucaaucggugagauaugcgacaguccacaccagauccuggauggcgaaaacuguacccuaauugacgcccuccugggggauccgcagugcgacggauuucagaauaaaaagugggaucuuuucguggagaggagcaaagcauauuccaacuguuaccccuaugacgucccugauuacgccucucugcggucguugguggcuucaagcggcacacucgaauuuaauaacgagaguuucaauuggaccgguguuacucaaaacgggacauccucugcaugcauccgccgaagcuccucaaguuucuucagccgucugaauuggcugacccaucucaacuauacguacccagccuuaaaugugacuaugcccaacaacgagcaguuugacaagcuguauauuuggggaguccaccauccuggcaccgauaaggaccagaucuuccuuuacgcucagucuuccggcagaauaacagugucaacuaaagggagccaacaggccguaauuccaaauaucggaaguaggccccggauucgcgauaucccuucuagaaucuccauuuacuggaccauaguuaagccaggugacaucuugcugauuaacagcacaggcaaucuaaucgcgccgaggggguauuuuaaaauacggucgggaaagucuuccauuaugcgcucagacgcacccaucggcaaauguaagagugaaugcaucaccccuaacgguagcauuccaaaugauaagcccuuccagaacgugaaucgaaucacguacggggccuguccuagauaugucaaacacuccacucucaagcuggcuacaggaaugaggaacgugccagagaaacagacccggggcauuuuuggcgccauagcaggguucaucgaaaauggaugggaggguaugguggacggcugguacggguuucgucaccaaaacucugagggacgcggccaggcugccgaucuuaagagcacucaggcggccauugaccaaaucaaugguaaacugaacagauugaucgggaagacaaaugaaaaauuccaucagauugagaaggaauuuucagaggucgaaggcaggauacaggaucucgagaaguauguugaggacaccaaaaucgaucuguggaguuacaacgcagaauuacugguggcucucgagaaucagcacacgauugaccuuaccgauuccgaaaugaacaagcuguuugagaaaacaaagaaacaauugcgggaaaacgccgaggacaugggaaauggcugcuucaagaucuaucauaagugugauaacgcuugcauugggagcauccgaaauggaacuuacgaccacaacguauaccgcgacgaggcccuaaauaacagauuucagauaaaagguguggaacugaagucuggcuauaaagauuggauccucuggauuucauucgcaaucaguugccugcuucugugugucgccuugcucggguuuauuaugugggcuugccagaagggaaauaucagguguaacauaugcauuuga

SEQ ID NO: 135212 - RNA, 1701 nt, Artificial Sequence; identical to SEQ ID NO: 134443
  derived and/or modified sequence opt3 from hemagglutinin__InfluenzaA__ALE31663

SEQ ID NO: 135213 - RNA, 1701 nt, Artificial Sequence
  derived and/or modified sequence opt3 from hemagglutinin__InfluenzaA__ALE31666
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaaguauacuuacccagcauuaaacgugaccaugcccaauaacgagcaguuugacaaacuguauauuuggggaguccaccauccuggcacagauaaggaccagaucuuccuuuacgcccguucuuccggcagaauaacugugucaaccaaaaggagccagcaagcuguaauuccaaacaucgggagucggccccgcauuagagauaucccuucuaggaucuccauuuacuggacaauaguuaagccaggagacaucuugcugauuaauagcaccgguaaccuaaucgccccgcggggcuauuuuaaaauacgcucggggaagucuuccauuaugcgaucagacgcgcccaucggaaaguguaaaagugaaugcaucacgccuaauggcagcauuccaaacgauaagcccuuccagaaugugaacagaaucacuuacggugcauguccuagguaugucaaacacuccacacucaagcuggccaccgggaugcggaaugugccagagaaacagacucguggaauuuuuggcgcuauagccggcuucaucgaaaacgggugggagggaaugguggacgguugguacggcuuucgccaccaaaauucugaggggagaggacaggcagcugaucuuaagagcacacaggccgcgauugaccagaucaacggcaaacugaauagguugaucgguaagaccaacgaaaaguuccaucaaauugagaaagaauuuucagaggucgaagggcggauacaggaucucgagaaguauguugaggacacgaaaaucgaucuguggaguuacaaugccgaauuacugguggcacucgagaaccagcacaccauugaccuuacagauuccgaaaugaauaagcuguuugagaaaacuaagaagcaguugcgagaaaacgcugaggacaugggcaacggaugcuucaaaaucuaucauaagugugauaaugccugcauuggcagcauccgcaacgggaccuacgaccacaauguauacagagacgaggcucuaaacaauagguuucaaauaaaaggaguggaacugaagucugguuauaaagauuggauccucuggauuucauucgccaucaguugcuuucugcuuugugucgcacuguugggcuucauuaugugggccugccagaaggggaacauccgguguaauauaugcauuuga

SEQ ID NO: 135214 - RNA, 1701 nt, Artificial Sequence
  derived and/or modified sequence opt3 from hemagglutinin__InfluenzaA__ALE31667
augaagaccaucauugcccugagcuacauacucugccuuguguucgcucagaaaauccccggcaacgacaauuccacagcaacucuguguuuggggcaccaugccgucuuaaacggaacgauuguuaagaccaucacaaaugauagaauugaggugacuaacgcgaccgaacugguacaaaauucuucaaucggugagauaugcgacaguccucaccagauccuagauggcgaaaacuguacacucauugacgcucugcuuggggauccacagugcgacggauuucagaauaaaaagugggaucuguucguggagaggagcaaagccuauuccaacuguuacccguaugacguccccgauuacgcaucuuugcggucgcucguggccucaagcggcacccuggaauuuaauaacgagaguuucaauuggacugguguuacacaaaacgggaccuccucugcuugcauccgcaagagcuccucaaguuucuucagccgacugaauuggcucacgcauuuaaacuauacuuacccugcacugaaugugaccaugccaaacaacgagcaguuugacaaacuuuauauuuggggaguccaccaucccggcacagauaaggaccagaucuucuuguacgcccguucuuccggcagaauaacugugucaaccaagaggagccagcaagcuguaauuccuaauaucgggagucggccacgcauuagagauauccccucuaggaucuccauuuacuggacaauaguuaaaccuggagacauccugcuaauuaacagcaccgguaaucucaucgccccacggggcuauuuuaagauacgcucggggaaaucuuccauuaugcgaucagacgcgccgaucggaaaguguaagagugaaugcaucacgcccaacggcagcauuccuaaugauaaaccauuccagaacgugaauagaaucacuuacggugcaugucccagguaugucaagcacuccacacugaaacuugccaccgggaugcggaacgugccugagaagcagacucguggaauuuuuggcgcuauagccggcuucaucgaaaaugggugggagggaaugguggacgguugguacggcuuucgccaccagaacucugaggggagaggacaagcagcugaucugaaaagcacacaggccgcgauugaccagaucaauggcaaguugaacaggcucaucgguaaaaccaaugaaaaguuccaucaaauugagaaggaauuuucagaggucgaagggcggauacaggaucuggagaaauauguugaggacacgaagaucgauuuauggaguuacaacgccgaacugcucguggcacuugagaaucagcacaccauugaccugacagauuccgaaaugaacaaauuguuugagaagacuaaaaagcagcuacgagaaaacgcugaggacaugggcaauggaugcuucaagaucuaucauaaaugugauaacgccugcauuggcagcauccgcaaugggaccuacgaccacaacguauacagagacgaggcucugaauaacagguuucaaauaaagggaguggaacucaaaucugguuauaaggauuggauccuguggauuucauucgccaucaguugcuuucuucugugugucgcauugcucggcuucauuaugugggccugccagaaagggaauauccgguguaacauaugcauuuga

SEQ ID NO: 135215 - RNA, 1701 nt, Artificial Sequence; identical to SEQ ID NO: 134457
  derived and/or modified sequence opt3 from hemagglutinin__InfluenzaA__ALE31668

SEQ ID NO: 135216 - RNA, 1701 nt, Artificial Sequence; identical to SEQ ID NO: 134457
  derived and/or modified sequence opt3 from hemagglutinin__InfluenzaA__ALE31669

SEQ ID NO: 135217 - RNA, 1701 nt, Artificial Sequence
  derived and/or modified sequence opt3 from hemagglutinin__InfluenzaA__ALE31670
augaagaccaucauugcccugagcuacauacucugccuuguguucgcucagaaacugcccgagaacgacaauuccacagcaacuuuguguuuaggccaccaugccgucccuaacgggacgaucguuaagaccauuacaucugauagaaucgaagugacuaaugcgaccgagcugguacaaaacucaaguauuggagaaaucugcgacagcccacaccagauacuagaugguaaaaauuguacacucaucgacgcucugcuuggcgauccgcagugcgacggguuucagaacaagaaaugggaucuguucguggagagguccaaggccuauucuaauuguuaccccuaugacgucccugauuacgcaucguugcggucacucguggccagcaguggaacccuggaauuuaacgacgaguccuucaauugggcuggcguuacucaaaacgguacaucuagcgcaugcauucgcggguccaauucaaguuucuuuagccgacugaacuggcucacccauucuaauuuuaaguauccagccuuaaacgugacgaugcccaauaacgagcaguucgauaaacuguacaucuggggaguccaccauccuggcacugacaaggaucagauuuuucuuuaugcucaguccucaggccguaucaccgugagcacaaaaagaagucaacaggccguaauaccaaacauugggucuaggccccggauccgcaauauuccuuccagaaucagcaucuacuggacuauuguuaagccaggagacauauugcugaucaacucgaccgguaaucuaauugcgccgaggggcuacuucaaaauccggucugggaaguccucaauaaugcgcagugacgcacccauuggaaaguguaaaagcgaaugcaucacaccuaacggcuccaucccaaaugauaagcccuuucagaacgugaaucgaauuaccuauggugccuguccuagauacgucaaacagucuacgcucaagcuggcuacugggaugaggaacgugccagagaaacaaacacggggaaucuucggcgccauugcaggcuuuauagaaaaugggugggagggaaugaaggacgguugguauggcuuccgucaccagaacagcgaggggcgcggacaggcugccgaucuuaaaucaacccaagcggccaucgaccagauuaauggcaagcugaacagauugaucgguaagacuaaugaaaaauuccaccagaucgagaaggaauuuagugagguggaagggaggauucaggaucucgagaaauacgucgaggacacaaagauagaucugugguccuauaacgcagaauuacugguugcucucgagaaucaacauaccaucgaccuuacggauagcgaaaugaacaaacuguucgagaagaccaagaaacagaugcgggaaaacgccgaggacaugggcaauggaugcuuuaagauuuaccacaaaugugauaacgcuugcaucggcucuauucgaaaugggacauaugaccaugacguguaccgcgaugaggccuugaacaauagauuccagaucaagggaguagaacuaaaaucagguuacaaggacuggauacuguggaucaguuuugcaauuagcugcuuccuccuguguguggcccuucugggcuuuaucaugugggcuugccagaaggggaacauuagguguaauaucugcauauga

SEQ ID NO: 135218 - RNA, 1701 nt, Artificial Sequence; identical to SEQ ID NO: 134457
  derived and/or modified sequence opt3 from hemagglutinin__InfluenzaA__ALE31671

SEQ ID NO: 135219 - RNA, 1701 nt, Artificial Sequence; identical to SEQ ID NO: 134457
  derived and/or modified sequence opt3 from hemagglutinin__InfluenzaA__ALE31672

SEQ ID NO: 135220 - RNA, 1701 nt, Artificial Sequence; identical to SEQ ID NO: 135014
  derived and/or modified sequence opt3 from hemagglutinin__InfluenzaA__ALE31673

SEQ ID NO: 135221 - RNA, 1701 nt, Artificial Sequence
  derived and/or modified sequence opt3 from hemagglutinin__InfluenzaA__ALE31674
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccacucuuccggcagaauaacugugucaaccaaaaggagccagcaagcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacucaagcuggccaccgggaugcggaacgugccagagaaacagacucguggaauuuuuggcgcuauagccggcuucaucgaaaaugggugggagggaaugguggacgguugguacggcuuucgccaucagaacucugaggggagaggacaagcagcugaucuuaagagcacacaggccgcgauugaccagaucaauggcaaacugaacagguugaucgguaagaccaaugaaaaauuccaccaaauugagaaggaauuuucagaggucgaagggcggauacaggaucucgagaaguauguugaggacacgaaaaucgaucuguggaguuacaacgccgaauuacugguggcacucgagaaucagcauaccauugaccuuacagauuccgaaaugaacaagcuguuugagaaaacuaagaaacaguugcgagaaaacgcugaggacaugggcaauggaugcuucaagaucuaucacaagugugauaacgccugcauuggcagcauccgcaaugggaccuacgaccacaacguauacagagacgaggcucuaaauaacagguuucaaauaaaaggaguggaacugaagucugguuauaaagauuggauccucuggauuucauucgccaucaguugcuuucugcuuugugucgcacuguugggcuucauuaugugggccugccagaaggggaauauccgguguaacauaugcauuuga

SEQ ID NO: 135222 - RNA, 1701 nt, Artificial Sequence
  derived and/or modified sequence opt3 from hemagglutinin__InfluenzaA__ALE31675
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcaacaguccacaccagauccuggacggcgaaaauuguacacuaauugaugcucuccugggggacccgcagugcgauggauuucagaacaaaaagugggaccuuuucguggagaggagcaaagccuauuccaauuguuaccccuaugaugucccugacuacgcaucucugcggucguugguggccucaagcggcacccucgaauuuaacaaugagaguuucaacuggacugguguuacacaaaaugggaccuccucugcuugcauccgccgaagcuccucaaguuucuucagccgucugaacuggcugacgcaucucaauuauacuuacccagcauuaaacgugaccaugcccaacaaugagcaguuugauaagcuguauauuuggggaguccaccauccuggcacagacaaggaucagaucuuccuuuacgcccagucuuccggcagaauaacugugucaaccaaagggagccaacaggcuguaauuccaaacaucggaaguaggccccggauucgcgacaucccuucuagaaucuccauuuacuggacaauaguuaagccaggugauaucuugcugauuaauagcaccggcaaccuaaucgccccgaggggguauuuuaaaauacggucgggaaagucuuccauuaugcgcucagacgcgcccaucggcaaauguaagagugaaugcaucacgccuaaugguagcauuccaaacgacaagcccuuccagaaugugaaccgaaucacuuacggggcauguccuagauaugucaaacacuccacacucaagcuggccaccggaaugaggaaugugccagagaaacagacucggggcauuuuuggcgcuauagccggguucaucgaaaacggaugggaggguaugguggauggcugguacggguuucgucaccaaaauucugagggacgcggccaggcagcugaccuuaagagcacacaggccgcgauugaucaaaucaacgguaaacugaauagauugaucgggaagaccaacgaaaaauuccaucagauugagaaggaauuuucagaggucgaaggcaggauacaggaccucgagaaguauguugaggauacgaaaaucgaccuguggaguuacaaugccgaauuacugguggcacucgagaaccagcacaccauugaucuuacagacuccgaaaugaacaagcuguuugagaaaacuaagaaacaauugcgggaaaaugcugaggauaugggaaacggcugcuucaagaucuaucauaagugugacaaugccugcauugggagcauccgaaacggaaccuacgaucacaauguauaccgcgacgaggcucuaaacaauagauuucagauaaaagguguggaacugaagucuggcuauaaagacuggauccucuggauuucauucgccaucaguugcuuucugcuuugugucgcacuguugggguucauuaugugggccugccagaagggaaacaucagguguaauauaugcauuuga

SEQ ID NO: 135223 - RNA, 1701 nt, Artificial Sequence
  derived and/or modified sequence opt3 from hemagglutinin__InfluenzaA__ALE31676
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggcccaagauucgcgauaucccuucuagaaucuccauuuacuggacaauaguuaaaccaggagacaucuugcugauuaacagcaccgguaaucuaaucgccccgaggggcuauuuuaagauacucucggggaaaucuuccauuaugcggucagacgcgcccaucggaaaguguaagagugaaugcaucacgccuaacggcagcauuccaaaugauaaacccuuccagaacgugaaucgcaucacuuacggugcauguccucgauaugucaagcacuccacacugaaacuugccaccgggaugagaaacgugccagagaagcagacuaggggaauuuuuggcgcuauagccggcuucaucgaaaaugggugggagggaaugguggacgguugguacggcuuucggcaccaaaacucugaggggcguggacaggcagcugaucugaaaagcacacaggccgcgauugaccaaaucaauggcaaguugaaccgccucaucgguaaaaccaaugaaaaguuccaucagauugagaaggaauuuucagaggucgaagggagaauacaggaucuggagaaauauguugaggacaguaagaucgauuuaugguccuacaacgccgaacugcucguggcacuugagaaucagcacacgauugaccugaccgauagcgaaaugaacaaauuguuugagaagacuaaaaagcaacuaagggaaaacgcugaggacaugggcaauggaugcuucaagaucuaucauaaaugugauaacgccugcauuggcucuauccggaaugggacauacgaccacaacguauaccgagacgaggcucugaauaaccgcuuucagauaaagggaguggaacucaaaucagguuauaaggauuggauccuguggauuaguuucgccaucagcugcuuucuucugugugucgcauugcucggcuucauuaugugggccugccagaaagggaauaucagauguaacauaugcauuuga

SEQ ID NO: 135224 - RNA, 1701 nt, Artificial Sequence; identical to SEQ ID NO: 135115
  derived and/or modified sequence opt3 from hemagglutinin__InfluenzaA__ALE31677

SEQ ID NO: 135225 - RNA, 1701 nt, Artificial Sequence; identical to SEQ ID NO: 134457
  derived and/or modified sequence opt3 from hemagglutinin__InfluenzaA__ALE31678

SEQ ID NO: 135226 - RNA, 1701 nt, Artificial Sequence; identical to SEQ ID NO: 134457
  derived and/or modified sequence opt3 from hemagglutinin__InfluenzaA__ALE31679

SEQ ID NO: 135227 - RNA, 1701 nt, Artificial Sequence; identical to SEQ ID NO: 135073
  derived and/or modified sequence opt3 from hemagglutinin__InfluenzaA__ALE31680

SEQ ID NO: 135228 - RNA, 1701 nt, Artificial Sequence; identical to SEQ ID NO: 135072
  derived and/or modified sequence opt3 from hemagglutinin__InfluenzaA__ALE31681

SEQ ID NO: 135229 - RNA, 1701 nt, Artificial Sequence; identical to SEQ ID NO: 134457
  derived and/or modified sequence opt3 from hemagglutinin__InfluenzaA__ALE31682

SEQ ID NO: 135230 - RNA, 1701 nt, Artificial Sequence; identical to SEQ ID NO: 134457
  derived and/or modified sequence opt3 from hemagglutinin__InfluenzaA__ALE31683

SEQ ID NO: 135231 - RNA, 1701 nt, Artificial Sequence; identical to SEQ ID NO: 134457
  derived and/or modified sequence opt3 from hemagglutinin__InfluenzaA__ALE31684

SEQ ID NO: 135232 - RNA, 1701 nt, Artificial Sequence; identical to SEQ ID NO: 134457
  derived and/or modified sequence opt3 from hemagglutinin__InfluenzaA__ALE31685

SEQ ID NO: 135233 - RNA, 1701 nt, Artificial Sequence; identical to SEQ ID NO: 134457
  derived and/or modified sequence opt3 from hemagglutinin__InfluenzaA__ALE31686

SEQ ID NO: 135234 - RNA, 1701 nt, Artificial Sequence
  derived and/or modified sequence opt3 from hemagglutinin__InfluenzaA__ALE31687
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacucaagcuggccaccgggaugcggaacgugccagagaaacagacucguggaauuuuuggcgcuauagccggcuucaucgaaaaugggugggagggaaugguggacgguugguacggcuuucgccaccaaaacucugaggggagaggacaggcagcugaucuuaagagcacacaggccgcgauugaccaaaucaauggcaaacugaacagguugaucgguaagaccaaugaaaaauuccaucagauugagaaggaauuuucagaggucgaagggcggauacaggaucucgagaaguauguugaggacacgaaaaucgaucuguggaguuacaacgccgaauuacugguggcacucgagaaucagcacaccauugaccuuacagauuccgaaaugaacaagcuguuugagaaaacuaagaaacaauugcgagaaaacgcugaggacaugggcaauggaugcuucaagaucuaucauaagugugauaacgccugcauugagagcauccgcaauggcaccuacgaccacaacguauacagagacgaagcucuaaauaacagguuucagauaaaagggguggagcugaagucuggauauaaagauuggauccucuggauuucauucgccaucaguugcuuucugcuuugugucgcacuguuggguuucauuaugugggccugccagaagggcaauauccgguguaacauaugcauuuga

SEQ ID NO: 135235 - RNA, 1701 nt, Artificial Sequence
  derived and/or modified sequence opt3 from hemagglutinin__InfluenzaA__ALE31688
augaagaccacaaucgcccugagcuacauucucugccuuguguucgcucagaaacugcccgagaacgacaauuccacugcaacguuguguuuaggccaccaugccgucccuaacgggaccauaguuaagacaaucacuucugauagaauugaagugaccaaugcgacagagcugguacaaaacucaaguaucggagaaauuugcgacagcccacaccagauccuagaugguaaaaauuguacccucauagacgcucugcuuggcgauccgcagugcgacggguuucagaacaagaaaugggaucuguucguggagagguccaaggccuauucuaauuguuaccccuaugacgucccugauuacgcaucguugcggucacucguggccagcaguggaacucuggaauuuaacgacgaguccuucaauugggcuggcguuacacaaaacgguaccucuagcgcaugcauccgcggguccaauucaaguuucuuuagccgacugaacuggcucacgcauucuaauuuuaaguauccagccuuaaacgugacuaugcccaauaacgagcaguucgauaaacuguacauuuggggaguccaccauccuggcaccgacaaggaucagaucuuucuuuaugcucaguccucaggccguauuacagugagcacuaaaagaagucaacaggccguaaucccaaacauagggucuaggccccggauucgcaauaucccuuccagaauuagcaucuacuggaccaucguuaagccaggagacauuuugcugauaaacucgacagguaaucuaaucgcgccgaggggcuacuucaaaauucggucugggaaguccucaaucaugcgcagugacgcacccauaggaaaguguaaaagcgaaugcauuaccccuaacggcuccaucccaaaugauaagcccuuucagaacgugaaucgaaucacguauggugccuguccuagauacgucaaacagucuacucucaagcuggcuacagggaugaggaacgugccagagaaacaaacccggggaauuuucggcgccaucgcaggcuuuauugaaaaugggugggagggaaugaaggacgguugguauggcuuccgucaccagaacagcgaggggcgcggacaggcugccgaucuuaaaucaacucaagcggccauagaccagaucaauggcaagcugaacagauugauugguaagacaaaugaaaaauuccaccagaucgagaaggaauuuagugagguggaagggaggauccaggaucucgagaaauacgucgaggacaccaagauugaucugugguccuauaacgcagaauuacugguugcucucgagaaucaacauacgauagaccuuaccgauagcgaaaugaacaaacuguucgagaagacaaagaaacaguugcgggaaaacgccgaggacaugggcaauggaugcuuuaagaucuaccacaaaugugauaacgcuugcauuggcucuauccgaaaugggacuuaugaccaugacguguaccgcgaugaggcccuaaacaauagauuccagauuaagggaguagaacugaaaucagguuacaaggacuggauccucuggauaaguuuugcaaucagcugcuuccugcuuuguguggcccuguugggcuuuauuaugugggcuugccagaaggggaacaucagguguaauauuugcaucuga

SEQ ID NO: 135236 - RNA, 1701 nt, Artificial Sequence; identical to SEQ ID NO: 134457
  derived and/or modified sequence opt3 from hemagglutinin__InfluenzaA__ALE31689

SEQ ID NO: 135237 - RNA, 1701 nt, Artificial Sequence
  derived and/or modified sequence opt3 from hemagglutinin__InfluenzaA__ALE31690
augaagaccaucauugcccugagcugcauacucugucuuguguucgcucagaaacugcccggcaacgacaauuccacagcaacuuugugcuuagggcaccaugccgucccuaacggaacgaucguuaagaccauuacaaaugauagaaucgaggugacuaacgcgaccgaacugguacaaaauucuucaauuggugagaucugugacaguccacaccagauacuagauggcgaaaacugcacacucaucgacgcucugcuuggggauccgcagugugacggauuucagaauaaaaagugggaucuguucguggagaggagcaaagccuacuccaacugcuaucccuacgacgucccugauuaugcaucuuugcggucgcucguggccucaagcggcacccuggaauuuaauaacgagaguuucaauugggcugguguuacucaaaacgggacauccucuagcuguauucgcggauccaauucaaguuucuucagccgacugaacuggcucacccauuuaaauucuaaguacccagcacugaacgugacgaugcccaacaaugagcaguuugacaaacuuuauaucuggggcguccaccauccuggcacugauaaggaccagauuuucuuguacgcccaguccucagggcguaucaccgugagcacaaagagaagucaacaggcuguaauaccaaacauuggaucuaggccccggauccgcgauauuccuuccagaaucagcaucuauuggacuauuguuaaaccaggugacauacugcuaaucaauucgaccggcaaccucauugccccgaggggguacuuuaagauccggucuggaaaauccucaauaaugcgcagugacgcgcccauuggcaagugcaagagcgaauguaucacaccuaaugguuccaucccaaacgauaaacccuuccagaaugugaaccgaauuaccuacggggcaugcccuagauaugucaagcagucuacgcugaaacuugccacuggaaugaggaaugugccagagcggcaaacacguggcaucuuuggcgcuauugccggguucauagaaaacggaugggaggguaugguggacggcugguacggguuucgccaccagaauagcgagggaagaggccaggcagcugaucugaagucaacccaagccgcgaucgaccagauuaacgguaaauugaauaggcucaucgggaagacuaacgaaaaauuccaccagaucgagaaggaauuuagugaggucgaaggccggauucaggaucuggagaaguauguugaggacacaaaaauagauuuaugguccuacaaugccgaacugcucguggcacuugagaaccaacauaccaucgaccugacggauagcgaaaugaacaaguuguuugagaaaaccaagaaacagcuacgagaaaaugcugaggacaugggaaacggcuguuucaagauuuaucacaagugcgauaaugccugcaucgggucuauucgcaacggaacauacgaccauaauguauauagagacgaggcucugaacaauagguuucagaucaaagguguggaacucaagucaggcuacaaagauuggauacuguggaucaguuucgccauuagcuguuuucuucugugcgucgcauugcucggguucaucaugugggccugucagaagggaaacauucggugcaauaucuguauauga

SEQ ID NO: 135238 - RNA, 1701 nt, Artificial Sequence; identical to SEQ ID NO: 132010
  derived and/or modified sequence opt3 from hemagglutinin__InfluenzaA__ALE31691

SEQ ID NO: 135239 - RNA, 1701 nt, Artificial Sequence
  derived and/or modified sequence opt3 from hemagglutinin__InfluenzaA__ALE31692
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuauacuuacccagcauuaaaugugaccaugcccaacaacgagcaguuugacaagcuguauauuuggggaguccaccauccuggcacagauaaagaccagaucuuccuuuacgcccguucuuccggcagaauaacugugucaaccaagaggagccagcaagcuguaauuccaaauaucggguaccggccccgcauuagagauaucccuaguaggaucucuauuuauuggacaauaguuaaaccaggagacaucuugcugauuaacuccaccgguaaucuaaucgccccgcggggcuacuuuaagauacgcagcgggaaaucgucuauuaugcgauccgacgcgcccaucggaaaguguaagucagaaugcaucacgccuaacggcaguauuccaaaugauaaacccuuccagaacgugaauagaaucacuuauggugcauguccuagguacgucaagcacagcacacucaaacuggccaccgggaugcggaacgugccagagaagcagacucguggaauuuuuggcgcuauagccggcuucaucgaaaaugggugggagggaaugguggacgguugguauggcuuucgccaccagaacuccgaggggagaggacaagcagcugaucuuaaaucuacacaggccgcgauugaccagaucaauggcaagcugaacagguugaucgguaaaaccaaugaaaaguuccaucaaauugagaaggaauuuagcgaggucgaagggcggauacaggaucucgagaaauacguugaggacacgaagaucgaucuguggucauauaacgccgaauuacugguggcacucgagaaucagcacaccauugaccuuacagauagugaaaugaacaaacuguuugagaagacuaaaaagcaguugcgagaaaacgcugaggacaugggcaauggaugcuucaagaucuaccauaaaugugauaacgccugcauuggcuccauccgcaaugggaccuacgaccacaacguauauagagacgaggcucuaaauaacagguuucaaauaaagggaguggaacugaaaagcgguuacaaggauuggauccucuggauuucuuucgccaucucaugcuuucugcuuugugucgcacuguugggcuucauuaugugggccugccagaaagggaauauccgguguaacauaugcauuuga

SEQ ID NO: 135240 - RNA, 1701 nt, Artificial Sequence; identical to SEQ ID NO: 135239
  derived and/or modified sequence opt3 from hemagglutinin__InfluenzaA__ALE31693

SEQ ID NO: 135241 - RNA, 1701 nt, Artificial Sequence; identical to SEQ ID NO: 134457
  derived and/or modified sequence opt3 from hemagglutinin__InfluenzaA__ALE31694

SEQ ID NO: 135242 - RNA, 1701 nt, Artificial Sequence; identical to SEQ ID NO: 135239
  derived and/or modified sequence opt3 from hemagglutinin__InfluenzaA__ALE31695

SEQ ID NO: 135243 - RNA, 1701 nt, Artificial Sequence; identical to SEQ ID NO: 135115
  derived and/or modified sequence opt3 from hemagglutinin__InfluenzaA__ALE31696

SEQ ID NO: 135244 - RNA, 1701 nt, Artificial Sequence; identical to SEQ ID NO: 135239
  derived and/or modified sequence opt3 from hemagglutinin__InfluenzaA__ALE31697

SEQ ID NO: 135245 - RNA, 1701 nt, Artificial Sequence
  derived and/or modified sequence opt3 from hemagglutinin__InfluenzaA__ALE31698
augaagaccaucauugcccugagcuacauacucugcaugguguucgcucagaaaauccccggcaacgacaauuccacagcaacucuuugucuggggcaccaugccgucccuaacggaacgauuguuaagaccaucacaaaugauagaauugaggugacuaacgcgaccgaauugguacaaaauucuucaaucggugagauaugcgacaguccacaccagaucuuagauggcgaaaacuguacacugauugacgcucuacucggggauccgcagugcgacggauuucagaauaaaaagugggaucuguucguggagaggagcaaagccuauuccaacuguuaccccuaugacgucccugauuacgcaucucuucggucgcugguggccucaagcggcaccuuggaauuuaauaacgagaguuucaauuggacugguguuacacaaaacgggaccuccucugcuugcauccgccgaagcuccucaaguuucuucagccgucucaauuggcugacgcaucugaacuauacuuacccagcacucaaugugaccaugcccaacaacgagcaguuugacaaguuauauauuuggggaguccaccauccuggcacagauaaggaccagaucuuccuguacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacauccuuuugauuaacagcaccgguaaucugaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacuaaagcucgccaccgggaugcggaacgugccagagaaacagacucguggaauuuuuggcgcuauagccggcuucaucgaaaaugggugggagggaaugguggacgguugguacggcuuucgccaccaaaacucugaggggagaggacaggcagcugaucuuaagagcacacaggccgcgauugaccaaaucaauggcaaacuuaacaggcugaucgguaagaccaaugaaaaauuccaucagauugagaaggaauuuucagaggucgaagggcggauacaggauuuggagaaguauguugaggacacgaaaaucgaucucuggaguuacaacgccgaacuguuaguggcacuggagaaucagcacaccauugaccucacagauuccgaaaugaacaagcuguuugagaaaacuaagaaacaacugcgagaaaacgcugaggacaugggcaauggaugcuucaagaucuaucauaagugugauaacgccugcauuggcagcauccgcaaugggaccuacgaccacaacguauacagagacgaggcuuugaauaacagguuucagauaaaaggaguggaacuaaagucugguuauaaagauuggauccuguggauuucauucgccaucaguugcuuucuccugugugucgcacuucugggcuucauuaugugggccugccagaaggggaauauccgguguaacauaugcauuuga

SEQ ID NO: 135246 - RNA, 1701 nt, Artificial Sequence
  derived and/or modified sequence opt3 from hemagglutinin__InfluenzaA__ALE31699
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccuaauuacgcaucucugcggucguugguggccucaagcggcacccucgaauuuaacaaugagaguuucaacuggacugguguuacacaaaaugggaccuccucugcuugcauccgccgaagcuccucaaguuucuucagccgucugaacuggcugacgcaucucaauuaugcauacccagccuuaaacgugacuaugcccaacaaugagcaguuugauaagcuguauauuuggggaguccaccauccuggcaccgacaaggaucagaucuuccuuuacgcucagucuuccggcagaauaacagugucaacuaaaaggagccaacaggccguaauuccaaacaucgggagucggccccgcauuagagacaucccuucuaggaucuccauuuacuggaccauaguuaagccaggagauaucuugcugauuaauagcacagguaaccuaaucgcgccgcggggcuauuuuaaaauacgcucggggaagucuuccauuaugcgaucagacgcacccaucggaaaauguaagagugaaugcaucaccccuaauggcagcauuccaaacgacaagcccuuccagaaugugaacagaaucacguacggugccuguccuagguaugucaaacacuccacucucaagcuggcuacagggaugcggaaugugccagagaaacagacccguggaauuuuuggcgccauagcaggcuucaucgaaaacgggugggagggaaugguggaugguugguacggcuuucgccaccaaaauucugaggggagaggacaggcugccgaccuuaagagcacucaggcggccauugaucaaaucaacggcaaacugaauagguugaucgguaagacaaacgaaaaauuccaucagauugagaaggaauuuucagaggucgaagggcggauacaggaccucgagaaguauguugaggauaccaaaaucgaccuguggaguuacaaugcagaauuacugguggcucucgagaaccagcacacgauugaucuuaccgacuccgaaaugaacaagcuguuugagaaaacaaagaaacaauugcgagaaaaugccgaggauaugggcaacggaugcuucaagaucuaucauaagugugacaaugcuugcauuggcagcauccgcaacgggacuuacgaucacaauguauacagagacgaggcccuaaacaauagguuucagauaaaaggaguggaacugaagucugguuauaaagacuggauccucuggauuucauucgcaaucaguugcuuucugcuuugugucgcccuguugggcuucauuaugugggcuugccagaaggggaacauccgguguaauauaugcauuuga

SEQ ID NO: 135247 - RNA, 1701 nt, Artificial Sequence; identical to SEQ ID NO: 134457
  derived and/or modified sequence opt3 from hemagglutinin__InfluenzaA__ALE31700

SEQ ID NO: 135248 - RNA, 1701 nt, Artificial Sequence; identical to SEQ ID NO: 134457
  derived and/or modified sequence opt3 from hemagglutinin__InfluenzaA__ALE31701

SEQ ID NO: 135249 - RNA, 1701 nt, Artificial Sequence; identical to SEQ ID NO: 135014
  derived and/or modified sequence opt3 from hemagglutinin__InfluenzaA__ALE31702

SEQ ID NO: 135250 - RNA, 1701 nt, Artificial Sequence; identical to SEQ ID NO: 134457
  derived and/or modified sequence opt3 from hemagglutinin__InfluenzaA__ALE31703

SEQ ID NO: 135251 - RNA, 1701 nt, Artificial Sequence; identical to SEQ ID NO: 134457
  derived and/or modified sequence opt3 from hemagglutinin__InfluenzaA__ALE31704

SEQ ID NO: 135252 - RNA, 1701 nt, Artificial Sequence; identical to SEQ ID NO: 135014
  derived and/or modified sequence opt3 from hemagglutinin__InfluenzaA__ALE31705

SEQ ID NO: 135253 - RNA, 1701 nt, Artificial Sequence
  derived and/or modified sequence opt3 from hemagglutinin__InfluenzaA__ALE31706
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaagggagccaacaggcuguaauuccaaauaucggaaguaggccccggauucgcgauaucccuucuagaaucuccauuuacuggacaauaguuaagccaggugacaucuugcugauuaacagcaccggcaaucuaaucgccccgaggggguauuuuaaaauacggucgggaaagucuuccauuaugcgcucagacgcgcccaucggcaaauguaagagugaaugcaucacgccuaacgguagcauuccaaaugauaagcccuuccagaacgugaaucgaaucacuuacggggcauguccuagauaugucaaacacuccacacucaagcuggccaccggaaugaggaacgugccagagaaacagacucggggcauuuuuggcgcuauagccggguucaucgaaaauggaugggaggguaugguggacggcugguacggguuucgucaccaaaacucugagggacgcggccaggcagcugaucuuaagagcacacaggccgcgauugaccaaaucaaugguaaacugaacagauugaucgggaagaccaaugaaaaauuccaucagauugagaaggaauuuucagaggucgaaggcaggauacaggaucucgagaaguauguugaggacacgaaaaucgaucuguggaguuacaacgccgaauuacugguggcacucgagaaucagcacaccauugaccuuacagauuccgaaaugaacaagcuguuugagaaaacuaagaaacaauugcgggaaaacgcugaggacaugggaaauggcugcuucaagaucuaucauaagugugauaacgccugcauugggagcauccgaaauggaaccuacgaccacaacguauaccgcgacgaggcucuaaauaacagauuucagauaaaagguguggaacugaagucuggcuauaaagauuggauccucuggauuucauucgccaucaguugccugcuucugugugucgcauugcucggguuuauuaugugggccugccagaagggaaauaucagguguaacauaugcauuuga

SEQ ID NO: 135254 - RNA, 1701 nt, Artificial Sequence; identical to SEQ ID NO: 135143
  derived and/or modified sequence opt3 from hemagglutinin__InfluenzaA__ALE31707

SEQ ID NO: 135255 - RNA, 1701 nt, Artificial Sequence; identical to SEQ ID NO: 135143
  derived and/or modified sequence opt3 from hemagglutinin__InfluenzaA__ALE31708

SEQ ID NO: 135256 - RNA, 1701 nt, Artificial Sequence; identical to SEQ ID NO: 134443
  derived and/or modified sequence opt3 from hemagglutinin__InfluenzaA__ALE31709

SEQ ID NO: 135257 - RNA, 1701 nt, Artificial Sequence
  derived and/or modified sequence opt3 from hemagglutinin__InfluenzaA__ALE31710
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucgguugcgcauuagagauauccccucuaggaucuccauuuacuggacaauaguuaagccuggagacauccugcuaauuaacagcaccgguaaucucaucgccccacggggcuauuuuaaaauacugucggggaagucuuccauuaugcgcucagacgcgccgaucggaaaauguaagagugaaugcaucacgcccaacggcagcauuccuaaugauaagccauuccagaacgugaaucgaaucacuuacggugcaugucccagauaugucaaacacuccacacuuaagcuggccaccgggaugaggaacgugccugagaaacagacucggggaauuuuuggcgcuauagccggcuucaucgaaaaugggugggagggaaugguggacgguugguacggcuuucgucaccaaaacucugaggggcgcggacaggcagcugaucucaagagcacacaggccgcgauugaccaaaucaauggcaaauugaacagacugaucgguaagaccaaugaaaaauuccaucagauugagaaggaauuuucagaggucgaagggaggauacaggauuuagagaaguauguugaggacaguaaaaucgaucugugguccuacaacgccgaacuccuuguggcacuggagaaucagcacacgauugacuugaccgauagcgaaaugaacaagcuauuugagaaaacaaagaaacaacugcgggaaaacgcugaggacaugggcaauggaugcuucaagaucuaucauaagugugauaacgccugcauuggcucuauccgaaaugggacuuacgaccacaacguauaccgcgacgaggcucucaauaacagauuucagauaaaaggaguggaacugaagucagguuauaaagauuggauccuuuggauuaguuucgccaucagcugcuuucuguugugugucgcacuccugggcuucauuaugugggccugccagaaggggaauaucagguguaacauaugcauuuga

SEQ ID NO: 135258 - RNA, 1701 nt, Artificial Sequence; identical to SEQ ID NO: 135143
  derived and/or modified sequence opt3 from hemagglutinin__InfluenzaA__ALE31711

SEQ ID NO: 135259 - RNA, 1701 nt, Artificial Sequence; identical to SEQ ID NO: 135001
  derived and/or modified sequence opt3 from hemagglutinin__InfluenzaA__ALE31712

SEQ ID NO: 135260 - RNA, 1701 nt, Artificial Sequence
  derived and/or modified sequence opt3 from hemagglutinin__InfluenzaA__ALE31713
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuauacuuacccagcauuaaaugugaccaugcccaacaacgagcaguuugacaagcuguauauuuggggaauccaccauccuggcacagauaaagaccagauauuccuuuacgcccguucuuccggcagaauuacugucucaaccaagaggagccagcaagcugugaucccaaauauugggagucggccccgcaucagagauaucccuucuaggauuuccauauacuggacaaucguaaaaccaggagacauuuugcugaucaacagcaccgguaaucuaauagccccgcggggcuauuuuaagauucgcucggggaaaucuuccaucaugcgaucagacgcgcccaucggaaaguguaagagugaaugcauuacgccuaacggcagcaucccaaaugauaaacccuuccagaacguuaauagaauuacuuacggugcauguccuagguaugugaagcacuccacacucaaacuggccaccgggaugcggaacauaccagagaagcagacuaaaggaaucuuuggcgcuauugccggcuucaucgaaaaugggugggagggaauggucgacgguugguacggcuuucgucaccagaacucugaggggcgcggacaagcagcugaucuuaagagcacacaggccgcgaucgaccagauuaauggcaaacugaacagauugauagguaagaccaaugaaaaguuccaucaaaucgagaaagaauuuucagagguggaagggaggauucaggaucucgagaaguauguggaggacacgaaaaucgaucuguggaguuacaacgccgaauuacuggucgcacucgagaaucagcacaccauugaccuuacagauuccgaaaugaacaagcuguuugagaaaacuaagaagcaguugcgggaaaacgcugaggacaugggcaauggaugcuucaaaaucuaucauaagugugauaacgccugcauaggcagcauccgaaaugggaccuacgaccacaacguuuaccgcgacgaggcucuaaauaacagauuucaaauuaaaggaguggaacugaagucugguuauaaagauuggauccucuggauuucauucgccacaaguugcuuucugcuuuguguagcacuguugggcuucaucaugugggccugccagaaggggaauauaagguguaacauuugcaucuga

SEQ ID NO: 135261 - RNA, 1701 nt, Artificial Sequence; identical to SEQ ID NO: 135115
  derived and/or modified sequence opt3 from hemagglutinin__InfluenzaA__ALE31714

SEQ ID NO: 135262 - RNA, 1701 nt, Artificial Sequence; identical to SEQ ID NO: 135115
  derived and/or modified sequence opt3 from hemagglutinin__InfluenzaA__ALE31715

SEQ ID NO: 135263 - RNA, 1701 nt, Artificial Sequence; identical to SEQ ID NO: 135143
  derived and/or modified sequence opt3 from hemagglutinin__InfluenzaA__ALE31716

SEQ ID NO: 135264 - RNA, 1701 nt, Artificial Sequence
  derived and/or modified sequence opt3 from hemagglutinin__InfluenzaA__ALE31717
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuauaaguacccagcauuaaaugugacuaugcccaacaacgagcaguuugacaaacuguauauuuggggaguccaccauccuggcaccgauaaggaccagaucuuccuuuacgcccguucuuccggcagaauaacagugucaacuaaaaccagccagcaagcuguaauuccaaauaucgggaguaggccccggauucgcgauaucccuucuagaaucuccauuuacuggacaauaguuaagccaggagacaucuugcugauuaacagcaccgguaaucuaaucgccccgaggggcuauuuuaaaauacggucggggaagucuuccauuaugcgcucagacgcgcccaucggaaaguguaaaagugaaugcaucacgccuaacggcagcauuccaaaugauaagcccuuccagaacgugaaucgaacuacauacggugcauguccuagauaugucaaacacuccacccucaagcuggccacugggaugaggaacgugccagagaaacagacacggggaaucuuuggcgcuauugccggcuucauagaaaaugggugggagggaaugguggacgguugguacggcuuucgucaccagaacucugaggggcgcggacaagcagcugaucuuaagagcacccaggccgcgaucgaccagauuaauggcaaacugaacagauugaucgguaagacgaaugaaaaguuccaucaaaucgagaaagaauuuucagaggucgaagggaggauucaggaucucgagaaguauguugaggacaccaaaauagaucuguggaguuacaacgccgaauuacugguggcacucgagaaucagcacacaaucgaccuuacugauuccgaaaugaacaagcuguuugagaaaaccaagaagcaguugcgggaaaacgcugaggacaugggcaauggaugcuucaaaauuuaucauaagugugauaacgccugcaucggcagcauucgaaaugggacauacgaccacaacguauaccgcgacgaggcucuaaauaacagauuucaaaucaaaggaguggaacugaagucugguuauaaagauuggauacucuggaucucauucgccauuaguugcuuucugcuuugugucgcacuguugggcuucaucaugugggccugccagaaggggaauauuagguguaacaucugcauauga

SEQ ID NO: 135265 - RNA, 1701 nt, Artificial Sequence; identical to SEQ ID NO: 135115
  derived and/or modified sequence opt3 from hemagglutinin__InfluenzaA__ALE31718

SEQ ID NO: 135266 - RNA, 1701 nt, Artificial Sequence
  derived and/or modified sequence opt3 from hemagglutinin__InfluenzaA__ALE31719
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuauacuuacccagcauuaaaugugaccaugcccaacaacgagcaguuugacaagcuguauauuuggggaguccaccauccuggcacagauaaagaccagaucuuccuuuacgcccguucuuccggcagaauaacugugucaaccaagaggagccagcaagcuguaauuccaaauaucgggagucggccccgcauuagagauaucccuucuaggaucuccauuuacuggacaauaguuaaaccaggagacaucuugcugauuaacagcaccgguaaucuaaucgccccgcggggcuauuuuaagauacgcucggggaaaucuuccauuaugcgaucagacgcgcccaucggaaaguguaagagugaaugcaucacgccuaacggcagcauuccaaaugauaaacccuuccagaacgugaauagaaucacuuacggugcauguccuagguaugucaagcacuccacacucaaacuggccaccgggaugcggaacauuccagagaagcagacucguggaauauuuggcgcuaucgccggcuucauugaaaaugggugggagggaaugguggacgguugguacggcuuucgccaccagaacucugaggggagaggacaagcagcugaucuuaaaagcacacaggccgcgaucgaccagaucaauggcaagcugaacagguugauugguaaaaccaaugaaaaguuccaucaaauagagaaggaauuuucagagguggaagggcggauccaggaucucgagaaauaugucgaggacacgaagauugaucuguggaguuacaacgccgaauuacugguugcacucgagaaucagcacaccaucgaccuuacagauuccgaaaugaacaaacuguuugagaagacuaaaaagcaguugcgagaaaacgcugaggacaugggcaauggaugcuucaagauuuaucauaaaugugauaacgccugcaucggcagcauacgcaaugggaccuacgaccacaacguguacagagacgaggcucuaaauaacagguuucaaaucaagggaguagaacugaaaucugguuauaaggauuggauucucuggaucucauucgccauuaguugcuuucugcuuuguguggcacuguugggcuucaucaugugggccugccagaaagggaauauacgguguaacauuugcaucuga

SEQ ID NO: 135267 - RNA, 1701 nt, Artificial Sequence; identical to SEQ ID NO: 135001
  derived and/or modified sequence opt3 from hemagglutinin__InfluenzaA__ALE31720

SEQ ID NO: 135268 - RNA, 1701 nt, Artificial Sequence; identical to SEQ ID NO: 135014
  derived and/or modified sequence opt3 from hemagglutinin__InfluenzaA__ALE31721

SEQ ID NO: 135269 - RNA, 1701 nt, Artificial Sequence; identical to SEQ ID NO: 135237
  derived and/or modified sequence opt3 from hemagglutinin__InfluenzaA__ALE31722

SEQ ID NO: 135270 - RNA, 1701 nt, Artificial Sequence
  derived and/or modified sequence opt3 from hemagglutinin__InfluenzaA__ALE31723
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuauacuuacccagcauuaaaugugaccaugcccaacaacgagcaguuugacaagcuguauauuuggggaguccaccauccuggcacagauaaagaccagaucuuccuuuacgcccguucuuccggcagaauaacugugucaaccaagaggagccagcaagcuguaauuccaaauaucgggagucggccccgcauuagagauaucccuucuaggaucuccauuuacuggacaauaguuaaaccaggagacaucuugcugauuaacagcaccgguaaucuaaucgccccgcggggcuauuuuaagauacgcucggggaaaucuuccauuaugcgaucagacgcgcccaucggaaaguguaagagugaaugcacgacuccuaacggcagcaucccaaaugauaaacccuuccagaacgugaauagaauuacauacggugcauguccuagguaugucaagcacuccacccucaaacuggccacugggaugcggaacgugccagagaagcagacacguggaaucuuuggcgcuauugccggcuucauagaaaaugggugggagggaaugguggacgguugguacggcuuucgccaccagaacucugaggggagaggacaagcagcugaucuuaaaagcacccaggccgcgaucgaccagauuaauggcaagcugaacagguugaucgguaaaacgaaugaaaaguuccaucaaaucgagaaggaauuuucagaggucgaagggcggauucaggaucucgagaaauauguugaggacaccaagauagaucuguggaguuacaacgccgaauuacugguggcacucgagaaucagcacacaaucgaccuuacugauuccgaaaugaacaaacuguuugagaagaccaaaaagcaguugcgagaaaacgcugaggacaugggcaauggaugcuucaagauuuaucauaaaugugauaacgccugcaucggcagcauucgcaaugggacauacgaccacaacguauacagagacgaggcucuaaauaacagguuucaaaucaagggaguggaacugaaaucugguuauaaggauuggauacucuggaucucauucgccauuaguugcuuucugcuuugugucgcacuguugggcuucaucaugugggccugccagaaagggaauauucgguguaacaucugcauauga

SEQ ID NO: 135271 - RNA, 1701 nt, Artificial Sequence; identical to SEQ ID NO: 134457
  derived and/or modified sequence opt3 from hemagglutinin__InfluenzaA__ALE31724

SEQ ID NO: 135272 - RNA, 1701 nt, Artificial Sequence; identical to SEQ ID NO: 134457
  derived and/or modified sequence opt3 from hemagglutinin__InfluenzaA__ALE31725

SEQ ID NO: 135273 - RNA, 1701 nt, Artificial Sequence; identical to SEQ ID NO: 134457
  derived and/or modified sequence opt3 from hemagglutinin__InfluenzaA__ALE31726

SEQ ID NO: 135274 - RNA, 1701 nt, Artificial Sequence; identical to SEQ ID NO: 134457
  derived and/or modified sequence opt3 from hemagglutinin__InfluenzaA__ALE31727

SEQ ID NO: 135275 - RNA, 1701 nt, Artificial Sequence
  derived and/or modified sequence opt3 from hemagglutinin__InfluenzaA__ALE31728
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccauucccaacaacgagcaguuugacaagcuguauaucuggggaguccaccauccuggcacagauaaggaccagauauuccuuuacgcccagucuuccggcagaauuacugugucaaccaaaaggagccaacaggcuguaaucccaaauauugggagucggccccgcaucagagauaucccuucuaggauuuccauauacuggacaaucguuaagccaggagacauuuugcugaucaacagcaccgguaaucuaauagccccgcggggcuauuuuaaaauucgcucggggaagucuuccaucaugcgaucagacgcgcccaucggaaaauguaagagugaaugcauuacgccuaacggcagcaucccaaaugauaagcccuuccagaacgugaauagaauuacuuacggugcauguccuagguaugucaaacacuccacacucaagcuggccaccgggaugcggaacgugccagagaaacagacucguggaauauuuggcgcuaucgccggcuucauugaaaaugggugggagggaaugguggacgguugguacggcuuucgccaccaaaacucugaggggagaggacaggcagcugaucuuaagagcacacaggccgcgaucgaccaaaucaauggcaaacugaacagguugauugguaagaccaaugaaaaauuccaucagauagagaaggaauuuucagaggucgaagggcggauccaggaucucgagaaguauguugaggacacgaaaauugaucuguggaguuacaacgccgaauuacugguggcacucgagaaucagcacaccaucgaccuuacagauuccgaaaugaacaagcuguuugagaaaacuaagaaacaauugcgagaaaacgcugaggacaugggcaauggaugcuucaagauuuaucauaagugugauaacgccugcaucggcagcauacgcaaugggaccuacgaccacaacguauacagagacgaggcucuaaauaacagguuucagaucaaaggaguggaacugaagucugguuauaaagauuggauucucuggaucucauucgccauuaguugcuuucugcuuugugucgcacuguugggcuucaucaugugggccugccagaaggggaauauacgguguaacauuugcaucuga

SEQ ID NO: 135276 - RNA, 1701 nt, Artificial Sequence
  derived and/or modified sequence opt3 from hemagglutinin__InfluenzaA__ALE31729
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagaucauugauggcgaaaacuguacacugaucgacgcucuacucggggauccgcagugcgacggauuucagaauaaaaagugggaucuguucguggagaggagcaaagccuauuccaacuguuaccccuaugacgucccugauuacgcaucucuucggucgcugguggccucaagcggcaccuuggaauuuaauaacgagaguuucaauuggacugguguuacacaaaacgggaccuccucugcuugcauucgccgaagcuccucaaguuucuucagccgucucaauuggcugacgcaucugaacuauacuuacccagcacucaaugugaccaugcccaacaacgagcaguuugacaaguuauauaucuggggaguccaccauccuggcacagauaaggaccagauauuccuguacgcccagucuuccggcagaauuacugugucaaccaaaaggagccaacaggcuguaaucccaaauauugggagucggccccgcaucagagauaucccuucuaggauuuccauauacuggacaaucguuaagccaggagacauucuuuugaucaacagcaccgguaaucugauagccccgcggggcuauuuuaaaauucgcucggggaagucuuccaucaugcgaucagacgcgcccaucggaaaauguaagagugaaugcauuacgccuaacggcagcaucccaaaugauaagcccuuccagaacgugaauagaauuacuuacggugcauguccuagguaugucaaacacuccacacuaaagcucgccaccgggaugcggaacgugccagagaaacagacucguggaauauuuggcgcuaucgccggcuucauugaaaaugggugggagggaaugguggacgguugguacggcuuucgccaccaaaacucugaggggagaggacaggcagcugaucuuaagagcacacaggccgcgaucgaccaaaucaauggcaaacuuaacaggcugauugguaagaccaaugaaaaauuccaucagauagagaaggaauuuucagaggucgaagggcggauccaggauuuggagaaguauguugaggacacgaaaauugaucucuggaguuacaacgccgaacuguuaguggcacuggagaaucagcacaccaucgaccucacagauuccgaaaugaacaagcuguuugagaaaacuaagaaacaacugcgagaaaacgcugaggacaugggcaauggaugcuucaagauuuaucauaagugugauaacgccugcaucggcagcauacgcaaugggaccuacgaccacaacguauacagagacgaggcuuugaauaacagguuucagaucaaaggaguggaacuaaagucugguuauaaagauuggauucuguggaucucauucgccauuaguugcuuucuccugugugucgcacuucugggcuucaucaugugggccugccagaaggggaauauacgguguaacauuugcaucuga

SEQ ID NO: 135277 - RNA, 1701 nt, Artificial Sequence; identical to SEQ ID NO: 134457
  derived and/or modified sequence opt3 from hemagglutinin__InfluenzaA__ALE31730

SEQ ID NO: 135278 - RNA, 1701 nt, Artificial Sequence
  derived and/or modified sequence opt3 from hemagglutinin__InfluenzaA__ALE31731
augaagaccaucauugcccugagcuacauacucugccagguguucgcucagaaaauccccggcaacgacaauuccacagcaacucuuugucuggggcaccaugccgucccuaacggaacgauuguuaagaccaucacaaaugauagaauugaggugacuaacgcgaccgaauugguacaaaauucuucaaucggugagauaugcgacaguccacaccagaucuuagauggcgaaaacuguacacugauugacgcucuacucggggauccgcagugcgacggauuucaaaauaaaaagugggaucuguucguggagaggagcaaagccuauuccaacuguuaccccuaugacgucccugauuacgcaucucuucggucgcugguggccucaagcggcaccuuggaauuuaauaacgagaguuucaauuggacugguguuacacagaacgggaccuccucugcuugcauccgcaagagcuccucaaguuucuucagccgacucaauuggcugacgcaucugaacuauacuuacccagcacucaaugugaccaugcccaacaacgagcaguuugacaaguuauauauuuggggaguccaccauccuggcacagauaaagaccagaucuuccuguacgcccguucuuccggcagaauaacugugucaaccaagaggagccaacaggcuguaauuccaaauaucgggagucggccccgcauuagagauaucccuucuaggaucuccauuuacuggacaauaguuaaaccaggagacauccuuuugauuaacagcaccgguaaucugaucgccccgcggggcuauuuuaagauacgcucggggaaaucuuccauuaugcgaucagacgcgcccaucggaaaguguaagagugaaugcaucacgccuaacggcagcauuccaaaugauaaacccuuccagaacgugaauagaaucacuuacggugcauguccuagguaugucaagcacuccacacuaaaacucgccaccgggaugcggaacgugccagagaagcagacucguggaauuuuuggcgcuauagccggcuucaucgaaaaugggugggagggaaugguggacgguugguacggcuuucgccaccaaaacucugaggggagaggacaggcagcugaucugaaaagcacacaggccgcgauugaccaaaucaauggcaaacuuaacaggcugaucgguaagaccaaugaaaaguuccaucagauugagaaggaauuuucagaggucgaagggcggauacaggauuuggagaaauauguugaggacacgaagaucgaucucuggaguuacaacgccgaacuguuaguggcacuggagaaucagcacaccauugaccucacagauuccgaaaugaacaaacuuuuugagaagacuaaaaagcaacugcgagaaaacgcugaggacaugggcaauggaugcuucaagaucuaucauaaaugugauaacgccugcauuggcagcauccgcaaugggaccuacgaccacaacguauacagagacgaggcuuugaauaacagguuucagauaaagggaguggaacuaaaaucugguuauaaggauuggauccuguggauuucauucgccaucaguugcuuucuccugugugucgcacuucugggcuucauuaugugggccugccagaaagggaauauccgguguaacauaugcauuuga

SEQ ID NO: 135279 - RNA, 1701 nt, Artificial Sequence; identical to SEQ ID NO: 135115
  derived and/or modified sequence opt3 from hemagglutinin__InfluenzaA__ALE31732

SEQ ID NO: 135280 - RNA, 1701 nt, Artificial Sequence; identical to SEQ ID NO: 135115
  derived and/or modified sequence opt3 from hemagglutinin__InfluenzaA__ALE31733

SEQ ID NO: 135281 - RNA, 1701 nt, Artificial Sequence
  derived and/or modified sequence opt3 from hemagglutinin__InfluenzaA__ALE31734
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucauccuuuuucagccgacugaauuggcugacgcaucucaaguauacuuacccagcauuaaacgugaccaugcccaauaacgagcaguuugacaaacuguauauuuggggaguccaccauccuggcacagauaaggaccagaucuuccuuuacgcccguucuuccggcagaauaacugugucaaccaaaaggagccagcaagcuguaauuccaaacaucggguuucggccccgcauuagagauaucccuaguaggaucucuauuuacuggacaauaguuaagccaggagacaucuugcugauuaauuccaccgguaaccuaaucgccccgcggggcuauuucaaaauacgcagcgggaagucgucuauuaugcgauccgacgcgcccaucggaaaguguaaaucagaaugcaucacgccuaauggcaguauuccaaacgauaagcccuuucagaaugugaacagaaucacuuacggugcauguccuagguaugucaaacacagcacacucaagcuggccaccgggaugcggaaugugccagagaaacagacucguggaauuuucggcgcuauagccggcuuuaucgaaaacgggugggagggaaugguggacgguugguacggcuuccgccaccagaauagugaggggagaggacaagcagcugaucuuaagucuacacaggccgcgauugaccagaucaacggcaaacugaauagguugaucgguaagaccaacgaaaaguuccaucaaauugagaaagaauuuagcgaggucgaagggcggauacaggaucucgagaaguauguugaggacacgaaaaucgaucuguggucauacaaugccgaauuacugguggcacucgagaaccagcacaccauugaccuuacagauagugaaaugaauaagcuguucgagaaaacuaagaagcaguugcgagaaaacgcugaggacaugggcaacggaugcuuuaaaaucuaucauaagugugauaaugccugcauuggcuccauccgcaacgggaccuacgaccacaauguauacagagacgaggcucuaaacaauagguuccaaauaaaaggaguggaacucaagagcgguuauaaagauuggauccuguggauuucuuuugccaucucaugcuuccugcuuugugucgcacuguugggcuuuauuaugugggccugccagaaggggaacauccgguguaauauaugcauuuga

SEQ ID NO: 135282 - RNA, 1701 nt, Artificial Sequence; identical to SEQ ID NO: 135115
  derived and/or modified sequence opt3 from hemagglutinin__InfluenzaA__ALE31735

SEQ ID NO: 135283 - RNA, 1701 nt, Artificial Sequence; identical to SEQ ID NO: 135014
  derived and/or modified sequence opt3 from hemagglutinin__InfluenzaA__ALE31736

SEQ ID NO: 135284 - RNA, 1701 nt, Artificial Sequence; identical to SEQ ID NO: 135014
  derived and/or modified sequence opt3 from hemagglutinin__InfluenzaA__ALE31737

SEQ ID NO: 135285 - RNA, 1701 nt, Artificial Sequence
  derived and/or modified sequence opt3 from hemagglutinin__InfluenzaA__ALE31738
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauaaguacccagcauuaaaugugacuaugcccaacaacgagcaguuugacaagcuguauauuuggggaguccaccauccuggcaccgauaaagaccagaucuuccuuuacgcccagucuuccggcagaauaacagugucaacuaaggggagccaacaggcuguaauuccaaauaucggaaguaggccccggauucgcgauaucccuucuagaaucuccauuuacuggaccauaguuaaaccaggugacaucuugcugauuaacagcacaggcaaucuaaucgccccgaggggguauuuuaagauacggucgggaaaaucuuccauuaugcgcucagacgcgcccaucggcaaguguaagagugaaugcaucaccccuaacgguagcauuccaaaugauaaacccuuccagaacgugaaucgaaucacguacggggcauguccuagauaugucaagcacuccacucucaaacuggccacaggaaugaggaacgugccagagaagcagacccggggcauuuuuggcgcuauagccggguucaucgaaaauggaugggaggguaugguggacggcugguacggguuucgucaccaaaacucugagggacgcggccaggcagcugaucuuaaaagcacucaggccgcgauugaccaaaucaaugguaagcugaacagauugaucgggaaaacaaaugaaaaguuccaucagauugagaaggaauuuucagaggucgaaggcaggauacaggaucucgagaaauauguugaggacaccaagaucgaucuguggaguuacaacgccgaauuacugguggcacucgagaaucagcacacgauugaccuuaccgauuccgaaaugaacaaacuguuugagaagacuaaaaagcaauugcgggaaaacgcugaggacaugggaaauggcugcuucaagaucuaucauaaaugugauaacgccugcauugggagcauccgaaauggaacauacgaccacaacguauaccgcgacgaggcucuaaauaacagauuucagauaaaggguguggaacugaaaucuggcuauaaggauuggauccucuggauuucauucgccaucaguugcuuucugcuuugugucgcacuguugggguucauuaugugggccugccagaaaggaaauaucagguguaacauaugcauuuga

SEQ ID NO: 135286 - RNA, 1701 nt, Artificial Sequence; identical to SEQ ID NO: 134457
  derived and/or modified sequence opt3 from hemagglutinin__InfluenzaA__ALE31739

SEQ ID NO: 135287 - RNA, 1701 nt, Artificial Sequence
  derived and/or modified sequence opt3 from hemagglutinin__InfluenzaA__ALE31741
augaagaccaucauugcccugagcuacauacucugccuuguguucgcucagaaacugcccgagaacgacaauuccacagcaacuuuguguuuaggccaccaugccgucccuaacgggacgaucguuaagaccauuacaucugauagaaucgaagugacuaaugcgaccgagcugguacaaaacucaaguauuagcgaaaucugcgacuccccacaccagauacuagaugggaaaaauuguacacucaucgacgcucugcuuggugauccgcagugcgacggcuuucagaacaagaaaugggaucuguucguggagaggucuaaggccuauucgaauuguuaccccuaugacgucccugauuacgcaucauugcggagccucguggccaguuccgggacccuggaauuuaacgacgagucuuucaauugggcuggaguuacucaaaacggcacaagcuccgcaugcauucgcgguucaaauaguagcuuuuucucucgacugaacuggcucacccauuccaauuuuaaguauccagccuuaaacgugacgaugcccaauaacgagcaguucgauaaacuguacaucuggggaguccaccauccuggaacugacaaggaucagauuuuucuuuaugcucagucaagcggccguaucaccgugaguacaaaaagaucucaacaggccguaauaccaaacauuggcuccaggccccggauccgcaauauuccuagcagaaucucgaucuacuggacuauuguuaagccaggggacauauugcugaucaacucuaccggaaaucuaauugcgccgagggguuacuucaaaauccgguccggcaagucaaguauaaugcgcagcgacgcacccauugggaaguguaaauccgaaugcaucacaccuaacggaucuaucccaaaugauaagcccuuucagaacgugaaucgaauuaccuauggcgccuguccuagauacgucaaacagagcacgcucaagcuggcuacugguaugaggaacgugccagagaaacaaacacgggggaucuucggagccauugcaggcuuuauagaaaauggcugggaggggaugaaggacggaugguaugguuuccgucaccagaacucagagggccgcgggcaggcugccgaucuuaaaaguacccaagcggccaucgaccagauuaauggaaagcugaacagauugaucggcaagacuaaugaaaaauuccaccagaucgagaaggaauuuuccgagguggaagguaggauucaggaucucgagaaauacgucgaggacacaaagauagaucuguggagcuauaacgcagaauuacugguugcucucgagaaucaacauaccaucgaccuuacggauucugaaaugaacaaacuguucgagaagaccaagaaacaguugcgggaaaacgccgaggacauggggaauggcugcuuuaagauuuaccacaaaugugauaacgcuugcaucggaucaauucgaaauggcacauaugaccaugacguguaccgcgaugaggcccuaaacaauagauuccagaucaaggggguagaacugaaaaguggauacaaggacuggauacucuggaucagcuuugcaauuuccugcuuccugcuuuguguggcccuguuggguuuuaucaugugggcuugccagaagggcaacauuagguguaauaucugcauauga

SEQ ID NO: 135288 - RNA, 1701 nt, Artificial Sequence
  derived and/or modified sequence opt3 from hemagglutinin__InfluenzaA__ALE31742
augaagaccaucauugcccugagcuacauacucugccuuggcuucgcucagaaaauccccgggaacgacaauuccacagcaacucuguguuugggacaccaugccgugccuaacgguacgauugucaagaccaucacaaaugauagaauugagguuacuaacgcgaccgaauuagugcaaaauucuucaaucggcgagauaugcgacaguccacaccagauccuggauggggaaaacuguacacuaauugacgcucuccugggagauccgcagugcgacggcuuucagaauaaaaagugggaucuuuucguagagaggagcaaagccuauuccaacuguuaccccuaugacgugccugauuacgcaucucugcggucguuggucgccucaagcgguacccucgaauuuaauaacgagaguuucaauuggacuggggugacacaaaacggaaccuccucugcuugcauccgccgaagcuccucaaguuucuucagccgucugaauuggcugacgcaucucaacuauacuuacccagcauuaaauguuaccaugcccaacaacgagcaguuugacaagcuguauauuuggggcgugcaccauccuggcacagauaaggaccagaucuuccuuuacgcccagucuuccgggagaauaacugucucaaccaaaaggagccaacaggcugugauuccaaauaucggaagucggccccgcauuagagauaucccuucuaggaucuccauuuacuggacaauaguaaagccaggugacaucuugcugauuaacagcaccggcaaucuaaucgccccgcggggguauuuuaaaauacgcucgggaaagucuuccauuaugcgaucagacgcgcccaucggcaaauguaagagugaaugcaucacgccuaacgguagcauuccaaaugauaagcccuuccagaacguuaauagagugacuuacggggcauguccuagguaugucaaacacuccacacucaagcuggccaccggaaugcggaacgugccagagaaacagacucguggcaucuuuggcgcuauugccggguucauagaaaauggaugggaggguaugguggacggcugguacggguuucgccaccaaaacucugagggaagaggccaggcagcugaucuuaagagcacacaggccgcgaucgaccaaauuaaugguaaacugaacagguugaucgggaagaccaaugaaaaauuccaucagaucgagaaggaauuuucagaggucgaaggccggauucaggaucucgagaaguauguugaggacacgaaaauagaucuguggaguuacaacgccgaauuacugguggcacucgagaaucagcacaccaucgaccuuacagauuccgaaaugaacaagcuguuugagaaaacuaagaaacaauugcgagaaaacgcugaggacaugggaaauggcugcuucaagauuuaucauaagugugauaacgccugcaucgggagcauucgcaauggaaccuacgaccacaacguauacagagacgaggcucuaaauaacagguuucagaucaaagguguggaacugaagucuggcuauaaagauuggauacucuggaucucauucgccauuaguugcuuucugcuuugugucgcacuguugggguucaucaugugggccugccagaagggaaauauucgguguaacaucugcauauga

SEQ ID NO: 135289 - RNA, 1701 nt, Artificial Sequence; identical to SEQ ID NO: 135014
  derived and/or modified sequence opt3 from hemagglutinin__InfluenzaA__ALE31743

SEQ ID NO: 135290 - RNA, 1701 nt, Artificial Sequence; identical to SEQ ID NO: 134457
  derived and/or modified sequence opt3 from hemagglutinin__InfluenzaA__ALE31744

SEQ ID NO: 135291 - RNA, 1701 nt, Artificial Sequence
  derived and/or modified sequence opt3 from hemagglutinin__InfluenzaA__ALE31745
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcaaaaacuguacacucaucgacgcucugcuuggggauccgcagugcgacggauuucagaauaagaggugggaucuguucguggaacggagcaaagccuauuccaacuguuaccccuaugacgucccugauuacgcaucuuugcgcucgcucguggccucaagcggcacccuggaguuuaaugacgaaaguuucaacugggcugguguuacucaaaaugggacauccucugcaugcauucgaggaagcaacuccucauuuuucagucgucugaauuggcucacccauagcaacuuuaaguauccagccuuaaaugugacgaugcccaacaacgagcaguucgauaagcuguacaucuggggcguccaccauccuggcacugacaaagaucagauuuuucuuuaugcucagucuuccgggagaaucaccgugucaacaaagaggagccaacaggccguaauaccaaauauuggaagucgguugcgcaucagaaacauucccucuaggaucuccaucuacuggacuauuguuaaaccuggugacauacugcuaaucaauagcaccggcaaccucauugcgccacggggguacuucaagauccagucgggaaaaucuuccauaaugcgcucagacgcaccgauuggcaaguguaagagugagugcaucacacccaaugguagcaucccuaacgauaaaccauuucagaaugugaacaagauuaccuauggggccuguccccgauacgucaaacaauccacgcugaaacuugcuacuggaaugagaaaugugccugaaaagcagacaaggggcaucuucggcgccauugcaggguuuauagagaacggaugggaagguaugaaggacggcugguauggguuccggcaccaaaauucugagggacguggccaggcugccgaucugaaaagcacccaggcggccaucgaccagauuaacgguaaguugaaucgccucaucgggaagacuaacgagaaauuccaccagaucgaaaaggaguuuucagaaguggagggcaggauucaagaucuggaaaaauacgucgaggacacaaagauagauuuauggaguuauaaugcagagcugcucguugcucuugaaaaccagcauaccaucgaccugacggauuccgagaugaacaaauuguucgaaaagaccaagaaacagcuaagagagaaugccgaagacaugggaaacggcugcuuuaagauuuaccacaaaugugauaaugcuugcaucgggagcauucggaacggaacauaugaccaugacguguaccgagaugaggcccugaauaaccgcuuccagaucaaggguguagagcucaaaucuggcuacaaggacuggauacuguggaucucauuugcaauuaguugcuuccuucuguguguggccuugcucggguuuaucaugugggcuugccaaaagggaaauauuagauguaacaucugcauauga

SEQ ID NO: 135292 - RNA, 1701 nt, Artificial Sequence
  derived and/or modified sequence opt3 from hemagglutinin__InfluenzaA__ALE31747
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcaaaaacuguacacucaucgacgcucugcuuggggauccgcagugcgacggauuucagaauaagaggugggaucuguucguggaacggagcaaagccuauuccaacuguuaccccuaugacgucccugauuacgcaucuuugcgcucgcucguggccucaagcggcacccuggaguuuaaugacgaaaguuucaacugggcugguguuacucaaaaugggacauccucugcaugcauucgaggaagcaacuccucauuuuucagucgucugaauuggcucacccauagcaacuuuaaguauccagccuuaaaugugacgaugcccaacaacgagcaguucgauaagcuguacaucuggggcguccaccauccuggcacugacaaagaucagauuuuucuuuaugcucagucuuccgggagaaucaccgugucaacaaagaggagccaacaggccguaauaccaaauauuggaagucggccccgcaucagaaacauuccuucuaggaucuccaucuacuggacuauuguuaaaccaggugacauauugcugaucaauagcaccggcaaccuaauugcgccgcggggguacuucaagauccagucgggaaaaucuuccauaaugcgcucagacgcacccauuggcaaguguaagagugagugcaucacaccuaaugguagcaucccaaacgauaaacccuuucagaaugugaaccgaauuaccuauggggccuguccuagauacgucaagcaauccacgcucaaacuggcuacuggaaugaggaaugugccagaaaagcagacacggggcaucuucggcgccauugcaggguuuauagagaacggaugggaagguaugaaagacggcugguauggguuccgucaccaaaauucugagggacgcggccaggcugccgaucuuaagagcacccaggcggccaucgaccagauuaacgguaaacugaauagauugaucgggaagacuaacgagaaguuccaccagaucgaaaaagaguuuucagaaguggagggcaggguccaagaucucgaaaaguacguugaggacacaaaaauugaucuguggaguuauaaugcagaguuacugguggcucucgaaaaccagcauaccauagaccuuacggauuccgagaugaacaagcuguucgagaaaaccaagaagcaguugcgggaaaaugccgaagacaugggaaacggcugcuuuaaaaucuaccacaagugugauaaugcuugcauugggagcauccgaaacggaacauaugaccaugacguauaccgcgaugaggcccuaaauaacagauuccagauuaaagguguggagcugaagucuggcuacaaagacuggauccucuggauaucauuugcaaucaguugcuuccugcuuugugucgcccuguugggguuuauuaugugggcuugccaaaagggaaauaucagguguaacauuugcaucuga

SEQ ID NO: 135293 - RNA, 1701 nt, Artificial Sequence; identical to SEQ ID NO: 135014
  derived and/or modified sequence opt3 from hemagglutinin__InfluenzaA__ALE31748

SEQ ID NO: 135294 - RNA, 1701 nt, Artificial Sequence; identical to SEQ ID NO: 134457
  derived and/or modified sequence opt3 from hemagglutinin__InfluenzaA__ALE31749

SEQ ID NO: 135295 - RNA, 1701 nt, Artificial Sequence; identical to SEQ ID NO: 135001
  derived and/or modified sequence opt3 from hemagglutinin__InfluenzaA__ALE31750

SEQ ID NO: 135296 - RNA, 1701 nt, Artificial Sequence
  derived and/or modified sequence opt3 from hemagglutinin__InfluenzaA__ALE31751
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucgacuauacuuacccagcauuaaacgugaccaugcccaauaacgagcaguuugauaagcuguauauuuggggaguccaccauccuggcacagacaaggaucagaucuuccuuuacgcccagucuuccggcagaauaacugugucaaccaaaaggagccaacaggcuguaauuccaaacaucgggagucggccccgcauuagagacaucccuucuaggaucuccauuuacuggacaauaguuaagccaggagacaucuugcugauuaauagcaccgguaaccuaaucgccccgcggggcuauuuuaaaauacgcucggggaagucuuccauuaugcgaucagaugcgcccaucggaaaauguaagagugaaugcaucacgccuaauggcagcauuccaaacgacaagcccuuccagaaugugaacagaaucacuuacggugcauguccuagguaugucaaacacuccacacucaagcuggccaccgggaugcggaaugugccagagaaacagacucguggaauuuuuggcgcuauagccggcuucaucgaaaacgggugggagggaaugguggaugguugguacggcuuucgccaccaaaauucugaggggagaggacaggcagcugaccuuaagagcacacaggccgcgauugaucaaaucaacggcaaacugaauagguugaucgguaagaccaacgaaaaauuccaucagauugagaaggaauuuucagaggucgaagggcggauacaggaccucgagaaguauguugaggauacgaaaaucgaccuguggaguuacaaugccgaauuacugguggcacucgagaaccagcacaccauugaucuuacagacuccgaaaugaauaagcuguuugagaaaacuaagaaacaauugcgagaaaacgcugaggauaugggcaacggaugcuucaagaucuaucauaagugugacaaugccugcauuggcagcauccgcaacgggaccuacgaccacaauguauacagagaugaggcucuaaacaauagguuucagauaaaaggaguggaacugaagucugguuauaaagacuggauccucuggauuucauucgccaucaguugcuuucugcuuugugucgcacuguugggcuucauuaugugggccugccagaaggggaacauccgguguaauauaugcauuuga

SEQ ID NO: 135297 - RNA, 1701 nt, Artificial Sequence; identical to SEQ ID NO: 134457
  derived and/or modified sequence opt3 from hemagglutinin__InfluenzaA__ALE31752

SEQ ID NO: 135298 - RNA, 1701 nt, Artificial Sequence; identical to SEQ ID NO: 135001
  derived and/or modified sequence opt3 from hemagglutinin__InfluenzaA__ALE31753

SEQ ID NO: 135299 - RNA, 1701 nt, Artificial Sequence; identical to SEQ ID NO: 134457
  derived and/or modified sequence opt3 from hemagglutinin__InfluenzaA__ALE31754

SEQ ID NO: 135300 - RNA, 1701 nt, Artificial Sequence
  derived and/or modified sequence opt3 from hemagglutinin__InfluenzaA__ALE31755
augaagaccaucauugcccugagcuacauacucugccuuguguucgcucagaaacugcccgagaacgacaauuccacagcaacuuuguguuuaggccaccaugccgucccuaacgggacgaucguuaagaccauuacaucugaucaaaucgaagugacuaaugcgaccgagcugguacagaacucaaguauuggagaaaucugcgacagcccacaccagauacuagaugguaaaaauuguacacucaucgacgcucugcuuggcgauccgcagugcgacggguuucaaaacaagaaaugggaucuguucguggagagauccaaggccuauucuaauuguuaccccuaugacgucccugauuacgcaucguugaggucacucguggccagcaguggaacccuggaauuuaacgacgaguccuucaauugggcuggcguuacucagaacgguacaucuagcgcaugcauucggggguccaauucaaguuucuuuagccgccugaacuggcucacccauucuaauuuuaaguauccagccuuaaacgugacgaugcccaauaacgagcaguucgauaaacuguacaucuggggaguccaccauccuggcacugacaaggaucagauuuuucuuuaugcucaauccucaggccgaaucaccgugagcacaaaacguagucagcaggccguaauaccaaacauugggucuagacccaggauccggaauauuccuucccgcaucagcaucuacuggacuauuguuaagccaggagacauauugcugaucaacucgaccgguaaucuaauugcgccgagaggcuacuucaaaaucaggucugggaaguccucaauaaugcggagugacgcacccauuggaaaguguaaaagcgaaugcaucacaccuaacggcuccaucccaaaugauaagcccuuucagaacgugaaucgcauuaccuauggugccuguccucgauacgucaaacaaucuacgcucaagcuggcuacugggaugagaaacgugccagagaaacagacaaggggaaucuucggcgccauugcaggcuuuauagaaaaugggugggagggaaugaaggacgguugguauggcuuccggcaccagaacagcgaggggcguggacaagcugccgaucuuaaaucaacccaggcggccaucgaccagauuaauggcaagcugaaccgcuugaucgguaagacuaaugaaaaauuccaccagaucgagaaggaauuuagugagguggaagggaggauucaagaucucgagaaauacgucgaggacacaaagauagaucugugguccuauaacgcagaauuacugguugcucucgagaaucagcauaccaucgaccuuacggauagcgaaaugaacaaacuguucgagaagaccaagaaacaguugagagaaaacgccgaggacaugggcaauggaugcuuuaagauuuaccacaaaugugauaacgcuugcaucggcucuauucggaaugggacauaugaccauaacguguaccgagacgaggcccuaaauaaccgcuuccagaucaagggaguagaacugaaaucagguuacaaggauuggauacucuggaucaguuuugcaauuagcugcuuccugcuuuguguggcccuguugggcuuuaucaugugggcuugccaaaaggggaauauuagauguaacaucugcauauga

SEQ ID NO: 135301 - RNA, 1701 nt, Artificial Sequence; identical to SEQ ID NO: 135001
  derived and/or modified sequence opt3 from hemagglutinin__InfluenzaA__ALE31756

SEQ ID NO: 135302 - RNA, 1701 nt, Artificial Sequence; identical to SEQ ID NO: 134457
  derived and/or modified sequence opt3 from hemagglutinin__InfluenzaA__ALE31757

SEQ ID NO: 135303 - RNA, 1701 nt, Artificial Sequence
  derived and/or modified sequence opt3 from hemagglutinin__InfluenzaA__ALE31758
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaguggccccgcggggcuauuuuaaaauccgcucggggaagucuuccauaaugcgaucagacgcgcccauuggaaaauguaagagugaaugcaucacgccuaacggcagcaucccaaaugauaagcccuuccagaacgucaauagaauuacuuacggugcauguccuagguaugugaaacacuccacacucaagcuggccaccgggaugcggaacgugccagagaaacagacucguggaaucuuuggcgcuauugccggcuucauagaaaaugggugggagggaauggucgacgguugguacggcuuucgccaccaaaacucugaggggagaggacaggcagcugaucuuaagagcacacaggccgcgaucgaccaaauuaauggcaaacugaacagguugaucgguaagaccaaugaaaaauuccaucagaucgagaaggaauuuucagagguugaagggcggauucaggaucucgagaaguauguggaggacacgaaaauagaucuguggaguuacaacgccgaauuacugguagcacucgagaaucagcacaccaucgaccuuacagauuccgaaaugaacaagcuguuugagaaaacuaagaaacaauugcgagaaaacgcugaggacaugggcaauggaugcuucaagauuuaucauaagugugauaacgccugcaucggcagcauucgcaaugggaccuacgaccacaacguguacagagacgaggcucuaaauaacagguuucagaucaaaggagucgaacugaagucugguuauaaagauuggauacucuggaucucauucgccauuaguugcuuucugcuuuguguggcacuguugggcuucaucaugugggccugccagaaggggaauauucgguguaacaucugcauauga

SEQ ID NO: 135304 - RNA, 1701 nt, Artificial Sequence
  derived and/or modified sequence opt3 from hemagglutinin__InfluenzaA__ALE31759
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcaaaaacuguacacucaucgacgcucugcuuggggauccgcagugcgacggauuucagaauaagaggugggaucuguucguggaacggagcaaagccuauuccaacuguuaccccuaugacgucccugauuacgcaucuuugcgcucgcucguggccucaagcggcacccuggaguuuaaugacgaaaguuucaacugggcugguguuacucaaaaugggacauccucugcaugcauucgaggaagcaacuccucauuuuucagucgucugaauuggcucacccauagcaacuuuaaguauccagccuuaaaugugacgaugcccaacaacgagcaguucgauaagcuguacaucuggggcguccaccauccuggcacugacaaagaucagauuuuucuuuaugcucagucuuccgggagagugaccguaucaacaaagaggagccaacaggccguuaucccaaauauaggaagucggccccgcauuagaaacaucccuucuaggauuuccaucuacuggacuaucgugaaaccaggugacauuuugcugauaaauagcaccggcaaccuaaucgcgccgcggggguacuucaagauucagucgggaaaaucuuccaucaugcgcucagacgcacccauaggcaaguguaagagugagugcauuacaccuaaugguagcaucccaaacaauaaacccuuucagaacgucaaucgaaucaccuauggggccuguccuagauacgugaagcaauccacgcucaaacuggcuacuggaaugaggaacgugccagaaaagcagacacggggcauuuucggcgccaucgcaggguuuauugagaauggaugggaagguaugaaagauggcugguauggguuccgucaccagaacucugagggacgcggccaagcugccgaccuuaagagcacccaggcggccauagaucagaucaaugguaaacugaacagauugauugggaagacuaaugagaaguuccaccagaucgaaaaagaguuuucagaagucgagggcaggauccaagaccucgaaaaguacguugaggauacaaaaauugaccuguggaguuauaacgcagaguuacugguggcucucgaaaaccagcauaccauagaucuuacggacuccgagaugaauaagcuguucgagaaaaccaagaagcaguugcgggaaaacgccgaagauaugggaaauggcugcuuuaaaaucuaccacaagugugacaacgcuugcauugggagcauccgaaauggaacauaugaucaugacguauaccgcgacgaggcccuaaacaauagauuccagauuaaagguguggagcugaagucuggcuacaaagauuggauccucuggauaucauuugcaaucaguugcuuccugcuuugugucgcccuguugggguuuauuaugugggcuugccaaaagggaaacaucagguguaauauuugcaucuga

SEQ ID NO: 135305 - RNA, 1701 nt, Artificial Sequence
  derived and/or modified sequence opt3 from hemagglutinin__InfluenzaA__ALE31760
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucggguaccggccccgcauuagagauaucccuaguaggaucucuauuuauuggacaauaguuaagccaggagacaucuugcugauuaacuccaccgguaaucuaaucgccccgcggggcuacuuuaaaauacgcagcgggaagucgucuauuaugcgauccgacgcgcccaucggaaaauguaagucagaaugcaucacgccuaacggcaguauuccaaaugauaagcccuuccagaacgugaauagaaucacuuauggugcauguccuagguacgucaaacacagcacacucaagcuggccaccgggaugcggaacgugccagagaaacagacucguggaauuuuuggcgcuauagccggcuucaucgaaaaugggugggagggaaugguggacgguugguauggcuuucgccaccaaaacuccgaggggagaggacaggcagcugaucuuaagucuacacaggccgcgauugaccaaaucaauggcaaacugaacagguugaucgguaagaccaaugaaaaauuccaucagauugagaaggaauuuagcgaggucgaagggcggauacaggaucucgagaaguacguugaggacgccaaaaucgaucuguggucauauaacgcagaauuacugguggcucucgagaaucagcacacgauugaccuuaccgauagugaaaugaacaagcuguuugagaaaacaaagaaacaauugcgagaaaacgccgaggacaugggcaauggaugcuucaagaucuaccauaagugugauaacgcuugcauuggcuccauccgcaaugggacuuacgaccacaacguauauagagacgaggcccuaaauaacagguuucagauaaaaggaguggaacucaagagcgguuacaaagauuggauccuguggauuucuuucgcaaucucaugcuuucugcuuugugucgcccuguugggcuucauuaugugggcuugccagaaggggaauauccgguguaacauaugcauuuga

SEQ ID NO: 135306 - RNA, 1701 nt, Artificial Sequence; identical to SEQ ID NO: 135001
  derived and/or modified sequence opt3 from hemagglutinin__InfluenzaA__ALE31761

SEQ ID NO: 135307 - RNA, 1701 nt, Artificial Sequence; identical to SEQ ID NO: 134457
  derived and/or modified sequence opt3 from hemagglutinin__InfluenzaA__ALE31762

SEQ ID NO: 135308 - RNA, 1701 nt, Artificial Sequence; identical to SEQ ID NO: 135063
  derived and/or modified sequence opt3 from hemagglutinin__InfluenzaA__ALE31763

SEQ ID NO: 135309 - RNA, 1701 nt, Artificial Sequence; identical to SEQ ID NO: 135115
  derived and/or modified sequence opt3 from hemagglutinin__InfluenzaA__ALE31764

SEQ ID NO: 135310 - RNA, 1701 nt, Artificial Sequence; identical to SEQ ID NO: 134457
  derived and/or modified sequence opt3 from hemagglutinin__InfluenzaA__ALE31765

SEQ ID NO: 135311 - RNA, 1701 nt, Artificial Sequence
  derived and/or modified sequence opt3 from hemagglutinin__InfluenzaA__ALE31774
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagguguuccuuuacgcccagucuuccggcagaaucacuguaucaaccaaaaggagccaacaggcuguuauaccaaauauugggagucggccccgcaucagagauauuccuucuaggaucuccaucuacuggacaauugugaagccaggagacauauugcugaucaacagcaccgguaaucuaauugccccgcggggcuauuuuaaaauccgcucggggaagucuuccauaaugcgaucagacgcgcccauuggaaaauguaagagugaaugcaucacgccuaacggcagcaucccaaaugauaagcccuuccagaacgucaauagaauuacuuacggugcauguccuagguaugugaaacacuccacacucaagcuggccaccgggaugcggaacgugccagagaaacagacucguggaaucuuuggcgcuauugccggcuucauagaaaaugggugggagggaauggucgacgguugguacggcuuucgccaccaaaacucugaggggagaggacaggcagcugaucuuaagagcacacaggccgcgaucgaccaaauuaauggcaaacugaacagguugaucgguaagaccaaugaaaaauuccaucagaucgagaaggaauuuucagagguugaagggcggauucaggaucucgagaaguauguggaggacacgaaaauagaucuguggaguuacaacgccgaauuacugguagcacucgagaaucagcacaccaucgaccuuacagauuccgaaaugaacaagcuguuugagaaaacuaagaaacaauugcgagaaaacgcugaggacaugggcaauggaugcuucaagauuuaucauaagugugauaacgccugcaucggcagcauucgcaaugggaccuacgaccacaacguguacagagacgaggcucuaaauaacagguuucagaucaaaggagucgaacugaagucugguuauaaagauuggauacucuggaucucauucgccauuaguugcuuucugcuuuguguggcacuguugggcuucaucaugugggccugccagaaggggaauauucgguguaacaucugcauauga

SEQ ID NO: 135312 - RNA, 1701 nt, Artificial Sequence
  derived and/or modified sequence opt3 from hemagglutinin__InfluenzaA__ALE31775
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuauacuuacccagcauuaaaugugaccaugcccaacaacgagcaguuugacaagcuguauauuuggggaguccaccauccuggcacagauaaagaccagaucuuccuuuacgcccguucuuccggcagaauaacugugucaaccaagaggagccagcaagcuguaauuccaaauaucgggagucggccccgcauuagagauaucccuucuaggaucuccauuuacuggacaauaguuaaaccaggagacaucuugcugauuaacagcaccgguaaucuaaucgccccgcggggcuauuuuaagauacgcucggggaaaucuuccauuaugcgaucagacgcgcccaucggaaaguguaagagugaaugcaucacgccuaacggcagcauuccaaaugauaaacccuuccagaacgugaauagaaucacuuacggugcauguccuagguaugucaagcacuccacacucaaacuggccaccgggaugcggaacgugccagagaagcagacucguggaauuuuuggcgcuauagccggcuucaucgaaaaugggugggagggaaugguggacgguugguacggcuuucgccaccagaacucugaggggagaggacaagcagcugaucuuaaaagcacacaggccgcgauugaccagaucaauggcaagcugaacagguugaucgguaaaaccaaugaaaaguuccaucaaauugagaaggaauuuucagaggucgaagggcggauacaggaucucgagaaauauguugaggacacgaagaucgaucuguggaguuacaacgccgaauuuuuaguggcacuggagaaucagcacaccauugaccucacagauuccgaaaugaacaaacuuuucgagaagacuaaaaagcagcugcgagaaaacgcugaggacaugggcaauggaugcuuuaagaucuaucauaaaugugauaacgccugcauuggcagcauccgcaaugggaccuacgaccacaacguauacagagacgaggcuuugaauaacagguuccaaauaaagggaguggaacuaaaaucugguuauaaggauuggauccuguggauuucauuugccaucaguugcuuccuccugugugucgcacuucugggcuuuauuaugugggccugccagaaagggaauauccgguguaacauaugcauuuga

SEQ ID NO: 135313 - RNA, 1701 nt, Artificial Sequence
  derived and/or modified sequence opt3 from hemagglutinin__InfluenzaA__ALE31776
augaagaccaucauugcccugagcuacauacucugccuuguguucgcucagaaacugcccgagaacgacaauuccacagcaacuuuguguuuaggccaccaugccgucccuaacgggacgaucguuaagaccauuacaucugauagaaucgaagugacuaaugcgaccgagcugguacaaaacucaaguauuggagaaaucugcgacagcccacaccagauacuagaugguaaaaauuguacacucaucgacgcucugcuuggcgauccgcagugcgacggguuucagaacaagaaaugggaucuguucguggagagguccaaggccuauucuaauuguuaccccuaugacgucccugauuacgcaucguugcggucacucguggccagcaguggaacccuggaauuuaacgacgaguccuucaauugggcuggcguuacucaaaacgguacaucuagcgcaugcauucgcggguccaauucaaguuucuuuagccgacugaacuggcucacccauucuaauuuuaaguauccagccuuaaacgugacgaugcccaauaacgagcaguucgauaaacuguacaucuggggaguccaccauccuggcacugacaaggaucagauuuuucuuuaugcucaguccucaggccguaucaccgugagcacaaaaagaagucaacaggccguaauaccaaacauugggucuaggccccggauccgcaauauuccuuccagaaucagcaucuacuggacuauuguuaagccaggagacauauugcugaucaacucgaccgguaaucuaauugcgccgaggggcuacuucaaaauccggucugggaaguccucaauaaugcgcagugacgcaagcauuggaaaguguaaauccgaaugcaucacacccaacggcucuaucccuaaugauaagccauuucagaacgugaaucgaauuaccuauggugccugucccagauacgucaaacagagcacgcucaagcuggcuacugggaugaggaacgugccugagaaacaaacacggggaaucuucggcgccauugcaggcuuuauagaaaaugggugggagggaaugaaggacgguugguauggcuuccgucaccagaacucagaggggcgcggacaggcugccgaucuuaaaaguacccaagcggccaucgaccagauuaauggcaagcugaacagauugaucgguaagacuaaugaaaaauuccaccagaucgagaaggaauuuuccgagguggaagggaggauucaggaucucgagaaauacgucgaggacacaaagauagaucuguggagcuauaacgcagaauuacugguugcucucgagaaucaacauaccaucgaccuuacggauucugaaaugaacaaacuguucgagaagaccaagaaacaguugcgggaaaacgccgaggacaugggcaauggaugcuuuaagauuuaccacaaaugugauaacgcuugcaucggcucaauucgaaaugggacauaugaccaugacguguaccgcgaugaggcccuaaacaauagauuccagaucaagggaguagaacugaaaagugguuacaaggacuggauacucuggaucagcuuugcaauuuccugcuuccugcuuuguguggcccuguugggcuuuaucaugugggcuugccagaaggggaacauuagguguaauaucugcauauga

SEQ ID NO: 135314 - RNA, 1701 nt, Artificial Sequence
  derived and/or modified sequence opt3 from hemagglutinin__InfluenzaA__ALE31777
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaguuccaaauauugggagucggccccgcaucagagauauuccuucuaggaucuccaucuacuggacaauugugaagccaggagacauauugcugaucaacagcaccgguaaucuaauugccccgcggggcuauuuuaaaauccgcucggggaagucuuccauaaugcgaucagacgcgcccauuggaaaauguaagagugaaugcaucacgccuaacggcagcaucccaaaugauaagcccuuccagaacgucaauagaauuacuuacggugcauguccuagguaugugaaacacuccacacucaagcuggccaccgggaugcggaacgugccagagaaacagacucguggaaucuuuggcgcuauugccggcuucauagaaaaugggugggagggaauggucgacgguugguacggcuuucgccaccaaaacucugaggggagaggacaggcagcugaucuuaagagcacacaggccgcgaucgaccaaauuaauggcaaacugaacagguugaucgguaagaccaaugaaaaauuccaucagaucgagaaggaauuuucagagguugaagggcggauucaggaucucgagaaguauguggaggacacgaaaauagaucuguggaguuacaacgccgaauuacugguagcacucgagaaucagcacaccaucgaccuuacagauuccgaaaugaacaagcuguuugagaaaacuaagaaacaauugcgagaaaacgcugaggacaugggcaauggaugcuucaagauuuaucauaagugugauaacgccugcaucggcagcauucgcaaugggaccuacgaccacaacguguacagagacgaggcucuaaauaacagguuucagaucaaaggagucgaacugaagucugguuauaaagauuggauacucuggaucucauucgccauuaguugcuuucugcuuuguguggcacuguugggcuucaucaugugggccugccagaaggggaauauucgguguaacaucugcauauga

SEQ ID NO: 135315 - RNA, 1701 nt, Artificial Sequence; identical to SEQ ID NO: 135063
  derived and/or modified sequence opt3 from hemagglutinin__InfluenzaA__ALE31778

SEQ ID NO: 135316 - RNA, 1701 nt, Artificial Sequence; identical to SEQ ID NO: 134457
  derived and/or modified sequence opt3 from hemagglutinin__InfluenzaA__ALE31779

SEQ ID NO: 135317 - RNA, 1701 nt, Artificial Sequence
  derived and/or modified sequence opt3 from hemagglutinin__InfluenzaA__ALE31780
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagcccauuccaacuguuaucccuacgacgucccugauuaugcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaccucaacuacacuuauccagcauuaaaugugaccaugcccaacaacgagcaguuugacaagcuguacauuuggggaguccaucacccuggcacagauaaggaccagaucuuccuuuaugcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuacuuuaaaauacgcucggggaagucuuccauuaugcgaacggacgcgcccaucggaaaauguaagucagaaugcaucacuccuaacggcaguauuccaaaugauaagcccuuccagaacgugaauagaaucacauauggugcauguccuagguacgucaaacacagcacccucaagcuggccacugggaugcggaacgugccagagaaacagacacguggaauuuuuggcgcuauagccggcuucaucgaaaaugggugggagggaaugguggacgguugguauggcuuucgccaucaaaacuccgaggggagaggacaggcagcugaucuuaagucuacccaggccgcgauugaccaaaucaauggcaaacugaacagguugaucgguaagacgaaugaaaaauuccaccagauugagaaggaauuuagcgaggucgaagggcggauacaggaucucgagaaguacguugaggacaccaaaaucgaucuguggucauauaacgccgaauuacugguggcacucgagaaucagcauacaauugaccuuacugauagugaaaugaacaagcuguuugagaaaaccaagaaacaauugcgagaaaacgcugaggacaugggcaauggaugcuucaagaucuaccacaagugugauaacgccugcauuggcuccauccgcaaugggacauaugaccacaacguauacagagacgaggcucuaaauaacagguuucagauaaaaggaguggaacucaagagcgguuacaaagauuggauccuguggauuucuuucgccaucucaugcuuucugcuuugugucgcacuguugggcuucauuaugugggccugccagaaggggaauauccgguguaacauaugcauuuga

SEQ ID NO: 135318 - RNA, 1701 nt, Artificial Sequence
  derived and/or modified sequence opt3 from hemagglutinin__InfluenzaA__ALE31781
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcggcaguccacaccagauccuggacggggaaaacuguacacuaauugaugcucuccugggagacccgcagugcgauggcuuucagaauaaaaagugggaccuuuucguggagaggagcaaagccuauuccaacuguuaccccuaugaugucccugacuacgcaucucugcggucguugguggccucaagcgguacccucgaauuuaauaacgagaguuucaauuggacugggguuacacaaaacggaaccuccucugcuugcauccgcaagagcuccucaaguuucuucagcaagcugaauuggcugacgcaucucaacuauacuuacccagcauuaaaugugaccaugcccaacaacgagcaguuugauaaacuguauauuuggggcguccaccauccuggcacagacaaggaucagaucuuccuuuacgcccgaucuuccgggcguauaacugugucaaccaaaagaagccagcaagcuguaauuccaaauaucggaaguaggccccggauucgcgacaucccuucuagaaucuccauuuacuggacaauaguuaagccaggugauaucuugcugauuaacagcaccggcaaucuaaucgccccgaggggguauuuuaaaauacggucgggaaagucuuccauuaugcgcucagacgcgcccaucggcaaguguaaaagugaaugcaucacgccuaacgguagcauuccaaaugacaagcccuuccagaacgugaaucgaaucacuuacggggcauguccuagauaugucaaacacuccacacucaagcuggccaccggaaugaggaacgugccagagaaacagacucggggcauuuuuggcgcuauagccggguucaucgaaaauggaugggaggguaugguggauggcugguacggguuucgucaccagaacucugagggacgcggccaagcagcugaccuuaagagcacacaggccgcgauugaucagaucaaugguaaacugaacagauugaucgggaagaccaaugaaaaguuccaucaaauugagaaagaauuuucagaggucgaaggcaggauacaggaccucgagaaguauguugaggauacgaaaaucgaccuguggaguuacaacgccgaauuacugguggcacucgagaaucagcacaccauugaucuuacagacuccgaaaugaacaagcuguuugagaaaacuaagaagcaguugcgggaaaacgcugaggauaugggaaauggcugcuucaaaaucuaucauaagugugacaacgccugcauugggagcauccgaaauggaaccuacgaucacaacguauaccgcgacgaggcucuaaauaacagauuucaaauaaaagguguggaacugaagucuggcuauaaagacuggauccucuggauuucauucgccaucaguugcuuucugcuuugugucgcacuguugggguucauuaugugggccugccagaagggaaauaucagguguaacauaugcauuuga

SEQ ID NO: 135319 - RNA, 1701 nt, Artificial Sequence
  derived and/or modified sequence opt3 from hemagglutinin__InfluenzaA__ALE31782
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgugucucugcggucguugguugcaucaagcggcacccucgaauuuaauaacgagaguuucaauuggacuggugugacacaaaacgggaccuccucugccugcauccgccgaagcuccucaaguuucuucagccgucugaauuggcugacgcaucucaacuauacuuacccagcuuuaaaugucaccaugcccaacaacgagcaguuugacaagcuguauauuuggggagugcaccauccuggcacagauaaggaccagaucuuccuuuacgcacagucuuccggcagaauaacuguaucaaccaaaaggagccaacaggccguuauuccaaauaucgggagucggccccgcauuagagauaucccuucuaggaucuccauuuacuggacaauagugaagccaggagacaucuugcugauuaacagcaccgguaaucuaaucgcuccgcggggcuauuuuaaaauacgcucggggaagucuuccauuaugcgaucagacgcccccaucggaaaauguaagagugaaugcaucacgccuaacggcagcauuccaaaugauaagcccuuccagaacgucaauagaaucacuuacggugcguguccuagguaugugaaacaguccacacucaagcuggcaaccgggaugcggaacgugccagagaaacaaacucguggaauuuuuggcgccauagcuggcuucaucgaaaaugggugggagggaauggucgacgguugguacggcuuucgccaccagaacucugaggggagaggacaggccgcagaucuuaagagcacacaagcugccauugaccagaucaauggcaaacugaacagguugaucgguaagaccaaugaaaaauuccaccagauugagaaggaauuuucagagguugaagggcggauacaggaucucgagaaguauguggaggacacgaaaaucgaucuguggaguuacaacgcggaauuacugguagcccucgagaaucaacauaccauugaccuuacagauuccgaaaugaacaagcuguuugagaaaacuaagaaacaguugcgagaaaacgcagaggacaugggcaauggaugcuucaagaucuaucacaagugugauaacgcuugcauuggcagcauccgcaaugggaccuacgaccauaacguguacagagacgaggcccuaaauaacagguuucagauaaaaggagucgaacugaagucugguuauaaagauuggauccucuggauuucauucgcuaucaguugcuuucugcuuuguguggcccuguugggcuucauuaugugggcaugccagaaggggaauauccgguguaacauaugcauuuga

SEQ ID NO: 135320 - RNA, 1701 nt, Artificial Sequence
  derived and/or modified sequence opt3 from hemagglutinin__InfluenzaA__ALE31783
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccguccccaacaacgagcaguuugacaagcuguauauuuggggagugcaccauccuggcacagauaaggaccagaucuuccuuuacgcccagucuuccggcagaauaacuguaucaaccaaaaggagccaacaggcuguuauuccaaauaucgggagucggccccgcauuagagauaucccuucuaggaucuccauuuacuggacaauagugaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgucaauagaaucacuuacggugcauguccuagguaugugaaacacuccacacucaagcuggccaccgggaugcggaacgugccagagaaacagacucguggaauuuuuggcgcuauagccggcuucaucgaaaaugggugggagggaauggucgacgguugguacggcuuucgccaccaaaacucugaggggagaggacaggcagcugaucuuaagagcacacaggccgcgauugaccaaaucaauggcaaacugaacagguugaucgguaagaccaaugaaaaauuccaucagauugagaaggaauuuucagagguugaagggcggauacaggaucucgagaaguauguggaggacacgaaaaucgaucuguggaguuacaacgccgaauuacugguagcacucgagaaucagcacaccauugaccuuacagauuccgaaaugaacaagcuguuugagaaaacuaagaaacaauugcgagaaaacgcugaggacaugggcaauggaugcuucaagaucuaucauaagugugauaacgccugcauuggcagcauccgcaaugggaccuacgaccacaacguguacagagacgaggcucuaaauaacagguuucagauaaaaggagucgaacugaagucugguuauaaagauuggauccucuggauuucauucgccaucaguugcuuucugcuuuguguggcacuguugggcuucauuaugugggccugccagaaggggaauauccgguguaacauaugcauuuga

SEQ ID NO: 135321 - RNA, 1701 nt, Artificial Sequence; identical to SEQ ID NO: 135073
  derived and/or modified sequence opt3 from hemagglutinin__InfluenzaA__ALE31784

SEQ ID NO: 135322 - RNA, 1701 nt, Artificial Sequence; identical to SEQ ID NO: 134457
  derived and/or modified sequence opt3 from hemagglutinin__InfluenzaA__ALE31785

SEQ ID NO: 135323 - RNA, 1701 nt, Artificial Sequence; identical to SEQ ID NO: 135063
  derived and/or modified sequence opt3 from hemagglutinin__InfluenzaA__ALE31786

SEQ ID NO: 135324 - RNA, 1701 nt, Artificial Sequence; identical to SEQ ID NO: 135115
  derived and/or modified sequence opt3 from hemagglutinin__InfluenzaA__ALE31787

SEQ ID NO: 135325 - RNA, 1701 nt, Artificial Sequence; identical to SEQ ID NO: 134557
  derived and/or modified sequence opt3 from hemagglutinin__InfluenzaA__ALE31788

SEQ ID NO: 135326 - RNA, 1701 nt, Artificial Sequence; identical to SEQ ID NO: 134457
  derived and/or modified sequence opt3 from hemagglutinin__InfluenzaA__ALE31789

SEQ ID NO: 135327 - RNA, 1701 nt, Artificial Sequence; identical to SEQ ID NO: 135072
  derived and/or modified sequence opt3 from hemagglutinin__InfluenzaA__ALE31790

SEQ ID NO: 135328 - RNA, 1701 nt, Artificial Sequence; identical to SEQ ID NO: 135193
  derived and/or modified sequence opt3 from hemagglutinin__InfluenzaA__ALE31791

SEQ ID NO: 135329 - RNA, 1701 nt, Artificial Sequence; identical to SEQ ID NO: 135093
  derived and/or modified sequence opt3 from hemagglutinin__InfluenzaA__ALE31792

SEQ ID NO: 135330 - RNA, 1701 nt, Artificial Sequence
  derived and/or modified sequence opt3 from hemagglutinin__InfluenzaA__ALE31793
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucucucuuuacgcccaguccucaggcagaauaacugugagcaccaaaaggagucaacaggcuguaauuccaaauaucgggucucggccccgcauuagagauaucccuuccaggaucagcauuuacuggacaauaguuaagccaggagacaucuugcugauuaacucgaccgguaaucuaaucgccccgcggggcuauuucaaaauacgcucugggaaguccucaauuaugcgaagugacgcgcccaucggaaaauguaagagcgaaugcaucacgccuaacggcuccauuccaaaugauaagcccuuucagaacgugaauagaaucacuuacggugcauguccuagguaugucaaacacucuacacucaagcuggccaccgggaugcggaacgugccagagaaacagacucguggaauuuucggcgcuauagccggcuuuaucgaaaaugggugggagggaaugguggacgguugguacggcuuccgccaccaaaacagcgaggggagaggacaggcagcugaucuuaagucaacacaggccgcgauugaccaaaucaauggcaaacugaacagguugaucgguaagaccaaugaaaaauuucaucagauugagaaggaauuuagugaggucgaagggcggauacaggaucucgagaaguauguugaggacacgaaaaucgaucugugguccuacaacgccgaauuacugguggcacucgagaaucagcacaccauugaccuuacagauagcgaaaugaacaagcuguucgagaaaacuaagaaacaauugcgagaaaacgcugaggacaugggcaauggaugcuuuaagaucuaucauaagugugauaacgccugcauuggcucuauccgcaaugggaccuacgaccacaacguauacagagacgaggcucuaaauaacagguuccagauaaaaggaguggaacugaagucagguuauaaagauuggauccucuggauuaguuuugccaucagcugcuuccugcuuugugucgcacuguugggcuuuauuaugugggccugccagaaggggaauauccgguguaacauaugcauuuga

SEQ ID NO: 135331 - RNA, 1701 nt, Artificial Sequence; identical to SEQ ID NO: 134457
  derived and/or modified sequence opt3 from hemagglutinin__InfluenzaA__ALE31794

SEQ ID NO: 135332 - RNA, 1701 nt, Artificial Sequence; identical to SEQ ID NO: 134457
  derived and/or modified sequence opt3 from hemagglutinin__InfluenzaA__ALE31795

SEQ ID NO: 135333 - RNA, 1701 nt, Artificial Sequence; identical to SEQ ID NO: 134457
  derived and/or modified sequence opt3 from hemagglutinin__InfluenzaA__ALE31796

SEQ ID NO: 135334 - RNA, 1701 nt, Artificial Sequence; identical to SEQ ID NO: 135115
  derived and/or modified sequence opt3 from hemagglutinin__InfluenzaA__ALE31797

SEQ ID NO: 135335 - RNA, 1701 nt, Artificial Sequence; identical to SEQ ID NO: 135115
  derived and/or modified sequence opt3 from hemagglutinin__InfluenzaA__ALE31798

SEQ ID NO: 135336 - RNA, 1701 nt, Artificial Sequence; identical to SEQ ID NO: 134457
  derived and/or modified sequence opt3 from hemagglutinin__InfluenzaA__ALE31799

SEQ ID NO: 135337 - RNA, 1701 nt, Artificial Sequence; identical to SEQ ID NO: 135063
  derived and/or modified sequence opt3 from hemagglutinin__InfluenzaA__ALE31800

SEQ ID NO: 135338 - RNA, 1701 nt, Artificial Sequence; identical to SEQ ID NO: 134457
  derived and/or modified sequence opt3 from hemagglutinin__InfluenzaA__ALE31801

SEQ ID NO: 135339 - RNA, 1701 nt, Artificial Sequence; identical to SEQ ID NO: 134457
  derived and/or modified sequence opt3 from hemagglutinin__InfluenzaA__ALE31802

SEQ ID NO: 135340 - RNA, 1701 nt, Artificial Sequence; identical to SEQ ID NO: 135063
  derived and/or modified sequence opt3 from hemagglutinin__InfluenzaA__ALE31803

SEQ ID NO: 135341 - RNA, 1701 nt, Artificial Sequence; identical to SEQ ID NO: 135014
  derived and/or modified sequence opt3 from hemagglutinin__InfluenzaA__ALE31805

SEQ ID NO: 135342 - RNA, 1701 nt, Artificial Sequence
  derived and/or modified sequence opt3 from hemagglutinin__InfluenzaA__ALE31806
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaccuugcugaucaacagcacggguaaucuaauugccccgcggggcuauuuuaaaauccgcucggggaagucuuccauaaugcgaucagacgcgcccauuggaaaauguaagagugaaugcaucacuccuaacggcagcaucccaaaugauaagcccuuccagaacgugaauagaauuacauacggugcauguccuagguaugucaaacacuccacccucaagcuggccacugggaugcggaacgugccagagaaacagacacguggaaucuuuggcgcuauugccggcuucauagaaaaugggugggagggaaugguggacgguugguacggcuuucgccaccaaaacucugaggggagaggacaggcagcugaucuuaagagcacccaggccgcgaucgaccaaauuaauggcaaacugaacagguugaucgguaagacgaaugaaaaauuccaucagaucgagaaggaauuuucagaggucgaagggcggauucaggaucucgagaaguauguugaggacaccaaaauagaucuguggaguuacaacgccgaauuacugguggcacucgagaaucagcacacaaucgaccuuacugauuccgaaaugaacaagcuguuugagaaaaccaagaaacaauugcgagaaaacgcugaggacaugggcaauggaugcuucaagauuuaucauaagugugauaacgccugcaucggcagcauucgcaaugggacauacgaccacaacguauacagagacgaggcucuaaauaacagguuucagaucaaaggaguggaacugaagucugguuauaaagauuggauacucuggaucucauucgccauuaguugcuuucugcuuugugucgcacuguugggcuucaucaugugggccugccagaaggggaauauucgguguaacaucugcauauga

SEQ ID NO: 135343 - RNA, 1701 nt, Artificial Sequence
  derived and/or modified sequence opt3 from hemagglutinin__InfluenzaA__ALE31807
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcuccucaaguuucuuuagccgucugaauuggcucacgcauuuaaacuuuacuuauccagcacugaaugugaccaugcccaacaacgagcaguucgacaagcuguacgucuggggagugcaccauccuggcacagauaaggaccagaucuuuuuguaugcccagucuuccggcagaauuacuguaucaaccaaaaggagccaacaggcuguuaucccaaauauagggagucggccccgcauuagaaacaucccuucuaggauuuccaucuacuggacaaucgugaagccaggagauauucugcuaauaaauagcaccgguaaccucaucgccccgcggggcuacuucaaaauucgcucggggaagucuuccaucaugcgaucagacgcgcccauaggaaaauguaagagugaaugcauuacgccuaauggcagcaucccaaacgacaagcccuuucagaaugucaacagaaucacuuauggugcauguccuagguacgugaaacacuccacacugaaacuugccaccgggaugcggaaugugccagagaagcagacucguggaauuuucggcgcuaucgccggcuuuauugaaaacgggugggagggaauggucgaugguugguauggcuuccgccaccaaaauucugaggggagaggacaggcagcugaccuuaagagcacacaggccgcgauagaucaaaucaacggcaaauugaauaggcucauugguaagaccaacgaaaaauuccaucagaucgagaaggaauuuucagagguugaagggcggauccaggaccuggagaaguacguggaggauacgaaaauugacuuauggaguuauaaugccgaacugcucguagcacuugagaaccagcacaccauagaucugacagacuccgaaaugaacaaguuguucgagaaaacuaagaaacaacuacgagaaaaugcugaggauaugggcaacggaugcuuuaagaucuaccauaagugugacaaugccugcauuggcagcauccgcaacgggaccuaugaucacaauguguacagagacgaggcucugaacaauagguuccagauuaaaggagucgaacucaagucugguuacaaagacuggauccuguggauaucauuugccaucaguugcuuccuucuguguguggcauugcucggcuuuauuaugugggccugccagaaggggaacauccgguguaauauuugcaucuga

SEQ ID NO: 135344 - RNA, 1701 nt, Artificial Sequence
  derived and/or modified sequence opt3 from hemagglutinin__InfluenzaA__ALE31808
augaagaccaucauugcccugggcuacauacucugccuuguguucgcucagaaaauccccgggaacgacaauagcacagcaacucuguguuugggacaccaugccgucccuaacgguacgauuguuaagaccaucacaaaugauagaauugaggugacuaacgcgaccgaauuaguacaaaauuccucuaucggcgagauaugcgacucaccacacaaaauccuggauggggaaaacuguacacuaauugacgcucuccugggagauccgcagugcgacggcuuucagaauaagaaaugggaucuuuucguggagaggaguaaggccuauagcaacuguuaccccuaugacgucccugauuacgcaucccugcggucuuugguggccucgucagguacccucgaauuuaauaacgagagcuucaauuggacugggguuacacagaacggaaccaguuccgcuugcauccgccgaucuagcuccucauuuuucagucgucugaauuggcugacgcaucucaacuauacuuacccagcauuaaaugugaccaugcccaacaacgagcaauuugacaagcuguauauuuggggcguccaccauccuggcacagauaaagaccagaucuuccuuuacgcccagagcucugggagaauaacuguguccaccaagaggucacagcaagcuguaauuccaaauaucggaagccggccccgcauuagagauaucccuaguaggaucucuauuuacuggacaauaguuaaaccaggugacaucuugcugauuaacuccaccggcaaucuaaucgccccgcggggguauuuuaagauacgcagcggaaaaucgucuauuaugcgauccgacgcgcccaucggcaaguguaagucagaaugcaucacgccuaacgguaguauuccaaaugauaaacccuuccagaacgugaauagaaucacuuacggggcauguccuagguaugucaagcacagcacacucaaacuggccaccggaaugcggaacgugccagagaagcagacucguggcauuuuuggcgcuauagccggguucaucgaaaauggaugggaggguaugguggacggcugguacggguuucgccaccagaacuccgagggaagaggccaagcagcugaucuuaaaucuacacaggccgcgauugaccagaucaaugguaagcugaacagguugaucgggaaaaccaaugaaaaguuccaucaaauugagaaggaguucagcgaagucgaaggccggauacaggaucucgagaaauauguugaggacacgaagaucgaucuguggucauacaacgccgaauuacugguggcacucgagaaucagcacaccauugaccuuacagauagugaaaugaacaaacuguuugagaagacuaaaaagcaguugcgagaaaacgcugaggacaugggaaauggcugcuucaagaucuaucauaaaugugauaacgccugcauuggguccauccgcaauggaaccuacgaccacaacguauacagagacgaggcucuaaauaacagguuucaaauaaaggguguggaacugaaaagcggcuauaaggauuggauccucuggauuucuuucgccaucucaugcuuucugcuuugugucgcacuguugggguucauuaugugggccugccagaaaggaaauauccgguguaacauaugcauuuga

SEQ ID NO: 135345 - RNA, 1701 nt, Artificial Sequence; identical to SEQ ID NO: 134457
  derived and/or modified sequence opt3 from hemagglutinin__InfluenzaA__ALE31810

SEQ ID NO: 135346 - RNA, 1701 nt, Artificial Sequence; identical to SEQ ID NO: 134457
  derived and/or modified sequence opt3 from hemagglutinin__InfluenzaA__ALE31812

SEQ ID NO: 135347 - RNA, 1701 nt, Artificial Sequence
  derived and/or modified sequence opt3 from hemagglutinin__InfluenzaA__ALE31814
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcaaaaacuguacacucaucgacgcucugcuuggggauccgcagugcgacggauuucagaauaagaaaugggaucuguucguggaaaggagcaaggcccauuccaacuguuaucccuacgacgucccugauuaugcaucuuugcggucgcucguggccucaagcggcacccuggaguuuaauaacgaaaguuucaauugggcugguguuacucaaaacgggacauccucuagcugcauucgcggauccaauucaaguuucuuuagccgacugaacuggcucacccacuuaaauucuaaguacccagcacugaacgugacgaugcccaacaaugagcaguuugacaaacuuuauaucuggggcguccaucacccuggcacugauaaggaccagauuuucuuguacgcccagccauccgggcguaucaccgugucaacaaaaagaagccaacaggcuguaauacccaacauuggaaguaggccucggauccgcgauauuccaucuagaaucuccaucuauuggacuauuguuaagccgggugacauacugcuaaucaauagcaccggcaaccucauugcccccaggggguacuuuaaaauccggucgggaaagucuuccauaaugcgcucagacgcgccuauuggcaaguguaaaagugagugcaucacaccaaaugguagcauccccaacgauaagccuuuccagaaugugaaccgaauuaccuacggggcauguccaagauaugucaaacaguccacgcugaagcuggccacuggaaugaggaaugugcccgaacggcaaacacguggcaucuuuggcgcuauugccggguucauagagaacggaugggaagguaugguggacggcugguacggguuucgccaccaaaauucugagggaagaggccaggcagcugaucuuaaaagcacccaggccgcgaucgaccagauuaacgguaaguugaauaggcucaucgggaaaacuaacgagaaguuccaucagaucgaaaaggaguucucagaagucgagggccggauucaggaucuggaaaaauauguugaggacacaaagauagauuuauggaguuacaaugccgagcugcucguggcacuugaaaaccaacacaccaucgaccugacggauuccgagaugaacaaauuguuugaaaagaccaaaaagcagcuacgagagaaugcugaagacaugggaaacggcugcuucaagauuuaucauaaaugugauaaugccugcaucgggagcauucgcaacggaacauacgaccacgacguauauagagaugaggcucugaauaacagguuucagaucaaggguguggagcucaaaucuggcuacaaggacuggauacuguggaucucauucgccauuaguugcuuucuucugugugucgcauugcucggguucaucaugugggccugccagaaaggaaauauucgguguaacaucugcauauga

SEQ ID NO: 135348 - RNA, 1701 nt, Artificial Sequence; identical to SEQ ID NO: 135347
  derived and/or modified sequence opt3 from hemagglutinin__InfluenzaA__ALE31815

SEQ ID NO: 135349 - RNA, 1701 nt, Artificial Sequence; identical to SEQ ID NO: 134457
  derived and/or modified sequence opt3 from hemagglutinin__InfluenzaA__ALE31818

SEQ ID NO: 135350 - RNA, 1701 nt, Artificial Sequence
  derived and/or modified sequence opt3 from hemagglutinin__InfluenzaA__ALE31819
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcggaagcuccucaaguuucuucagccgacugaauuggcugacgcaucucaacuauacuuacccagcauuaaaugugaccaugcccaacaaggagcaguuugacaagcuguauauuuggggcguccaccauccuggcacagauaaagaccagaucuuccuuuacgcccagucuuccgggcguauaacugugucaaccaagagaagccaacaggcuguaauuccaaacaucggaaguaggccccggauucgcgauaucccuucuagaaucuccauuuacuggacaauaguuaaaccaggugacaucuugcugauuaauagcaccggcaaccuaaucgccccgaggggguauuuuaagauacggucgggaaaaucuuccauuaugcgcucagacgcgcccaucggcaaguguaagagugaaugcaucacgccuaaugguagcauuccaaacgauaaacccuuccagaaugugaaccgaaucacuuacggggcauguccuagauaugucaagcacuccacacucaaacuggccaccggaaugaggaaugugccagagaagcagacucggggcauuuuuggcgcuauagccggguucaucgaaaacggaugggaggguaugguggacggcugguacggguuucgucaccaaaauucugagggacgcggccaggcagcugaucuuaaaagcacacaggccgcgauugaccaaaucaacgguaagcugaauagauugaucgggaaaaccaacgaaaaguuccaucagauugagaaggaauuuucagaggucgaaggcaggauacaggaucucgagaaauauguugaggacacgaagaucgaucuguggaguuacaaugccgaauuacugguggcacucgagaaccagcacaccauugaccuuacagauuccgaaaugaauaaacuguuugagaagacuaaaaagcaauugcgggaaaacgcugaggacaugggaaacggcugcuucaagaucuaucauaaaugugauaaugccugcauugggagcauccgaaacggaaccuacgaccacaauguauaccgcgacgaggcucuaaacaauagauuucagauaaaggguguggaacugaaaucuggcuauaaggauuggauccucuggauuucauucgccaucaguugcuuucugcuuugugucgcacuguugggguucauuaugugggccugccagaaaggaaacaucagguguaauauaugcauuuga

SEQ ID NO: 135351 - RNA, 1701 nt, Artificial Sequence; identical to SEQ ID NO: 135001
  derived and/or modified sequence opt3 from hemagglutinin__InfluenzaA__ALE31820

SEQ ID NO: 135352 - RNA, 1701 nt, Artificial Sequence
  derived and/or modified sequence opt3 from hemagglutinin__InfluenzaA__ALE31821
augaagaccaucauugcccugagcuacacacucugccuuguguucgcucagaaaauacccggcaacgacaauuccacugcaacgcuguguuuggggcaccaugccgucccuaacggaaccaucguuaagacaauuacuaaugauagaaucgaggugaccaacgcgacagaauuaguacaaaauucuucaauuggugagaucugcgacaguccacaccagauacuggauggcgaaaacuguacccuaaucgacgcucuccugggggauccgcagugcgacggauuucagaauaaaaagugggaucuuuucguggagaggagcaaagcccauuccaacuguuaucccuacgacgucccugauuaugcaucucugcggucguugguggccucaagcggcacucucgaauuuaauaacgagaguuucaauuggacagguguuacccaaaacgggacguccucugcuugcauucgccgaagcuccucaaguuucuucagccgucugaauuggcugacucaccucaacuacaccuauccagcauuaaaugugacaaugcccaacaacgagcaguuugacaagcuguacaucuggggaguccaucacccuggcacugauaaggaccagauuuuccuuuaugcccagucuuccggcagaaucaccgugucaacaaaaaggagccaacaggcuguaauaccaaauauugggagucggccccgcaucagagauauuccuucuaggaucuccaucuacuggaccauuguuaagccaggagacauauugcugaucaacagcacggguaaucuaauugccccgcggggcuacuuuaaaauccgcucggggaagucuuccauaaugcgaucagacgcgcccauuggaaaauguaagagugaaugcaucacuccuaacggcagcaucccaaaugauaagcccuuccagaacgugaauagaauuacauauggugcauguccuagguacgucaaacacuccacccucaagcuggccacugggaugcggaacgugccagagaaacagacacguggaaucuuuggcgcuauugccggcuucauagaaaaugggugggagggaaugguggacgguugguauggcuuucgccaucaaaacucugaggggagaggacaggcagcugaucuuaagagcacccaggccgcgaucgaccaaauuaauggcaaacugaacagguugaucgguaagacgaaugaaaaauuccaccagaucgagaaggaauuuucagaggucgaagggcggauucaggaucucgagaaguacguugaggacaccaaaauagaucuguggaguuauaacgccgaauuacugguggcacucgagaaucagcauacaaucgaccuuacugauuccgaaaugaacaagcuguuugagaaaaccaagaaacaauugcgagaaaacgcugaggacaugggcaauggaugcuucaagauuuaccacaagugugauaacgccugcaucggcagcauucgcaaugggacauaugaccacaacguauacagagacgaggcucuaaauaacagguuucagaucaaaggaguggaacugaagucugguuacaaagauuggauacucuggaucucauucgccauuaguugcuuucugcuuugugucgcacuguugggcuucaucaugugggccugccagaaggggaauauucgguguaacaucugcauauga

SEQ ID NO: 135353 - RNA, 1701 nt, Artificial Sequence; identical to SEQ ID NO: 135093
  derived and/or modified sequence opt3 from hemagglutinin__InfluenzaA__ALE31822

SEQ ID NO: 135354 - RNA, 1701 nt, Artificial Sequence; identical to SEQ ID NO: 135001
  derived and/or modified sequence opt3 from hemagglutinin__InfluenzaA__ALE31823

SEQ ID NO: 135355 - RNA, 1701 nt, Artificial Sequence; identical to SEQ ID NO: 134457
  derived and/or modified sequence opt3 from hemagglutinin__InfluenzaA__ALE31824

SEQ ID NO: 135356 - RNA, 1701 nt, Artificial Sequence
  derived and/or modified sequence opt3 from hemagglutinin__InfluenzaA__ALE31825
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauagauacccagcauuaaaugugacuaugcccaacaacgagcaguuugacaagcuguauauuuggggaguccaccauccuggcaccgauaaggaccagaucuuccuuuacgcccagucuuccggcaggauaacagugucaacuaaacggagccaacaggcuguaauuccaaauaucgggagucgccccagaauuagggauaucccuucucggaucuccauuuacuggaccauaguuaagccaggagacaucuugcugauuaacagcacagguaaucuaaucgccccgcgcggcuauuuuaaaauacgaucggggaagucuuccauuaugagaucagacgcgcccaucggaaaauguaagagugaaugcaucaccccuaacggcagcauuccaaaugauaagcccuuccagaacgugaauaggaucacguacggugcauguccucgguaugucaaacacuccacucucaagcuggccacagggaugcguaacgugccagagaaacagacccgcggaauuuuuggcgcuauagccggcuucaucgaaaaugggugggagggaaugguggacgguugguacggcuuuagacaccaaaacucugaggggaggggacaggcagcugaucuuaagagcacucaggccgcgauugaccaaaucaauggcaaacugaaccgguugaucgguaagacaaaugaaaaauuccaucagauugagaaggaauuuucagaggucgaagggcgaauacaggaucucgagaaguauguugaggacaccaaaaucgaucuguggaguuacaacgccgaauuacugguggcacucgagaaucagcacacgauugaccuuaccgauuccgaaaugaacaagcuguuugagaaaacaaagaaacaauugcgcgaaaacgcugaggacaugggcaauggaugcuucaagaucuaucauaagugugauaacgccugcauuggcagcaucagaaaugggacuuacgaccacaacguauacagggacgaggcucuaaauaaccgguuucagauaaaaggaguggaacugaagucugguuauaaagauuggauccucuggauuucauucgccaucaguugcuuucugcuuugugucgcacuguugggcuucauuaugugggccugccagaaggggaauauccgcuguaacauaugcauuuga

SEQ ID NO: 135357 - RNA, 1701 nt, Artificial Sequence; identical to SEQ ID NO: 134457
  derived and/or modified sequence opt3 from hemagglutinin__InfluenzaA__ALE31826

SEQ ID NO: 135358 - RNA, 1701 nt, Artificial Sequence; identical to SEQ ID NO: 134457
  derived and/or modified sequence opt3 from hemagglutinin__InfluenzaA__ALE31827

SEQ ID NO: 135359 - RNA, 1701 nt, Artificial Sequence; identical to SEQ ID NO: 134457
  derived and/or modified sequence opt3 from hemagglutinin__InfluenzaA__ALE31828

SEQ ID NO: 135360 - RNA, 1701 nt, Artificial Sequence; identical to SEQ ID NO: 135014
  derived and/or modified sequence opt3 from hemagglutinin__InfluenzaA__ALE31829

SEQ ID NO: 135361 - RNA, 1701 nt, Artificial Sequence
  derived and/or modified sequence opt3 from hemagglutinin__InfluenzaA__ALE31830
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacucaagcuggccaccgggaugcggaacgugccagagaaacagacucguggaauuuuuggcgcuauagccggcuucaucgaaaaugggugggagggaaugguggacgguugguacggcuuucgccaccaaaacucugaggggagaggacaggcagcugaucuuaagagcacacaggccgcgauugaccaaaucaauggcaaacugaacagguugaucgguaagaccaaugaaaaauuccaucagauugagaaggaauuuucagaggucgaagggcggauacaggaucucgagaaguauguugaggacacgaaaaucgaucuguggaguuacaacgccgaauuacugguggcacucgagaaucagcacaccauugacaucacagauuccgaaaugaacaaacuuuuugagaagacuaagaaacaacugcgagaaaacgcugaggacaugggcaauggaugcuucaagauuuaucauaagugugauaacgccugcaucggcagcauacgcaaugggaccuacgaccacaacguauacagagacgaggcuuugaauaacagguuucagaucaaaggaguggaacuaaagucugguuauaaagauuggauucuguggaucucauucgccauuaguugcuuucuccugugugucgcacuucugggcuucaucaugugggccugccagaaggggaauauacgguguaacauuugcaucuga

SEQ ID NO: 135362 - RNA, 1701 nt, Artificial Sequence
  derived and/or modified sequence opt3 from hemagglutinin__InfluenzaA__ALE31832
augaagaacaucauugcccugagcuacauacucugccuuguguucgcucagaaaauccccggcaaugacaacuccaccgcaacacuguguuuggggcaccaugccgucccuaauggaacuauuguuaagacgaucaccaacgauagaauugaggugacaaaugcgacugaauuaguacaaaacucuucaaucggugagauaugcgacaguccacaccagauccuggauggcgaaaauuguacccuaauugacgcucuccugggggauccgcagugcgacggauuucagaacaaaaagugggaucuuuucguggagaggagcaaagccuauuccaauuguuaccccuaugacgucccugauuacgcaucucugcggucguugguggccucaagcggcacacucgaauuuaacaaugagaguuucaacuggaccgguguuacucaaaaugggacauccucugcuugcauccgccgaagcaacuccucauuuuucagucgucugaauuggcugacccaucucaacuauacguacccagcauuaaacgugacuaugcccaauaacgagcaguuugacaagcuguauauuuggggaguccaccauccuggcaccgauaaggaccagaucuuccuuuacgcccagagcucuggcagaauaacaguguccacuaaaaggucacaacaggcuguaauuccaaauaucgggagccggccccgcauuagagauaucccuaguaggaucucuauuuacuggaccauaguuaagccaggagacaucuugcugauuaacuccacagguaaucuaaucgccccgcggggcuauuuuaaaauacgcagcgggaagucgucuauuaugcgauccgacgcgcccaucggaaaauguaagucagaaugcaucaccccuaacggcaguauuccaaaugauaagcccuuccagaacgugaauagaaucacguacggugcauguccuagguaugucaaacacagcacucucaagcuggccacagggaugcggaacgugccagagaaacagacccguggaauuuuuggcgcuauagccggcuucaucgaaaaugggugggagggaaugguggacgguugguacggcuuucgccaccaaaacuccgaggggagaggacaggcagcugaucuuaagucuacucaggccgcgauugaccaaaucaauggcaaacugaacagguugaucgguaagacaaaugaaaaauuccaucagauugagaaggaguucagcgaagucgaagggcggauacaggaucucgagaaguauguugaggacaccaaaaucgaucuguggucauacaacgccgaauuacugguggcacucgagaaccagcacacgauugaccuuaccgauagugaaaugaauaagcuguuugagaaaacaaagaaacaauugcgagaaaacgcugaggacaugggcaauggaugcuucaagaucuaucauaagugugauaacgccugcauuggcuccauccgcaaugggacuuacgaccacaacguauacagagacgaggcucuaaauaacagguuucagauaaaaggaguggaacucaagagcgguuauaaagauuggauccuguggauuucuuucgccaucucaugcuuucugcuuugugucgcacuguugggcuucauuaugugggccugccagaaggggaauauccgguguaacauaugcauuuga

SEQ ID NO: 135363 - RNA, 1701 nt, Artificial Sequence
  derived and/or modified sequence opt3 from hemagglutinin__InfluenzaA__ALE31833
augaagaccaucauugcccugagcuacauacucugccuuguguccgcucagaaaauccccggcaacgacaauucuacagcaacucuguguuuggggcaccaugccgucccuaacggaacgauuguuaagaccaucacaaaugauagaauugaggugacuaacgcgaccgaauuaguacaaaauucaaguaucggugagauaugcaacagcccacaccagauccuggacggcgaaaauuguacacuaauugaugcucuccugggggacccgcagugcgauggauuccagaacaaaaagugggaccuuuuuguggagagguccaaagccuauucuaauuguuaccccuaugaugucccugacuacgcaucgcugcggucauugguggccagcaguggcacccucgaguucaacaaugaauccuuuaacuggacugguguuacacaaaaugggaccucuagcgcuugcauccgccgauccucaaguagcuucuuuucucgucugaacuggcugacgcaucucaauuauacuuacccagcauuaaacgugaccaugcccaacaaugagcaguucgauaagcuguauauuuggggaguccaccauccuggcacagacaaggaucagaucuuucuuuacgcccaguccucaggcagaauaacugugagcaccaaaaggagucaacaggcuguaauuccaaacaucgggucucggccccgcauuagagacaucccuuccaggaucagcauuuacuggacaauaguuaagccaggagauaucuugcugauuaauucgaccgguaaccuaaucgccccgcggggcuauuucaaaauacgcucugggaaguccucaauuaugcgaagugacgcgcccaucggaaaauguaagagcgaaugcaucacgccuaauggcuccauuccaaacgacaagcccuuucagaaugugaacagaaucacuuacggugcauguccuagguaugucaaacacucuacacucaagcuggccaccgggaugcggaaugugccagagaaacagacucguggaauuuucggcgcuauagccggcuuuaucgaaaacgggugggagggaaugguggaugguugguacggcuuccgccaccaaaauagcgaggggagaggacaggcagcugaccuuaagucaacacaggccgcgauugaucaaaucaacggcaaacugaauagguugaucgguaagaccaacgaaaaauuucaucagauugagaaggaguucagugaagucgaagggcggauacaggaccucgagaaguauguugaggauacgaaaaucgaccugugguccuacaaugccgaauuacugguggcacucgagaaccagcacaccauugaucuuacagacagcgaaaugaacaagcuguucgagaaaacuaagaaacaauugcgagaaaaugcugaggauaugggcaacggaugcuuuaagaucuaucauaagugugacaaugccugcauuggcucuauccgcaacgggaccuacgaucacaauguauacagagacgaggcucuaaacaauagguuccagauaaaaggaguggaacugaagucagguuauaaagacuggauccucuggauuaguuuugccaucagcugcuuccugcuuugugucgcacuguugggcuuuauuaugugggccugccagaaggggaacauccgguguaauauaugcauuuga

SEQ ID NO: 135364 - RNA, 1701 nt, Artificial Sequence
  derived and/or modified sequence opt3 from hemagglutinin__InfluenzaA__ALE31834
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagcccauuccaacuguuaucccuacgacgucccugauuaugcaucuuugcggucgcucguggccucaagcggcacccuggaauuuaauaacgagaguuucaauugggcugguguuacucaaaacgggacauccucuagcugcauucgcggauccaauucaaguuucuucagccgacugaacuggcucacccacuuaaauucuaaguacccagcacugaacgugacgaugcccaacaaugagcaguuugacaaacuuuauaucuggggcguccaucacccuggcacugauaaggaccagauuuucuuguacgcccaguccucagggcguaucaccgugagcacaaagagaagucaacaggcuguaauaccaaacauuggaucuaggccccggauccgcgauauuccuuccagaaucagcaucuauuggacuauuguuaaaccaggugacauacugcuaaucaauucgaccggcaaccucauugccccgaggggguacuuuaagauccggucuggaaaauccucaauaaugcgcagugacgcgcccauuggcaaguguaagagcgaaugcaucacaccuaaugguuccaucccaaacgauaaacccuuccagaaugugaaccgaauuaccuacggggcauguccuagauaugucaagcagucuacgcugaaacuugccacuggaaugaggaaugugccagagaagcaaacacggggcaucuuuggcgcuauugccggguucauagaaaacggaugggaggguaugguggacggcugguacggguuucgucaccagaauagcgagggacgcggccaggcagcugaucugaaaucaacccaagccgcgaucgaccagauuaacgguaaguugaauagacucaucgggaaaacuaacgaaaaguuccaucagaucgagaaggaauuuagugaggucgaaggcaggauucaggaucuggagaaauauguugaggacacaaagauagauuuaugguccuacaaugccgaacugcucguggcacuugagaaccaacacaccaucgaccugacggauagcgaaaugaacaaauuguuugagaagaccaaaaagcagcuacgggaaaaugcugaggacaugggaaacggcugcuucaagauuuaucauaaaugugauaaugccugcaucgggucuauucgaaacggaacauacgaccacgacguauaucgcgaugaggcucugaauaacagauuucagaucaaggguguggaacucaaaucaggcuacaaggacuggauacuguggaucaguuucgccauuagcugcuuucuucugugugucgcauugcucggguucaucaugugggccugccagaaaggaaauauuagguguaacaucugcauauga

SEQ ID NO: 135365 - RNA, 1701 nt, Artificial Sequence; identical to SEQ ID NO: 135115
  derived and/or modified sequence opt3 from hemagglutinin__InfluenzaA__ALE31835

SEQ ID NO: 135366 - RNA, 1701 nt, Artificial Sequence; identical to SEQ ID NO: 134457
  derived and/or modified sequence opt3 from hemagglutinin__InfluenzaA__ALE31836

SEQ ID NO: 135367 - RNA, 1701 nt, Artificial Sequence
  derived and/or modified sequence opt3 from hemagglutinin__InfluenzaA__ALE31837
augaagaccaucauugcccugagcuacauacucugccuuguguaugcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuccagaauaaaaagugggaucuuuuuguggagaggagcaaagccuacuccaacuguuaucccuacgacgucccugauuaugcaucucugcggucguugguggccucaagcggcacccucgaguucaauaacgaaaguuuuaauuggacugguguuacacaaaacgggaccuccucugcuugcauccgccgaagcuccucaaguuucuuuagccgucugaauuggcugacgcaucucaacuacacuuauccagcauuaaaugugaccaugcccaacaacgagcaguucgacaagcuguacauuuggggaguccaccauccuggcacagauaaggaccagaucuuucuuuacgcccagucuuccggcagaauaacugugucaaccaaaaggagccaacaggcuguaauuccaaauaucgggagucggccccgcauuagagauaucccuucuaggaucuccauuuauuggacaauaguuaagccaggagacaucuugcugauuaacagcaccgguaaucuaaucgccccgcggggcuacuucaaaauacgcucggggaagucuuccauuaugcgaucagacgcgcccaucggaaaauguaagagugaaugcaucacgccuaacggcagcauuccaaaugauaagcccuuucagaacgugaauagaaucacuuauggugcauguccuagguacgucaaacacuccacacucaagcuggccaccgggaugcggaacgugccagagaaacagacucguggaauuuucggcgcuauagccggcuuuaucgaaaaugggugggagggaaugguggacgguugguauggcuuccgccaccaaaacucugaggggagaggacaggcagcugaucuuaagagcacacaggccgcgauugaccaaaucaauggcaaacugaacagguugaucgguaagaccaaugaaaaauuucaucagauugagaaggaguucucagaagucgaagggcggauacaggaucucgagaaguacguugaggacacgaaaaucgaucuguggaguuauaacgccgaauuacugguggcacucgagaaucagcacaccauugaccuuacagauuccgaaaugaacaagcuguucgagaaaacuaagaaacaauugcgagaaaacgcugaggacaugggcaauggaugcuuuaagaucuaccauaagugugauaacgccugcauuggcagcauccgcaaugggaccuacgaccacaacguauauagagacgaggcucuaaauaacagguuccagauaaaaggaguggaacugaagucugguuacaaagauuggauccucuggauuucauuugccaucaguugcuuccugcuuugugucgcacuguugggcuuuauuaugugggccugccagaaggggaauauccgguguaacauaugcauuuga

SEQ ID NO: 135368 - RNA, 1701 nt, Artificial Sequence; identical to SEQ ID NO: 134457
  derived and/or modified sequence opt3 from hemagglutinin__InfluenzaA__ALE31838

SEQ ID NO: 135369 - RNA, 1701 nt, Artificial Sequence; identical to SEQ ID NO: 134457
  derived and/or modified sequence opt3 from hemagglutinin__InfluenzaA__ALE31839

SEQ ID NO: 135370 - RNA, 1701 nt, Artificial Sequence
  derived and/or modified sequence opt3 from hemagglutinin__InfluenzaA__ALE31840
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucgguugcgcauuagagauauccccucuaggaucuccauuuacuggacaauaguuaagccuggagacauccugcuaauuaacagcaccgguaaucucaucgccccacggggcuauuuuaaaauacgcucggggaagucuuccauuaugcgaucagacgcgccgaucggaaaauguaagagugaaugcaucacgcccaacggcagcauuccuaaugauaagccauuccagaacgugaauagaaucacuuacggugcaugucccagguaugucaaacacuccacacugaagcuggccaccgggaugcggaacgugccugagaaacagacucguggaauuuuuggcgcuauagccggcuucaucgaaaaugggugggagggaaugguggacgguugguacggcuuucgccaccaaaacucugaggggagaggacaggcagcugaucuuaagagcacacaggccgcgauugaccaaaucaauggcaaauugaacaggcucaucgguaagaccaaugaaaaauuccaucagauugagaaggaauuuucagaggucgaagggcggauacaggaucuggagaaguauguugaggacacgaaaaucgauuuauggaguuacaacgccgaacugcucguggcacuugagaaucagcacaccauugaccugacagauuccgaaaugaacaaguuguuugagaaaacuaagaaacaacuacgagaaaacgcugaggacaugggcaauggaugcuucaagaucuaucauaagugugauaacgccugcauuggcagcauccgcaaugggaccuacgaccacaacguauacagagacgaggcucugaauaacagguuucagauaaaaggaguggaacucaagucugguuauaaagauuggauccuguggauuucauucgccaucaguugcuuucuucugugugucgcauugcucggcuucauuaugugggccugccagaaggggaauauccgguguaacauaugcauuuga

SEQ ID NO: 135371 - RNA, 1701 nt, Artificial Sequence; identical to SEQ ID NO: 134457
  derived and/or modified sequence opt3 from hemagglutinin__InfluenzaA__ALE31842

SEQ ID NO: 135372 - RNA, 1701 nt, Artificial Sequence
  derived and/or modified sequence opt3 from hemagglutinin__InfluenzaA__ALE31843
augcagaccaucauugcccugagcuacauacucugccuuguguucgcucaaaagauccccggcaacgacaauuccacagcaacucuguguuuggggcaccaugccgucccuaacggaacgauuguuaaaaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaagaaaugggaucuuuucguggagaggagcaaggccuauuccaacuguuaccccuaugacgucccugauuacgcaucucugcggucguugguggccucaagcggcacccucgaauuuaauaacgagaguuucaauuggacugguguuacacagaacgggaccuccucugcuugcauccgcaaaagcuccucaaguuucuucagccgacugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccaaucuuccggccguauaacugugucaaccaaaagaagccagcaggcuguaauuccaaauaucgggaguaggccccggauucgcgauaucccuucuagaaucuccauuuacuggacaauaguuaagccaggagacaucuugcugauuaacagcaccgguaaucuaaucgccccgaggggcuauuuuaaaauacucucggggaagucuuccauuaugcggucagacgcgcccaucggaaaauguaagagugaaugcaucacgccuaacggcagcauuccaaaugauaagcccuuccagaacgugaaucgcaucacuuacggugcauguccucgauaugucaaacacuccacacugaagcuggccaccgggaugagaaacgugccagagaaacaaacuaggggaauuuuuggcgcuauagccggcuucaucgaaaaugggugggagggaaugguggacgguugguacggcuuucggcaccagaacucugaggggcguggacaggcagcugaucuuaagagcacacaagccgcgauugaccagaucaauggcaaauugaaccgccucaucgguaagaccaaugaaaaauuccaucagauugagaaggaauuuucagaggucgaagggagaauacaggaucuggagaaguauguugaggacacgaaaaucgauuuauggaguuacaacgccgaacugcucguggcacuugagaaucaacacaccauugaccugacagauuccgaaaugaacaaguuguuugagaaaacuaagaaacagcuaagggaaaacgcugaggacaugggcaauggaugcuucaagaucuaucauaagugugauaacgccugcauuggcagcauccggaaugggaccuacgaccacaacguauaccgagacgaggcucugaauaaccgcuuucagauaaaaggaguggaacucaagucugguuauaaagauuggauccuguggauuucauucgccaucaguugcuuucuucugugugucgcauugcucggcuucauuaugugggccugccagaaggggaauaucagauguaacauaugcauuuga

SEQ ID NO: 135373 - RNA, 1701 nt, Artificial Sequence; identical to SEQ ID NO: 135014
  derived and/or modified sequence opt3 from hemagglutinin__InfluenzaA__ALE31844

SEQ ID NO: 135374 - RNA, 1701 nt, Artificial Sequence; identical to SEQ ID NO: 134990
  derived and/or modified sequence opt3 from hemagglutinin__InfluenzaA__ALE31846

SEQ ID NO: 135375 - RNA, 1701 nt, Artificial Sequence; identical to SEQ ID NO: 134457
  derived and/or modified sequence opt3 from hemagglutinin__InfluenzaA__ALE31847

SEQ ID NO: 135376 - RNA, 1701 nt, Artificial Sequence; identical to SEQ ID NO: 134457
  derived and/or modified sequence opt3 from hemagglutinin__InfluenzaA__ALE31848

SEQ ID NO: 135377 - RNA, 1701 nt, Artificial Sequence
  derived and/or modified sequence opt3 from hemagglutinin__InfluenzaA__ALE31850
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucuagcugcauucgcggauccaauucaaguuucuucagccgacugaacuggcucacccauuuaaauucuaaguauccagcacugaacgugacgaugcccaacaaugagcaguuugacaagcuguacaucuggggcguccaccauccuggcacugauaaagaccagauuuucuuguaugcccagccauccgggcguaucaccgugucaacaaagagaagccaacaggcuguaauacccaacauuggaaguaggccucggauccgcgauauuccaucuagaaucuccaucuacuggacuauuguuaaaccgggugacauacugcuaaucaauagcaccggcaaccucauugcccccaggggguacuuuaagauccggucgggaaaaucuuccauaaugcgcucagacgcgccuauuggcaaguguaagagugaaugcaucacaccaaaugguagcauccccaacgauaaaccuuuccagaaugugaaccgagucaccuauggggcauguccaagauacgugaagcaguccacgcugaaacuugccacuggaaugaggaaugugcccgagcggcaaacacguggcauuuuuggcgcuaucgccggguucauugaaaacggaugggaggguauggucgacggcugguauggguuucgccaccaaaauucugagggaagaggccaggcagcugaucuuaagagcacccaggccgcgauagaccagaucaacgguaaauugaauaggcucauugggaagacuaacgaaaaauuccaccagaucgagaaggaauuuucagagguugaaggccggauccaggaucuggagaaguacguggaggacacaaaaauugauuuauggaguuauaaugccgaacugcucguagcacuugagaaccaacauaccauagaccugacggauuccgaaaugaacaaguuguuugagaaaaccaagaaacagcuacgagaaaaugcugaggacaugggaaacggcugcuucaagaucuaccacaagugugauaaugccugcauugggagcauccgcaacggaacauaugaccaugacguguacagagaugaggcucugaauaacagguuucagauuaaaggugucgaacucaagucuggcuacaaagacuggauccuguggauaucauucgccaucaguugcuuucuucuguguguggcauugcucggguucauuaugugggccugccagaagggaaauauccgguguaacauuugcaucuga

SEQ ID NO: 135378 - RNA, 1701 nt, Artificial Sequence
  derived and/or modified sequence opt3 from hemagglutinin__InfluenzaA__ALE31851
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuauacuuacccagcauuaaaugugaccaugcccaacaacgagcaguuugacaagcuguauauuuggggaguccaccauccuggcacagauaaagaccagaucuuccuuuacgcccguucuuccggcagaauaacugugucaaccaagaggagccagcaagcuguaauuccaaauaucgggagucggccccgcauuagagauaucccuucuaggaucuccauuuacuggacaauaguuaaaccaggagacaucuugcugauuaacagcaucgguaaucuaauagccccgcggggcuauuuuaagauucgcucggggaaaucuuccaucaugcgaucagacgcgcccaucggaaaguguaagagugaaugcauuaccccuaacggcagcaucccaaaugauaaacccuuccagaacgugaauagaauuacguacggugcauguccuagguaugucaagcacuccacucucaaacuggccacagggaugcggaacgugccagagaagcagacccguggaauauuuggcgcuaucgccggcuucauugaaaaugggugggagggaaugguggacgguugguacggcuuucgccaccagaacucugaggggagaggacaagcagcugaucuuaaaagcacucaggccgcgaucgaccagaucaauggcaagcugaacagguugauugguaaaacaaaugaaaaguuccaucaaauagagaaggaauuuucagaggucgaagggcggauccaggaucucgagaaauauguugaggacaccaagauugaucuguggaguuacaacgccgaauuacugguggcacucgagaaucagcacacgaucgaccuuaccgauuccgaaaugaacaaacuguuugagaagacuaaaaagcaguugcgagaaaacgcugaggacaugggcaauggaugcuucaagauuuaucauaaaugugauaacgccugcaucggcagcauacgcaaugggacauacgaccacaacguauacagagacgaggcucuaaauaacagguuucaaaucaagggaguggaacugaaaucugguuauaaggauuggauucucuggaucucauucgccauuaguugcuuucugcuuugugucgcacuguugggcuucaucaugugggccugccagaaagggaauauacgguguaacauuugcaucuga

SEQ ID NO: 135379 - RNA, 1701 nt, Artificial Sequence; identical to SEQ ID NO: 135001
  derived and/or modified sequence opt3 from hemagglutinin__InfluenzaA__ALE31852

SEQ ID NO: 135380 - RNA, 1701 nt, Artificial Sequence
  derived and/or modified sequence opt3 from hemagglutinin__InfluenzaA__ALE31853
augaagaccaucauugcccugagcuacauacucugccuuguguucacacagaaaauccccggcaacgacaauuccacugcuacgcuguguuuggggcaccaugcagucccuaacggaaccauuguuaagacaaucacuaaugauagaauugaggugaccaacgccacagaauuaguacaaaauucuucaaucggugagauaugcgacaguccacaccagauccuggauggcgaaaacuguacccuaauugacgcgcuccugggggauccgcagugcgacggauuucagaauaaaaagugggaucuuuucguggagaggagcaaggcuuauuccaacuguuaccccuaugacgucccugauuacgccucucugcggucguugguggcaucaagcggcacucucgaauuuaauaacgagaguuucaauuggacagguguuacccaaaacgggacguccucugccugcauccgccgaagcuccucaaguuucuucagccgucugaauuggcugacucaucucaacuauaccuacccagcuuuaaaugugacaaugcccaacaacgagcaguuugacaaacuguauauuuggggaguccaccauccuggcacugauaaggaccagaucuuccuuuacgcacagucuuccggcagaauaaccgugucaacaaaaaggagccaacaggccguaauuccaaauaucgggagucggccccgcauuagagauaucccuucuaggaucuccauuuacuggaccauaguuaagccaggagacaucuugcugauuaacagcacggguaaucuaaucgcuccgcggggcuauuuuaaaauacgcucggggaagucuuccauuaugcgaucagacgcccccaucggaaaauguaagagugaaugcaucacuccuaacggcagcauuccaaaugauaagcccuuccagaacgugaauagaaucacauacggugcguguccuagguaugucaaacacuccacccucaagcuggcaacugggaugcggaacgugccagagaaacagacacguggaauuuuuggcgccauagcuggcuucaucgaaaaugggugggagggaaugguggacgguugguacggcuuucgccaccaaaacucugaggggagaggacaggccgcagaucuuaagagcacccaggcugccauugaccaaaucaauggcaaacugaacagguugaucgguaagacgaaugaaaaauuccaucagauugagaaggaauuuucagaggucgaagggcggauacaggaucucgagaaguauguugaggacaccaaaaucgaucuguggaguuacaacgcggaauuacugguggcccucgagaaucagcacacaauugaccuuacugauuccgaaaugaacaagcuguuugagaaaaccaagaaacaauugcgagaaaacgcagaggacaugggcaauggaugcuucaagaucuaucauaagugugauaacgcuugcauuggcagcauccgcaaugggacauacgaccacaacguauacagagacgaggcccuaaauaacagguuucagauaaaaggaguggaacugaagucugguuauaaagauuggauccucuggauuucauucgcuaucaguugcuuucugcuuugugucgcccuguugggcuucauuaugugggcaugccagaaggggaauauccgguguaacauaugcauuuga

SEQ ID NO: 135381 - RNA, 1701 nt, Artificial Sequence
  derived and/or modified sequence opt3 from hemagglutinin__InfluenzaA__ALE31854
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgccagaucuuccggcaggauaacugugucaaccaaagggagccagcaagcuguaauuccaaauaucggaagucggccccgcauuagagauaucccuucuaggaucuccauuuacuggacaauaguuaagccaggugacaucuugcugauuaacagcaccggcaaucuaaucgccccgcggggguauuuuaaaauacgcucgggaaagucuuccauuaugcgaucagacgcgcccaucggcagauguaaaagugaaugcaucacgccuaacgguagcauuccaaaugauaagcccuuccagaacgugaauaggaucacuuacggggcauguccucgguaugucaagcacuccacacucaaacuggccaccggaaugcguaacgugccagagaagcagacucgcggcauuuuuggcgcuauagccggguucaucgaaaauggaugggaggguaugguggacggcugguacggguuuagacaccagaacucugagggaaggggccaagcagcugaucuuaaaagcacacaggccgcgauugaccagaucaaugguaagcugaaccgguugaucgggaaaaccaaugaaaaguuccaucaaauugagaaagaauuuucagaggucgaaggccgaauacaggaucucgagaaguauguugaggacacgaagaucgaucuguggaguuacaacgccgaauuacugguggcacucgagaaucagcacaccauugaccuuacagauuccgaaaugaacaaacuguuugagaagacuaaaaagcaguugcgcgaaaacgcugaggacaugggaaauggcugcuucaaaaucuaucauaagugugauaacgccugcauugggagcaucagaaauggaaccuacgaccacaacguauacagggacgaggcucuaaauaaccgguuucaaauaaaggguguggaacugaaaucuggcuauaaggauuggauccucuggauuucauucgccaucaguugcuuucugcuuugugucgcacuguugggguucauuaugugggccugccagaaaggaaauauccgcuguaacauaugcauuuga

SEQ ID NO: 135382 - RNA, 1701 nt, Artificial Sequence; identical to SEQ ID NO: 135143
  derived and/or modified sequence opt3 from hemagglutinin__InfluenzaA__ALE31855

SEQ ID NO: 135383 - RNA, 1701 nt, Artificial Sequence; identical to SEQ ID NO: 134457
  derived and/or modified sequence opt3 from hemagglutinin__InfluenzaA__ALE31856

SEQ ID NO: 135384 - RNA, 1701 nt, Artificial Sequence; identical to SEQ ID NO: 134457
  derived and/or modified sequence opt3 from hemagglutinin__InfluenzaA__ALE31857

SEQ ID NO: 135385 - RNA, 1701 nt, Artificial Sequence
  derived and/or modified sequence opt3 from hemagglutinin__InfluenzaA__ALE31858
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaaguauacuuacccagcauuaaacgugaccaugcccaauaacgagcaguuugacaagcuguauauuuggggaguccaccauccuggcacagauaaagaccagaucuuccuuuacgcccagucuuccggcagaauaacugugucaaccaagaggagccaacaggcuguaauuccaaacaucgggagucggccccgcauuagagauaucccuucuaggaucuccauuuacuggacaauaguuaaaccaggagacaucuugcugauuaauagcaccgguaaccuaaucgccccgcggggcuauuuuaagauacgcucggggaaaucuuccauuaugcgaucagacgcgcccaucggaaaguguaagagugaaugcaucacgccuaauggcagcauuccaaacgauaaacccuuccagaaugugaacagaaucacuuacggugcauguccuagguaugucaagcacuccacacucaaacuggccaccgggaugcggaaugugccagagaagcagacucguggaauuuuuggcgcuauagccggcuucaucgaaaacgggugggagggaaugguggacgguugguacggcuuucgccaccaaaauucugaggggagaggacaggcagcugaucuuaaaagcacacaggccgcgauugaccaaaucaacggcaagcugaauagguugaucgguaaaaccaacgaaaaguuccaucagauugagaaggaauuuucagaggucgaagggcggauacaggaucucgagaaauauguugaggacacgaagaucgaucuguggaguuacaaugccgaauuacugguggcacucgagaaccagcacaccauugaccuuacagauuccgaaaugaauaaacuguuugagaagacuaaaaagcaauugcgagaaaacgcugaggacaugggcaacggaugcuucaagaucuaucauaaaugugauaaugccugcauuggcagcauccgcaacgggaccuacgaccacaauguauacagagacgaggcucuaaacaauagguuucagauaaagggaguggaacugaaaucugguuauaaggauuggauccucuggauuucauucgccaucaguugcuuucugcuuugugucgcacuguugggcuucauuaugugggccugccagaaagggaacauccgguguaauauaugcauuuga

SEQ ID NO: 135386 - RNA, 1701 nt, Artificial Sequence
  derived and/or modified sequence opt3 from hemagglutinin__InfluenzaA__ALE31859
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcacgcgccgaagcuccucaaguuucuucagccgucugaauuggcugacucaucucaacuauaccuacccagcauuaaaugugacaaugcccaacaacgagcaguuugacaagcuguauaucuggggaguccaccauccuggcacugauaaggaccagauuuuccuuuacgcccagucuuccggcagaaucaccgugucaacaaaaaggagccaacaggcuguaauaccaaauauugggagucggccccgcaucagagauauuccuucuaggaucuccaucuacuggaccauuguuaagccaggagacauguugcugauaaacagcacggguaaucuaaucgccccgcggggcuauuuuaaaauucgcucggggaagucuuccaucaugcgaucagacgcgcccauaggaaaauguaagagugaaugcauuacuccuaacggcagcaucccaaaugauaagcccuuccagaacgugaauagaaucacauacggugcauguccuagguaugucaaacacuccacccucaagcuggccacugggaugcggaacgugccagagaaacagacacguggaauuuuuggcgcuaucgccggcuucauugaaaaugggugggagggaaugguggacgguugguacggcuuucgccaccaaaacucugaggggagaggacaggcagcugaucuuaagagcacccaggccgcgauagaccaaaucaauggcaaacugaacagguugauugguaagacgaaugaaaaauuccaucagaucgagaaggaauuuucagaggucgaagggcggauccaggaucucgagaaguauguugaggacaccaaaauugaucuguggaguuacaacgccgaauuacugguggcacucgagaaucagcacacaauagaccuuacugauuccgaaaugaacaagcuguuugagaaaaccaagaaacaauugcgagaaaacgcugaggacaugggcaauggaugcuucaagaucuaucauaagugugauaacgccugcauuggcagcauccgcaaugggacauacgaccacaacguauacagagacgaggcucuaaauaacagguuucagauuaaaggaguggaacugaagucugguuauaaagauuggauccucuggauaucauucgccaucaguugcuuucugcuuugugucgcacuguugggcuucauuaugugggccugccagaaggggaauauccgguguaacauuugcaucuga

SEQ ID NO: 135387 - RNA, 1701 nt, Artificial Sequence
  derived and/or modified sequence opt3 from hemagglutinin__InfluenzaA__ALE31860
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucgguaaaauaugcgacaguccacaccagauccuggauggcgagaacuguacacuaauugacgcucuccugggggauccgcagugcgacggauuucagaauaagaaaugggaucuuuucguggaaaggagcaaggccuauuccaacuguuaccccuaugacgucccugauuacgcaucucugcggucguugguggccucaagcggcacccucgaguuuaauaacgaaaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaagaccagaucuuccuuuacgcccagucuuccggcagaauaacugugucaaccaagaggagccaacaggcuguaauuccaaauaucgggagucggccccgcauuagagauaucccuucuaggaucuccauuuacuggacaauaguuaaaccaggagacaucuugcugauuaacagcaccgguaaucuaaucgccccgcggggcuauuuuaagauacgcucgggggagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacucaagcuggccaccgggaugcggaacgugccagagaaacagacucguggaauuuuuggcgcuauagccggcuucaucgaaaaugggugggagggaaugguggacgguugguacggcuuucgccaccaaaacucugaggggagaggacaggcagcugaucuuaagagcacacaggccgcgauugaccaaaucaauggcaaacugaacagguugaucgguaagaccaaugaaaaauuccaucagauugagaaggaauuuucagaggucgaagggcggauacaggaucucgagaaguauguugaggacacgaaaaucgaucuguggaguuacaacgccgaauuacugguggcacucgagaaucagcacaccauugaccuuacagauuccgaaaugaacaagcuguuugagaaaacuaagaaacaauugcgagaaaacgcugaggacaugggcaauggaugcuucaagaucuaucauaagugugauaacgccugcauuggcagcauccgcaaugggaccuacgaccacaacguauacagagacgaggcucuaaauaacagguuucagauaaaaggaguggaacugaagucugguuauaaagauuggauccucuggauuucauucgccaucaguugcuuucugcuuugugucgcacuguugggcuucauuaugugggccugccagaaggggaauauccgguguaacauaugcauuuga

SEQ ID NO: 135388 - RNA, 1701 nt, Artificial Sequence; identical to SEQ ID NO: 134457
  derived and/or modified sequence opt3 from hemagglutinin__InfluenzaA__ALE31861

SEQ ID NO: 135389 - RNA, 1701 nt, Artificial Sequence
  derived and/or modified sequence opt3 from hemagglutinin__InfluenzaA__ALE31862
augaagaugaucauugcccugagcuacauacucugccuuguguucgcucagaaaauccccggcaacgacaauuccaccgcaacacuguguuuggggcaccaugccgucccuaacggaacuauuguuaagacgaucaccaaugauagaauugaggugacaaacgcgacugaauuaguacaaaauucuucaaucggugagauaugcgacaguccacaccagauccuggauggcgaaaacuguacccuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacacucgaauuuaauaacgagaguuucaauuggaccgguguuacucaaaacgggacauccucugcuugcauccgcaagagcuccucaaguuucuucagccgacugaauuggcugacccaucucaacuauacguacccagcauuaaaugugacuaugcccaacaacgagcaguuugacaagcuguauauuuggggaguccaccauccuggcaccgauaaagaccagaucuuccuuuacgcccguucuuccggcagaauaacagugucaacuaagaggagccagcaagcuguaauuccaaauaucgggagucggccccgcauuagagauaucccuucuaggaucuccauuuacuggaccauaguuaaaccaggagacaucuugcugauuaacagcacagguaaucuaaucgccccgcggggcuauuuuaagauacgcucggggaaaucuuccauuaugcgaucagacgcgcccaucggaaaguguaagagugaaugcaucaccccuaacggcagcauuccaaaugauaaacccuuccagaacgugaauagaaucacguacggugcauguccuagguaugucaagcacuccacucucaaacuggccacagggaugcggaacgugccagagaagcagacccguggaauuuuuggcgcuauagccggcuucaucgaaaaugggugggagggaaugguggacgguugguacggcuuucgccaccagaacucugaggggagaggacaagcagcugaucuuaaaagcacucaggccgcgauugaccagaucaauggcaagcugaacagguugaucgguaaaacaaaugaaaaguuccaucaaauugagaaggaauuuucagaggucgaagggcggauacaggaucucgagaaauauguugaggacaccaagaucgaucuguggaguuacaacgccgaauuuuuaguggcacuggagaaucagcacacgauugaccucaccgauuccgaaaugaacaaacuuuucgagaagacuaaaaagcagcugcgagaaaacgcugaggacaugggcaauggaugcuuuaagaucuaucauaaaugugauaacgccugcauuggcagcauccgcaaugggacauacgaccacaacguauacagagacgaggcuuugaauaacagguuccaaauaaagggaguggaacuaaaaucugguuauaaggauuggauccuguggauuucauuugccaucaguugcuuccuccugugugucgcacuucugggcuuuauuaugugggccugccagaaagggaauauccgguguaacauaugcauuuga

SEQ ID NO: 135390 - RNA, 1701 nt, Artificial Sequence; identical to SEQ ID NO: 135115
  derived and/or modified sequence opt3 from hemagglutinin__InfluenzaA__ALE31863

SEQ ID NO: 135391 - RNA, 1701 nt, Artificial Sequence; identical to SEQ ID NO: 135115
  derived and/or modified sequence opt3 from hemagglutinin__InfluenzaA__ALE31865

SEQ ID NO: 135392 - RNA, 1701 nt, Artificial Sequence; identical to SEQ ID NO: 135115
  derived and/or modified sequence opt3 from hemagglutinin__InfluenzaA__ALE31866

SEQ ID NO: 135393 - RNA, 1701 nt, Artificial Sequence
  derived and/or modified sequence opt3 from hemagglutinin__InfluenzaA__ALE31867
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuauacuuacccagcauuaaaugugaccaugcccaacaacgagcaguuugacaagcuguauauuuggggaguccaccauccuggcacagauaaagaccagaucuuccuuuacgcccguucuuccggcagaauaacugugucaaccaagaggagccagcaagcuguaauuccaaauaucgggagucggccccgcauuagagauaucccuucuaggaucuccauuuacuggacaauaguuaaaccaggagacaucuugcugauuaacagcaccgguaaucuaaucgccccgcggggcuauuuuaagauacgcucggggaaaucuuccauuaugcgaucagacgcgcccaucggaaaguguaagagugaaugcaucacgccuaacggcagcauuccaaaugauaaacccuuccagaacgugaauagaaucacuuacggugcauguccuagguaugucaagcacuccacacucaaacuggccaccgggaugcggaacgugccagagaagcagacucguggaauuuuuggcgcuauagccggcuucaucgaaaaugggugggagggaaugguggacgguugguacggcuuucgccaccagaacucugaggggagaggacaagcagcugaucuuaaaagcacacaggccgcgauugaccagaucaauggcaagcugaacagguugaucgguaaaaccaaugaaaaguuccaucaaauugagaaggaauuuucagaggucgaagggcggauacaggaucucgagaaauauguugaggacacgaagaucgaucuguggaguuacaacgccgaauuacugguggcacucgagaaucagcacaccauugaccuuacagauuccgaaaugaacaaacuguuugagaagacuaaaaagcaguugcgagaaaacgcugaggacaugggcaauggaugcuucaagaucuaucauaaaugugauaacgccugcauuggcagcauccgcaaugggaccuacgaccacaacguauacagagacgaggcucuaaauaacagguuucaaauaaagggaguggaacugaaaucugguuauaaggauuggauccucuggauuucauucgccaucaguugcuuucugcuuugugucgcacuguugggcuucauuaugugggccugccagaaugggaacauccgguguaauauaugcauuuga

SEQ ID NO: 135394 - RNA, 1701 nt, Artificial Sequence; identical to SEQ ID NO: 134457
  derived and/or modified sequence opt3 from hemagglutinin__InfluenzaA__ALE31868

SEQ ID NO: 135395 - RNA, 1701 nt, Artificial Sequence; identical to SEQ ID NO: 135393
  derived and/or modified sequence opt3 from hemagglutinin__InfluenzaA__ALE31869

SEQ ID NO: 135396 - RNA, 1701 nt, Artificial Sequence; identical to SEQ ID NO: 135393
  derived and/or modified sequence opt3 from hemagglutinin__InfluenzaA__ALE31870

SEQ ID NO: 135397 - RNA, 1701 nt, Artificial Sequence
  derived and/or modified sequence opt3 from hemagglutinin__InfluenzaA__ALE31871
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcaacaguccacaccagauccuggacggcgaaaauuguacacuaauugaugcucuccugggggacccgcagugcgauggauuucagaacaaaaagugggaccuuuucguggagaggagcaaagccuauuccaauuguuaccccuaugaugucccugacuacgcaucucugcggucguugguggccucaagcggcacccucgaauuuaacaaugagaguuucaacuggacugguguuacacaaaaugggaccuccucugcuugcauccgcaagagcuccucaaguuucuucagccgacugaacuggcugacgcaucucaauuauacuuacccagcauuaaacgugaccaugcccaacaaugagcaguuugauaagcuguauauuuggggaguccaccauccuggcacagacaaagaucagaucuuccuuuacgcccguucuuccggcagaauaacugugucaaccaagaggagccagcaagcuguaauuccaaacaucgggagucggccccgcauuagagacaucccuucuaggaucuccauuuacuggacaauaguuaaaccaggagauaucuugcugauuaauagcaccgguaaccuaaucgccccgcggggcuauuuuaagauacgcucggggaaaucuuccauuaugcgaucagacgcgcccaucggaaaguguaagagugaaugcaucacgccuaauggcagcauuccaaacgacaaacccuuccagaaugugaacagaaucacuuacggugcauguccuagguaugucaagcacuccacacucaaacuggccaccgggaugcggaaugugccagagaagcagacucguggaauuuuuggcgcuauagccggcuucaucgaaaacgggugggagggaaugguggaugguugguacggcuuucgccaccaaaauucugaggggagaggacaggcagcugaccuuaaaagcacacaggccgcgauugaucagaucaacggcaagcugaauagguugaucgguaaaaccaacgaaaaguuccaucaaauugagaaggaauuuucagaggucgaagggcggauacaggaccucgagaaauauguugaggauacgaagaucgaccuguggaguuacaaugccgaauuacugguggcacucgagaaccagcacaccauugaucuuacagacuccgaaaugaacaaacuguuugagaagacuaaaaagcaguugcgagaaaaugcugaggauaugggcaacggaugcuucaagaucuaucauaaaugugacaaugccugcauuggcagcauccgcaacgggaccuacgaucacaauguauacagagacgaggcucuaaacaauagguuucaaauaaagggaguggaacugaaaucugguuauaaggacuggauccucuggauuucauucgccaucaguugcuuucugcuuugugucgcacuguugggcuucauuaugugggccugccagaaagggaacauccgguguaauauaugcauuuga

SEQ ID NO: 135398 - RNA, 1701 nt, Artificial Sequence; identical to SEQ ID NO: 134443
  derived and/or modified sequence opt3 from hemagglutinin__InfluenzaA__ALE31872

SEQ ID NO: 135399 - RNA, 1701 nt, Artificial Sequence; identical to SEQ ID NO: 134457
  derived and/or modified sequence opt3 from hemagglutinin__InfluenzaA__ALE31873

SEQ ID NO: 135400 - RNA, 1701 nt, Artificial Sequence
  derived and/or modified sequence opt3 from hemagglutinin__InfluenzaA__ALE31874
augaagaccaucauugcccugagcuacauacucugccuuguguucgcucagaaacugcccggcaacgacaauuccgcagccacauuguguuuagggcaccaugcggucccuaacggaacuaucguuaagacgauuaccaaugauagaaucgaggugacaaacgcuacugaacugguacaaaauucuucaauuggugagaucugcgacaguccacaccagauacuagauggcgaaaacuguacccucaucgacgcccugcuuggggauccgcagugcgacggauuucagaauaaaaagugggaucuguucguggagaggagcaaagcacauuccaacuguuaucccuacgacgucccugauuaugccucuuugcggucgcucguggcuucaagcggcacacuggaauuuaauaacgagaguuucaauugggccgguguuacccaaaacgggacuuccucuagcugcauucgcggauccaauucaaguuucuucagccgacugaacuggcucacacacuuaaauucuaaguacccagcacugaacgugaccaugcccaacaaugagcaguuugacaaacuuuauaucuggggcguccaucacccuggcacggauaaggaccagauuuucuuguacgcucaguccucagggcguaucacugugagcaccaagagaagucaacaggccguaauaccaaacauuggaucuaggccccggauccgcgauauuccuuccagaaucagcaucuauuggacaauuguuaaaccaggugacauacugcuaaucaauucgacuggcaaccucauugcgccgaggggguacuuuaagauccggucuggaaaauccucaauaaugcgcagugacgcacccauuggcaaguguaagagcgaaugcaucaccccuaaugguuccaucccaaacgauaaacccuuccagaaugugaaccgaauuacauacggggccuguccuagauaugucaagcagucuacccugaaacuugcuacgggaaugaggaaugugccagagaagcaaacucggggcaucuuuggcgccauugcaggguucauagaaaacggaugggaggguaugguggacggcugguacggguuucgucaccagaauagcgagggacgcggccaggcugccgaucugaaaucaacacaagcggccaucgaccagauuaacgguaaguugaauagacucaucgggaaaaccaacgaaaaguuccaucagaucgagaaggaauuuagugaggucgaaggcaggauucaggaucuggagaaauauguugaggacacuaagauagauuuaugguccuacaaugcagaacugcucguggcucuugagaaccaacacacaaucgaccugaccgauagcgaaaugaacaaauuguuugagaagacgaaaaagcagcuacgggaaaaugccgaggacaugggaaacggcugcuucaagauuuaucauaaaugugauaaugcuugcaucgggucuauucgaaacggaaccuacgaccacgacguauaucgcgaugaggcccugaauaacagauuucagaucaaggguguggaacucaaaucaggcuacaaggacuggauacuguggaucaguuucgcaauuagcugcuuucuucugugugucgccuugcucggguucaucaugugggcuugccagaaaggaaauauuagguguaacaucugcauauga

SEQ ID NO: 135401 - RNA, 1701 nt, Artificial Sequence; identical to SEQ ID NO: 135400
  derived and/or modified sequence opt3 from hemagglutinin__InfluenzaA__ALE31875

SEQ ID NO: 135402 - RNA, 1701 nt, Artificial Sequence; identical to SEQ ID NO: 135400
  derived and/or modified sequence opt3 from hemagglutinin__InfluenzaA__ALE31876

SEQ ID NO: 135403 - RNA, 1701 nt, Artificial Sequence
  derived and/or modified sequence opt3 from hemagglutinin__InfluenzaA__ALE31877
augaagaccaucauugcccugagcuacauacucugccuuguguucgcucagaaacugcccgagaacgacaauuccacagcaacuuuguguuuaggccaccaugccgucccuaacgggacgaucguuaagaccauuacaucugauagaaucgaagugacuaaugcgaccgagcugguacaaaacucaaguauuggagaaaucugcgacagcccacaccagauacuagaugguaaaaauuguacacucaucgacgcucugcuuggcgauccgcagugcgacggguuucagaacaagaaaugggaucuguucguggagagguccaaggccuauucuaauuguuaccccuaugacgucccugauuacgcaucguugcggucacucguggccagcaguggaacccuggaauuuaacgacgaguccuucaauugggcuggcguuacucaaaacgguacaucuagcgcaugcauucgcggguccaauucaaguuucuuuagccgacugaacuggcucacccauucuaauuuuaaguauccagccuuaaacgugacgaugcccaauaacgagcaguucgauaaacuguacaucuggggaguccaccauccuggcacugacaaggaucagauuuuucuuuaugcucaguccucaggccguaucaccgugagcacaaaaagaagucaacaggccguaauaccaaacauugggucuaggccccggauccgcaauauuccuuccagaaucagcaucuacuggacuauuguuaagccaggagacauauugcugaucaacucgaccgguaaucuaauugcgccgaggggcuacuucaaaauccggucugggaaguccucaauaaugcgcagugacgcacccauuggaaaguguaaaagcgaaugcaucacaccuaacggcuccaucccaaaugauaagcccuuucagaacgugaaucgaauuaccuauggugccuguccuagauacgucaaacagucuacgcucaagcuggcuacugggaugaggaacgugccagagaaacaaacacggggaaucuucggcgccauugcaggcuuuauagaaaaugggugggagggaaugaaggacgguugguauggcuuccgucaccagaacagcgaggggcgcggacaggcugccgaucuuaaaucaacccaagcggccaucgaccagauuaauggcaagcugaacagauugaucgguaagacuaaugaaaaauuccaccagaucgagaaggaauuuagugagguggaagggaggauucaggaucucgagaaauacgucgaggacacaaagauagaucugugguccuauaacgcagaauuacugguugcucucgagaaucaacauaccaucgaccuuacggauagcgaaauuaacaaacuguucgagaagaccaagaaacaguugcgggaaaacgccgaggacaugggcaauggaugcuuuaagaucuaccacaaaugugauaacgcuugcauuggcucuauccgaaaugggacauaugaccaugacguguaccgcgaugaggcccuaaacaauagauuccagauaaagggaguagaacugaaaucagguuacaaggacuggauccucuggauuaguuuugcaaucagcugcuuccugcuuuguguggcccuguugggcuuuauuaugugggcuugccagaaggggaacaucagguguaauauaugcauuuga

SEQ ID NO: 135404 - RNA, 1701 nt, Artificial Sequence; identical to SEQ ID NO: 134457
  derived and/or modified sequence opt3 from hemagglutinin__InfluenzaA__ALE31878

SEQ ID NO: 135405 - RNA, 1701 nt, Artificial Sequence; identical to SEQ ID NO: 134457
  derived and/or modified sequence opt3 from hemagglutinin__InfluenzaA__ALE31879

SEQ ID NO: 135406 - RNA, 1701 nt, Artificial Sequence; identical to SEQ ID NO: 134457
  derived and/or modified sequence opt3 from hemagglutinin__InfluenzaA__ALE31880

SEQ ID NO: 135407 - RNA, 1701 nt, Artificial Sequence
  derived and/or modified sequence opt3 from hemagglutinin__InfluenzaA__ALE31881
augaagaccaucauugcccugagccacauacucugccuuguguucgcucagaaaauccccggcaacgacaauuccacagcaacucuguguuuggggcaucacgccgucccuaacggaacgauuguuaagaccaucacaaaugauagaauugaggugacuaacgcgaccgaauuaguacaaaauucuucaaucggugagauaugcgacaguccacaucagauccuggauggcgaaaacuguacacuaauugacgcucuccugggggauccgcagugcgacggauuucagaauaaaaagugggaucuuuucguggagaggagcaaagccuacuccaacuguuaucccuacgacgucccugauuaugcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaccucaacuacacuuauccagcauuaaaugugaccaugcccaacaacgagcaguuugacaagcuguacauuuggggaguccaucacccuggcacagauaaggaccagaucuuccuuuaugcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaguggccccgcggggcuacuuuaaaauccgcucggggaagucuuccauaaugcgaucagacgcgcccauuggaaaauguaagagugaaugcaucacgccuaacggcagcaucccaaaugauaagcccuuccagaacgucaauagaauuacuuauggugcauguccuagguacgugaaacacuccacacucaagcuggccaccgggaugcggaacgugccagagaaacagacucguggaaucuuuggcgcuauugccggcuucauagaaaaugggugggagggaauggucgacgguugguauggcuuucgccaucaaaacucugaggggagaggacaggcagcugaucuuaagagcacacaggccgcgaucgaccaaauuaauggcaaacugaacagguugaucgguaagaccaaugaaaaauuccaccagaucgagaaggaauuuucagagguugaagggcggauucaggaucucgagaaguacguggaggacacgaaaauagaucuguggaguuauaacgccgaauuacugguagcacucgagaaucagcauaccaucgaccuuacagauuccgaaaugaacaagcuguuugagaaaacuaagaaacaauugcgagaaaacgcugaggacaugggcaauggaugcuucaagauuuaccacaagugugauaacgccugcaucggcagcauucgcaaugggaccuaugaccacaacguguacagagacgaggcucuaaauaacagguuucagaucaaaggaauagaacugaagucugguuacaaagauuggauccucuggauuucauucgccaucaguugcuuucugcuuugugucgcacuguugggcuucauuaugugggccugccagaaggggaauauccgguguaacauaugcauuuga

SEQ ID NO: 135408 - RNA, 1701 nt, Artificial Sequence; identical to SEQ ID NO: 134457
  derived and/or modified sequence opt3 from hemagglutinin__InfluenzaA__ALE31882

SEQ ID NO: 135409 - RNA, 1701 nt, Artificial Sequence; identical to SEQ ID NO: 134457
  derived and/or modified sequence opt3 from hemagglutinin__InfluenzaA__ALE31888

SEQ ID NO: 135410 - RNA, 1701 nt, Artificial Sequence; identical to SEQ ID NO: 134457
  derived and/or modified sequence opt3 from hemagglutinin__InfluenzaA__ALE31889

SEQ ID NO: 135411 - RNA, 1701 nt, Artificial Sequence; identical to SEQ ID NO: 135115
  derived and/or modified sequence opt3 from hemagglutinin__InfluenzaA__ALE31890

SEQ ID NO: 135412 - RNA, 1701 nt, Artificial Sequence; identical to SEQ ID NO: 135115
  derived and/or modified sequence opt3 from hemagglutinin__InfluenzaA__ALE31891

SEQ ID NO: 135413 - RNA, 1701 nt, Artificial Sequence; identical to SEQ ID NO: 134457
  derived and/or modified sequence opt3 from hemagglutinin__InfluenzaA__ALE31892

SEQ ID NO: 135414 - RNA, 1701 nt, Artificial Sequence; identical to SEQ ID NO: 134457
  derived and/or modified sequence opt3 from hemagglutinin__InfluenzaA__ALE31893

SEQ ID NO: 135415 - RNA, 1701 nt, Artificial Sequence; identical to SEQ ID NO: 135063
  derived and/or modified sequence opt3 from hemagglutinin__InfluenzaA__ALE31894

SEQ ID NO: 135416 - RNA, 1701 nt, Artificial Sequence; identical to SEQ ID NO: 134443
  derived and/or modified sequence opt3 from hemagglutinin__InfluenzaA__ALE31895

SEQ ID NO: 135417 - RNA, 1701 nt, Artificial Sequence; identical to SEQ ID NO: 134457
  derived and/or modified sequence opt3 from hemagglutinin__InfluenzaA__ALE31896

SEQ ID NO: 135418 - RNA, 1701 nt, Artificial Sequence; identical to SEQ ID NO: 134457
  derived and/or modified sequence opt3 from hemagglutinin__InfluenzaA__ALE31897

SEQ ID NO: 135419 - RNA, 1701 nt, Artificial Sequence; identical to SEQ ID NO: 134457
  derived and/or modified sequence opt3 from hemagglutinin__InfluenzaA__ALE31898

SEQ ID NO: 135420 - RNA, 1701 nt, Artificial Sequence
  derived and/or modified sequence opt3 from hemagglutinin__InfluenzaA__ALE31899
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuauacuuacccagcauuaaaugugaccaugcccaacaacgagcaguuugacaagcuguauauuuggggaguccaccauccuggcacagauaaagaccagaucuuccuuuacgcccguucuuccggcagaauaacugugucaaccaagaggagccagcaagcuguaauuccaaauaucgggagucggccccgcauuagagauaucccuucuaggaucuccauuuacuggacaauaguuaaaccaggagacaucuugcugauuaacagcaccgguaaucuaaucgccccgcggggcuauuuuaagauacgcucggggaaaucuuccaugaugcgaucagacgcgcccauuggaaaguguaagagugaaugcaucacgccuaacggcagcaucccaaaugauaaacccuuccagaacgugaauagaauuacuuacggugcauguccuagguaugucaagcacuccacacucaaacuggccaccgggaugcggaacgugccagagaagcagacucguggaaucuuuggcgcuauugccggcuucauagaaaaugggugggagggaaugguggacgguugguacggcuuucgccaccagaacucugaggggagaggacaagcagcugaucuuaaaagcacacaggccgcgaucgaccagauuaauggcaagcugaacagguugaucgguaaaaccaaugaaaaguuccaucaaaucgagaaggaauuuucagaggucgaagggcggauucaggaucucgagaaauauguugaggacacgaagauagaucuguggaguuacaacgccgaauuacugguggcacucgagaaucagcacaccaucgaccuuacagauuccgaaaugaacaaacuguuugagaagacuaaaaagcaguugcgagaaaacgcugaggacaugggcaauggaugcuucaagauuuaucauaaaugugauaacgccugcaucggcagcauucgcaaugggaccuacgaccacaacguauacagagacgaggcucuaaauaacagguuucaaaucaagggaguggaacugaaaucugguuauaaggauuggauacucuggaucucauucgccauuaguugcuuucugcuuugugucgcacuguugggcuucaucaugugggccugccagaaagggaauauucgguguaacaucugcauauga

SEQ ID NO: 135421 - RNA, 1701 nt, Artificial Sequence; identical to SEQ ID NO: 135063
  derived and/or modified sequence opt3 from hemagglutinin__InfluenzaA__ALE31901

SEQ ID NO: 135422 - RNA, 1701 nt, Artificial Sequence
  derived and/or modified sequence opt3 from hemagglutinin__InfluenzaA__ALE31902
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacucaagcuggccaccgggaugcggaacgugccagagaaacagacucguggaauuuuuggcgcuauagccggcuucaucgaaaaugggugggagggaaugguggacgguugguacggcuuucgccaccaaaacucugaggggagaggacaggcagcugaucuuaagagcacacaggccgcgauugaccaaaucaauggcaaacugaacagguugaucgguaagaccaaugaaaaauuccaucagauugagaaggaauuuucagaggucgaagggcggauacaggaucucgagaaguauguugaggacacgaaaaucgaucuguggaguuacaacgccgaauuacugguggcacucgagaaucagcacaccauugaccuuacagauuccgaaaugaacaagcuguuugagcgaacuaaaaagcaauugcgcgaaaacgcugaggacaugggcaauggaugcuucaaaaucuaucauaagugugauaacgccugcauuggcagcaucagaaaugggaccuacgaccacaacguauacagggacgaggcucuaaauaaccgguuucagauaaagggaguggaacugaaaucugguuauaaggauuggauccucuggauuucauucgccaucaguugcuuucugcuuugugucgcacuguugggcuucauuaugugggccugccagaaagggaauauccgcuguaacauaugcauuuga

SEQ ID NO: 135423 - RNA, 1701 nt, Artificial Sequence; identical to SEQ ID NO: 134457
  derived and/or modified sequence opt3 from hemagglutinin__InfluenzaA__ALE31903

SEQ ID NO: 135424 - RNA, 1701 nt, Artificial Sequence; identical to SEQ ID NO: 134457
  derived and/or modified sequence opt3 from hemagglutinin__InfluenzaA__ALE31904

SEQ ID NO: 135425 - RNA, 1701 nt, Artificial Sequence
  derived and/or modified sequence opt3 from hemagglutinin__InfluenzaA__ALE31905
augaagaccaucauugcccugggcuacauacucugccuuggguucgcucagaaaauccccggaaacgacaauagcacagcaacucuguguuugggucaccaugccgugccuaacggcacgauugucaagaccaucacaaaugauagaauugagguuacuaacgcgaccgaauuagugcaaaauuccucuaucggggagauaugcgacucaccacacaaaauccuggauggagaaaacuguacacuaauugacgcucuccugggcgauccgcagugcgacgguuuucagaauaagaaaugggaucuuuucguagagaggaguaaggccuauagcaacuguuaccccuaugacgugccugauuacgcaucccugcggucuuuggucgccucgucagggacccucgaauuuaauaacgagagcuucaauuggacuggagugacacagaacggcaccaguuccgcuugcauccgccgaucuagcuccucauuuuucagucgucugaauuggcugacgcaucucaacuauacuuacccagcauuaaauguuaccaugcccaacaacgagcaauuugacaagcuguauauuuggggcgugcaccauccugggacagauaaagaccagaucuuccuuuacgcccagagcucuggaagaauaacugucuccaccaagaggucacagcaagcugugauuccaaauaucgguagccggccccgcauuagagauaucccuaguaggaucucuauuuacuggacaauaguaaaaccaggcgacaucuugcugauuaacuccaccgggaaucuaaucgccccgcggggauauuuuaagauacgcagcggcaaaucgucuauuaugcgauccgacgcgcccaucgguaaguguaagucagaaugcaucacgccuaacgggaguauuccaaaugauaaacccuuccagaacguuaauagaaucacuuacggagcauguccuagguaugugaagcacagcacacucaaacuggccaccggcaugcggaacgucccagagaagcagacucguggcauuuuuggggcuauagccggauucaucgaaaaugguugggagggcaugguggacgggugguacggauuucgccaccagaacuccgagggcagaggucaagcagcugaucuuaaaucuacacaggccgcgauugaccagaucaaugggaagcugaacagguugaucggcaaaaccaaugaaaaguuccaucaaauugagaaggaguucagcgaaguggaaggacggauacaggaucucgagaaauaugucgaggacacgaagaucgaucuguggucauacaacgccgaauuacugguugcacucgagaaucagcacaccauugaccuuacagauagugaaaugaacaaacuguuugagaagacuaaaaagcaguugcgagaaaacgcugaggacaugggcaaugggugcuucaagaucuaucauaaaugugauaacgccugcauuggauccauccgcaaugguaccuacgaccacaacguguacagagacgaggcucuaaauaacagguuucaaauaaagggcguagaacugaaaagcggguauaaggauuggauccucuggauuucuuucgccaucucaugcuuucugcuuuguguggcacuguugggauucauuaugugggccugccagaaaggcaauauccgguguaacauaugcauuuga

SEQ ID NO: 135426 - RNA, 1701 nt, Artificial Sequence; identical to SEQ ID NO: 134457
  derived and/or modified sequence opt3 from hemagglutinin__InfluenzaA__ALE31906

SEQ ID NO: 135427 - RNA, 1701 nt, Artificial Sequence
  derived and/or modified sequence opt3 from hemagglutinin__InfluenzaA__ALE31907
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauaaguacccagcauuaaaugugacuaugcccaacaacgagcaguuugacaagcuguauauuuggggaguccaccauccuggcaccgauaaagaccagaucuuccuuuacgcccagucuuccggcagaauaacagugucaacuaagaggagccaacaggcuguaauuccaaauaucgggagucggccccgcauuagagauaucccuucuaggaucuccauuuacuggaccauaguuaaaagcggagacaucuugcugauuaacucgacagguaaucuaaucgccccacggggcuauuuuaagauacgcucugggaaauccucaauuaugcgaagugacgcgccgaucggaaaguguaagagcgaaugcaucacccccaacggcuccauuccuaaugauaaaccauuccagaacgugaauagaaucacguacggugcaugucccagguaugucaagcacucuacucucaaacuggccacagggaugcggaacgugccugagaagcagacccguggaauuuuuggcgcuauagccggcuucaucgaaaaugggugggagggaaugguggacgguugguacggcuuucgccaccaaaacagcgaggggagaggacaggcagcugaucuuaaaucaacucaggccgcgauugaccaaaucaauggcaagcugaacagguugaucgguaaaacaaaugaaaaguuccaucagauugagaaggaauuuagugaggucgaagggcggauacaggaucucgagaaauauguugaggacaccaagaucgaucugugguccuacaacgccgaauuacugguggcacucgagaaucagcacacgauugaccuuaccgauagcgaaaugaacaaacuguuugagaagacuaaaaagcaauugcgagaaaacgcugaggacaugggcaauggaugcuucaagaucuaucauaaaugugauaacgccugcauuggcucuauccgcaaugggacauacgaccacaacguauacagagacgaggcucuaaauaacagguuucagauaaagggaguggaacugaaaucagguuauaaggauuggauccucuggauuaguuucgccaucagcugcuuucugcuuugugucgcacuguugggcuucauuaugugggccugccagaaagggaauauccgguguaacauaugcauuuga

SEQ ID NO: 135428 - RNA, 1701 nt, Artificial Sequence; identical to SEQ ID NO: 134457
  derived and/or modified sequence opt3 from hemagglutinin__InfluenzaA__ALE31908

SEQ ID NO: 135429 - RNA, 1701 nt, Artificial Sequence
  derived and/or modified sequence opt3 from hemagglutinin__InfluenzaA__ALE31909
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagagcggagacaucuugcugauuaacucgaccgguaaucuaaucgccccacggggcuauuuuaaaauacgcucugggaaguccucaauuaugcgaagugacgcgccgaucggaaaauguaagagcgaaugcaucacgcccaacggcuccauuccuaaugauaagccauuccagaacgugaauagaaucacuuacggugcaugucccagguaugucaaacacucuacacucaagcuggccaccgggaugcggaacgugccugagaaacagacucguggaauuuuuggcgcuauagccggcuucaucgaaaaugggugggagggaaugguggacgguugguacggcuuucgccaccaaaacagcgaggggagaggacaggcagcugaucuuaagucaacacaggccgcgauugaccaaaucaauggcaaacugaacagguugaucgguaagaccaaugaaaaauuccaucagauugagaaggaauuuagugaggucgaagggcggauacaggaucucgagaaguauguugaggacacgaaaaucgaucugugguccuacaacgccgaauuacugguggcacucgagaaucagcacaccauugaccuuacagauagcgaaaugaacaagcuguuugagaaaacuaagaaacaauugcgagaaaacgcugaggacaugggcaauggaugcuucaagaucuaucauaagugugauaacgccugcauuggcucuauccgcaaugggaccuacgaccacaacguauacagagacgaggcucuaaauaacagguuucagauaaaaggaguggaacugaagucagguuauaaagauuggauccucuggauuaguuucgccaucagcugcuuucugcuuugugucgcacuguugggcuucauuaugugggccugccagaaggggaauauccgguguaacauaugcauuuga

SEQ ID NO: 135430 - RNA, 1701 nt, Artificial Sequence; identical to SEQ ID NO: 134457
  derived and/or modified sequence opt3 from hemagglutinin__InfluenzaA__ALE31910

SEQ ID NO: 135431 - RNA, 1701 nt, Artificial Sequence; identical to SEQ ID NO: 135380
  derived and/or modified sequence opt3 from hemagglutinin__InfluenzaA__ALE31912

SEQ ID NO: 135432 - RNA, 1701 nt, Artificial Sequence
  derived and/or modified sequence opt3 from hemagglutinin__InfluenzaA__ALE31913
augaagaccaucauugcccugggcuacauacucugccuuguguucgcucagaaaauccccgggaacgacaauagcacagcaacucuguguuugggacaccaugccgucccuaacgguacgauuguuaagaccaucacaaaugauagaauugaggugacuaacgcgaccgaauuaguacaaaauuccucuaucggcgagauaugcgacucaccacacaaaauccuggauggggaaaacuguacacuaauugacgcucuccugggagauccgcagugcgacggcuuucagaauaagaaaugggaucuuuucguggagaggaguaaggccuauagcaacuguuaccccuaugacgucccugauuacgcaucccugcggucuuugguggccucgucagguacccucgaauuuaauaacgagagcuucaauuggacugggguuacacagaacggaaccaguuccgcuugcauccgccgaucuagcuccucauuuuucagucgucugaauuggcugacgcaucucaacuauacuuacccagcauuaaaugugaccaugcccaacaacgagcaauuugacaagcuguauauuuggggcguccaccauccuggcacagauaaagaccagaucuuccuuuacgcccagagcucugggagaauaacuguguccaccaagaggucacagcaagcuguaauuccaaauaucggaagccggccccgcauuagagauaucccuaguaggaucucuauuuacuggacaauaguuaaaccaggugacaucuugcugauuaacuccaccggcaaucuaaucgccccgcggggguauuuuaagauacgcagcggaaaaucgucuauuaugcgauccgacgcgcccaucggcaaguguaagucagaaugcaucacgccuaacgguaguauuccaaaugauaaacccuuccagaacgugaauagaaucacuuacggggcauguccuagguaugucaagcacagcacacucaaacuggccaccggaaugcggaacgugccagagaagcagacucguggcauuuuuggcgcuauagccggguucaucgaaaauggaugggaggguaugguggacggcugguacggguuucgccaccagaacuccgagggaagaggccaagcagcugaucuuaaaucuacacaggccgcgauugaccagaucaaugguaagcugaacagguugaucgggaaaaccaaugaaaaguuccaucaaauugagaaggaguucagcgaagucgaaggccggauacaggaucucgagaaauauguugaggacacgaagaucgaucuguggucauacaacgccgaauuacugguggcacucgagaaucagcacaccauugaccuuacagauagugaaaugaacaaacuguuugagaagacuaaaaagcaguugcgagaaaacgcugaggacaugggaaauggcugcuucaagaucuaucauaaaugugauaacgccugcauugaguccauccgcaaugggaccuacgaccacaacguauacagagacgaagcucuaaauaacagguuucaaauaaagggaguggagcugaaaagcgguuauaaggauuggauccucuggauuucuuucgccaucucaugcuuucugcuuugugucgcacuguugggcuucauuaugugggccugccagaaagggaauauccgguguaacauaugcauuuga

SEQ ID NO: 135433 - RNA, 1701 nt, Artificial Sequence; identical to SEQ ID NO: 134457
  derived and/or modified sequence opt3 from hemagglutinin__InfluenzaA__ALE31914

SEQ ID NO: 135434 - RNA, 1701 nt, Artificial Sequence
  derived and/or modified sequence opt3 from hemagglutinin__InfluenzaA__ALE31915
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugaauacgcaucucugcggucguugguggccucaagcggcacccucgaguuuaauaacgagaguuucaauuggacugguguuacacaaaacgggaccuccucugcuugcauccgccgaagcuccucaaguuucuuuagccgucugaauuggcugacgcaucucaacuauacuuacccagcauuaaaugugaccaugcccaacaacgaacaguuugauaagcuguauauuuggggaguccaccauccuggcacagacaaggaucagaucuuccuuuacgcccagucuuccggcagaauaacugugucaaccaaaaggagccaacaggcuguaauuccaaauaucgggagucggccccgcauuagagacaucccuucuaggaucuccauuuacuggacaauaguuaagccaggagauaucuugcugauuaacagcaccgguaaucuaaucgccccgcggggcuauuuuaaaauacgcucggggaagucuuccauuaugcgaucagacgcgcccaucggaaaauguaagagugagugcaucacgccuaacggcagcauuccaaaugacaagcccuuccagaacgugaauagaaucacuuacggugcauguccuagguaugucaaacacuccacacucaagcuggccaccgggaugcggaacgugccagaaaaacagacucguggaauuuuuggcgcuauagccggcuucaucgagaaugggugggagggaaugguggaugguugguacggcuuucgccaccaaaacucugaagggagaggacaggcagcugaccuuaagagcacacaggccgcgauugaucaaaucaauggcaaacugaacagguugaucgguaagaccaaugagaaauuccaucagauugaaaaggaguucucagaagucgaggggcggauacaggaccucgagaaguauguugaagauacgaaaaucgaccuguggaguuacaacgccgaguuacugguggcacucgaaaaucagcacaccauugaucuuacagacuccgagaugaacaagcuguuugagaaaacuaagaaacaauugcgagaaaacgcugaggauaugggcaauggaugcuucaagaucuaucauaagugugacaacgccugcauuggcagcauccgcaaugggaccuacgaucacaacguauacagagacgaagcucuaaauaacagguuucagauaaaaggaguggagcugaagucugguuauaaagacuggauccucuggauuucauucgccaucaguugcuuucugcuuugugucgcacuguugggcuucauuaugugggccugccagaaggggaauauccgguguaacauaugcauuuga

SEQ ID NO: 135435 - RNA, 1701 nt, Artificial Sequence; identical to SEQ ID NO: 134457
  derived and/or modified sequence opt3 from hemagglutinin__InfluenzaA__ALE31916

SEQ ID NO: 135436 - RNA, 1701 nt, Artificial Sequence; identical to SEQ ID NO: 134457
  derived and/or modified sequence opt3 from hemagglutinin__InfluenzaA__ALE31917

SEQ ID NO: 135437 - RNA, 1701 nt, Artificial Sequence; identical to SEQ ID NO: 134990
  derived and/or modified sequence opt3 from hemagglutinin__InfluenzaA__ALE31918

SEQ ID NO: 135438 - RNA, 1701 nt, Artificial Sequence; identical to SEQ ID NO: 135115
  derived and/or modified sequence opt3 from hemagglutinin__InfluenzaA__ALE31920

SEQ ID NO: 135439 - RNA, 1701 nt, Artificial Sequence; identical to SEQ ID NO: 134457
  derived and/or modified sequence opt3 from hemagglutinin__InfluenzaA__ALE31921

SEQ ID NO: 135440 - RNA, 1701 nt, Artificial Sequence; identical to SEQ ID NO: 134457
  derived and/or modified sequence opt3 from hemagglutinin__InfluenzaA__ALE31922

SEQ ID NO: 135441 - RNA, 1701 nt, Artificial Sequence; identical to SEQ ID NO: 135001
  derived and/or modified sequence opt3 from hemagglutinin__InfluenzaA__ALE31923

SEQ ID NO: 135442 - RNA, 1701 nt, Artificial Sequence; identical to SEQ ID NO: 134457
  derived and/or modified sequence opt3 from hemagglutinin__InfluenzaA__ALE31924

SEQ ID NO: 135443 - RNA, 1701 nt, Artificial Sequence; identical to SEQ ID NO: 134457
  derived and/or modified sequence opt3 from hemagglutinin__InfluenzaA__ALE31925

SEQ ID NO: 135444 - RNA, 1701 nt, Artificial Sequence
  derived and/or modified sequence opt3 from hemagglutinin__InfluenzaA__ALE31926
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgaggguuucaauuggacugggguuacacaaaacggaaccaguuccgcuugcauccgccgaucuagcuccucauuuuucagucgucugaauuggcugacgcaucucaacuauaaguacccagcauuaaaugugacuaugcccaacaacgagcaguuugacaagcuguauauuuggggcguccaccauccuggcaccgauaaagaccagaucuuccuuuacgcccagagcucugggagaauaacaguguccacuaagaggucacaacaggcuguaauuccaaauaucggaagccggccccgcauuagagauaucccuaguaggaucucuauuuacuggaccauaguuaaaccaggugacaucuugcugauuaacuccacaggcaaucuaaucgccccgcggggguauuuuaagauacgcagcggaaaaucgucuauuaugcgauccgacgcgcccaucggcaaguguaagucagaaugcaucaccccuaacgguaguauuccaaaugauaaacccuuccagaacgugaauagaaucacguacggggcauguccuagguaugucaagcacagcacucucaaacuggccacaggaaugcggaacgugccagagaagcagacccguggcauuuuuggcgcuauagccggguucaucgaaaauggaugggaggguaugguggacggcugguacggguuucgccaccaaaacuccgagggaagaggccaggcagcugaucuuaaaucuacucaggccgcgauugaccaaaucaaugguaagcugaacagguugaucgggaaaacaaaugaaaaguuccaucagauugagaaggaguucagcgaagucgaaggccggauacaggaucucgagaaauauguugaggacaccaagaucgaucuguggucauacaacgccgaauuacugguggcacucgagaaucagcacacgauugaccuuaccgauagugaaaugaacaaacuguuugagaagacuaaaaagcaauugcgagaaaacgcugaggacaugggaaauggcugcuucaagaucuaucauaaaugugauaacgccugcauuggguccauccgcaauggaacauacgaccacaacguauacagagacgaggcucuaaauaacagguuucagauaaaggguguggaacugaaaagcggcuauaaggauuggauccucuggauuucuuucgccaucucaugcuuucugcuuugugucgcacuguugggguucauuaugugggccugccagaaaggaaauauccgguguaacauaugcauuuga

SEQ ID NO: 135445 - RNA, 1701 nt, Artificial Sequence; identical to SEQ ID NO: 134457
  derived and/or modified sequence opt3 from hemagglutinin__InfluenzaA__ALE31927

SEQ ID NO: 135446 - RNA, 1701 nt, Artificial Sequence
  derived and/or modified sequence opt3 from hemagglutinin__InfluenzaA__ALE31928
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauagcaauuuuaaguauccagccuuaaacgugacgaugcccaacaaugagcaguucgacaagcuguacaucuggggcguccaccauccuggcacugauaaagaccagauuuuucuuuaugcucagucuuccgggcguaucaccgugucaacaaagagaagccaacaggccguaauaccaaacauuggaaguaggccccggauccgcgauauuccuucuagaaucuccaucuacuggacuauuguuaaaccaggugacauauugcugaucaauagcaccggcaaccuaauugcgccgaggggguacuucaagauccggucgggaaaaucuuccauaaugcgcucagacgcacccauuggcaaguguaagagugaaugcaucacaccuaaugguagcaucccaaacgauaaacccuuucagaaugugaaccgaauuaccuauggggccuguccuagauacgucaagcaguccacgcucaaacuggcuacuggaaugaggaaugugccagagaagcaaacacggggcaucuucggcgccauugcaggguuuauagaaaacggaugggaggguaugguggacggcugguauggguuccgucaccaaaauucugagggacgcggccaggcugccgaucuuaaaagcacccaggcggccaucgaccagauuaacgguaagcugaauagauugaucgggaaaacuaacgaaaaguuccaccagaucgagaaggaauuuucagaggucgaaggcaggauucaggaucucgagaaauacguugaggacacaaagauagaucuguggaguuauaaugcagaauuacugguggcucucgagaaccaacauaccaucgaccuuacggauuccgaaaugaacaaacuguucgagaagaccaaaaagcaguugcgggaaaaugccgaggacaugggaaacggcugcuuuaagauuuaccacaaaugugauaaugcuugcaucgggagcauucgaaacggaacauaugaccaugacguauaccgcgaugaggcccuaaauaacagauuccagaucaaggguguggaacugaaaucuggcuacaaggacuggauacucuggaucucauuugcaauuaguugcuuccugcuuugugucgcccuguugggguuuaucaugugggcuugccagaaaggaaauauuagguguaacaucugcauauga

SEQ ID NO: 135447 - RNA, 1701 nt, Artificial Sequence; identical to SEQ ID NO: 135093
  derived and/or modified sequence opt3 from hemagglutinin__InfluenzaA__ALE31930

SEQ ID NO: 135448 - RNA, 1701 nt, Artificial Sequence; identical to SEQ ID NO: 134457
  derived and/or modified sequence opt3 from hemagglutinin__InfluenzaA__ALE31931

SEQ ID NO: 135449 - RNA, 1701 nt, Artificial Sequence; identical to SEQ ID NO: 134457
  derived and/or modified sequence opt3 from hemagglutinin__InfluenzaA__ALE31932

SEQ ID NO: 135450 - RNA, 1701 nt, Artificial Sequence
  derived and/or modified sequence opt3 from hemagglutinin__InfluenzaA__ALE31933
augaagaccaucauugcccugagcuacauacucugccuuguguaugcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuccagaauaaaaagugggaucuuuuuguggagaggagcaaagccuacuccaacuguuaucccuacgacgucccugauuaugcaucucugcggucguugguggccucaagcggcacccucgaguucaauaacgaaaguuuuaauuggacugguguuacacaaaacgggaccuccucugcuugcauccgccgaagcuccucaaguuucuuuagccgucugaauuggcugacgcaucucaaguacacuuauccagcauuaaacgugaccaugcccaauaacgagcaguucgacaagcuguacauuuggggaguccaccauccuggcacagauaaagaccagaucuuucuuuacgcccagucuuccggcagaauaacugugucaaccaagaggagccaacaggcuguaauuccaaacaucgggagucggccccgcauuagagauaucccuucuaggaucuccauuuauuggacaauaguuaaaccaggagacaucuugcugauuaauagcaccgguaaccuaaucgccccgcggggcuacuucaagauacgcucggggaaaucuuccauuaugcgaucagacgcgcccaucggaaaguguaagagugaaugcaucacgccuaauggcagcauuccaaacgauaaacccuuucagaaugugaacagaaucacuuauggugcauguccuagguacgucaagcacuccacacucaaacuggccaccgggaugcggaaugugccagagaagcagacucguggaauuuucggcgcuauagccggcuuuaucgaaaacgggugggagggaaugguggacgguugguauggcuuccgccaccaaaauucugaggggagaggacaggcagcugaucuuaaaagcacacaggccgcgauugaccaaaucaacggcaagcugaauagguugaucgguaaaaccaacgaaaaguuucaucagauugagaaggaguucucagaagucgaagggcggauacaggaucucgagaaauacguugaggacacgaagaucgaucuguggaguuauaaugccgaauuacugguggcacucgagaaccagcacaccauugaccuuacagauuccgaaaugaauaaacuguucgagaagacuaaaaagcaauugcgagaaaacgcugaggacaugggcaacggaugcuuuaagaucuaccauaaaugugauaaugccugcauuggcagcauccgcaacgggaccuacgaccacaauguauauagagacgaggcucuaaacaauagguuccagauaaagggaguggaacugaaaucugguuacaaggauuggauccucuggauuucauuugccaucaguugcuuccugcuuugugucgcacuguugggcuuuauuaugugggccugccagaaagggaacauccgguguaauauaugcauuuga

SEQ ID NO: 135451 - RNA, 1701 nt, Artificial Sequence
  derived and/or modified sequence opt3 from hemagglutinin__InfluenzaA__ALE31934
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuauacuuaccaggcauuaaaugugaccaugccaaacaacgagcaguuugacaagcuguauauuuggggaguccaccaucccggcacagauaaagaccagaucuuccuuuacgcccguucuuccggcagaauaacugugucaaccaagaggagccaacaggcuguaauuccuaauaucgggagucggccacgcauuagagauauccccucuaggaucuccauuuacuggacaauaguuaaaccuggagacaucuugcugauuaacagcaccgguaaucuaaucgccccacggggcuauuuuaagauacgcucggggaaaucuuccauuaugcgaucagacgcgccgaucggaaaguguaagagugaaugcaucacgcccaacggcagcauuccuaaugauaaaccauuccagaacgugaauagaaucacuuacggugcaugucccagguaugucaagcacuccacacucaaacuggccaccgggaugcggaacauuccugagaagcagacucguggaauauuuggcgcuaucgccggcuucauugaaaaugggugggagggaaugguggacgguugguacggcuuucgccaccaaaacucugaggggagaggacaggcagcugaucuuaaaagcacacaggccgcgaucgaccaaaucaauggcaagcugaacagguugauugguaaaaccaaugaaaaguuccaucagauagagaaggaauuuucagagguggaagggcggauccaggaucucgagaaauaugucgaggacacgaagauugaucuguggaguuacaacgccgaauuacugguugcacucgagaaucagcacaccaucgaccuuacagauuccgaaaugaacaaacuguuugagaagacuaaaaagcaauugcgagaaaacgcugaggacaugggcaauggaugcuucaagauuuaucauaaaugugauaacgccugcaucggcagcauacgcaaugggaccuacgaccacaacguguacagagacgaggcucuaaauaacagguuucagaucaagggaguagaacugaaaucugguuauaaggauuggauucucuggaucucauucgccauuaguugcuuucugcuuuguguggcacuguugggcuucaucaugugggccugccagaaagggaauauacgguguaacauuugcaucuga

SEQ ID NO: 135452 - RNA, 1701 nt, Artificial Sequence; identical to SEQ ID NO: 134457
  derived and/or modified sequence opt3 from hemagglutinin__InfluenzaA__ALE31935

SEQ ID NO: 135453 - RNA, 1701 nt, Artificial Sequence; identical to SEQ ID NO: 135239
  derived and/or modified sequence opt3 from hemagglutinin__InfluenzaA__ALE31936

SEQ ID NO: 135454 - RNA, 1701 nt, Artificial Sequence
  derived and/or modified sequence opt3 from hemagglutinin__InfluenzaA__ALE31937
augaagaccaucauugcccugagcuacauacucugccuuguguucgcucagaaacugcccgagaacgacaauuccacagcaacuuuguguuuaggccaccaugccgucccuaacgggacgaucguuaagaccauuacaaaugauagaaucgaagugacuaacgcgaccgagcugguacaaaauucuucaauuggagaaaucugcgacaguccacaccagauacuagauggugagaacuguacacucaucgacgcucugcuuggcgauccgcagugcgacggguuucagaauaaaaagugggaucuguucguggaaaggagcaaagccuauuccaacuguuaccccuaugacgucccugauuacgcaucuuugcggucgcucguggccucaagcggaacccuggaguuuaauaacgagaguuucaauugggcuggcguuacucaaaacgguacauccucuagcugcauucgcggguccaauucaaguuucuuuagccgacugaacuggcucacccauuuaaauucuaaguauccagcacugaacgugacgaugcccaacaaugaacaguuugacaaacuuuacaucuggggaguccaccauccuggcacugauaaagaccagauuuucuuguaugcccagccauccggccguaucaccgugucaacaaagagaagccaacaggcuguaauacccaacauugggaguaggccucggauccgcgauauuccaucuagaaucuccaucuacuggacuauuguuaaaccgggagacauacugcuaaucaauagcaccgguaaccucauugcccccaggggcuacuuuaagauccggucggggaaaucuuccauaaugcgcucagacgcgccuauuggaaaguguaagagugagugcaucacaccaaauggcagcauccccaacgauaaaccuuuccagaaugugaaccgaauuaccuauggugcauguccaagauacgucaagcaguccacgcugaaacuugccacugggaugaggaaugugcccgaacggcaaacacguggaaucuuuggcgcuauugccggcuucauagagaacgggugggagggaaugguggacgguugguauggcuuucgccaccagaauagcgaagggagaggacaggcagcugaucugaagucuacccaagccgcgaucgaccagauuaacggcaaauugaauaggcucaucgguaagacuaacgagaaauuccaccagaucgaaaaggaguucucagaagucgaggggcggauucaggaucuggagaaguacguugaagacacaaaaauagauuuauggaguuauaaugccgagcugcucguggcacuugaaaaccaacauaccaucgaccugacggauuccgagaugaacaaguuguuugaaaagaccaagaaacagcuacgagagaaugcugaggacaugggcaacggaugcuucaagauuuaccacaagugugauaaugccugcaucggcagcauucgcaacgggacauaugaccaugacguauacagagaugaagcucugaauaacagguuucagaucaaaggaguggagcucaagucugguuacaaagacuggauacuguggaucucauucgccauuaguugcuuucuucugugugucgcauugcucggcuucaucaugugggccugccagaaggggaauauucgguguaacaucugcauauga

SEQ ID NO: 135455 - RNA, 1701 nt, Artificial Sequence; identical to SEQ ID NO: 134457
  derived and/or modified sequence opt3 from hemagglutinin__InfluenzaA__ALE31938

SEQ ID NO: 135456 - RNA, 1701 nt, Artificial Sequence; identical to SEQ ID NO: 135063
  derived and/or modified sequence opt3 from hemagglutinin__InfluenzaA__ALE31939

SEQ ID NO: 135457 - RNA, 1701 nt, Artificial Sequence; identical to SEQ ID NO: 134457
  derived and/or modified sequence opt3 from hemagglutinin__InfluenzaA__ALE31941

SEQ ID NO: 135458 - RNA, 1701 nt, Artificial Sequence; identical to SEQ ID NO: 135014
  derived and/or modified sequence opt3 from hemagglutinin__InfluenzaA__ALE31943

SEQ ID NO: 135459 - RNA, 1701 nt, Artificial Sequence
  derived and/or modified sequence opt3 from hemagglutinin__InfluenzaA__ALE31944
augaagaccaucauugcccugagcuacauacucugccuuguguucgcucagaaacugcccgagaacgacaauuccacagcaacuuuguguuuaggccaccaugccgucccuaacgggacgaucguuaagaccauuacaucugauagaaucgaagugacuaaugcgaccgagcugguacaaaacucaaguauuggagaaaucugcgacagcccacaccagauacuagaugguaaaaauuguacacucaucgacgcucugcuuggcgauccgcagugcgacggguuucagaacaagaaaugggaucuguucguggagagguccaaggccuauucuaauuguuaccccuaugacgucccugauuacgcaucguugcggucacucguggccagcaguggaacccuggaauuuaacgacgaguccuucaauugggcuggcguuacucaaaacgguacaucuagcgcaugcauucgcggguccaauucaaguuucuuuagccgacugaacuggcucacccauucuaauuuuaaguauccagccuuaaacgugacgaugcccaauaacgagcaguucgauaaacuguacaucuggggaguccaccauccuggcacugacaaggaucagauuuuucuuuaugcucaguccucaggccguaucaccgugagcacaaaaagaagucaacaggccguaauaccaaacauugggucuaggccccggauccgcgacauuccuuccagaaucagcaucuacuggacuauuguuaagccaggagacauauugcugaucaauucgaccgguaaccuaauugcgccgaggggcuacuucaaaauccggucugggaaguccucaauaaugcgcagugaugcacccauuggaaaguguaaaagcgaaugcaucacaccuaauggcuccaucccaaacgacaagcccuuucagaaugugaaccgaauuaccuauggugccuguccuagauacgucaaacagucuacgcucaagcuggcuacugggaugaggaaugugccagagaaacaaacacggggaaucuucggcgccauugcaggcuuuauagaaaacgggugggagggaaugaaggaugguugguauggcuuccgucaccagaauagcgaggggcgcggacaggcugccgaccuuaaaucaacccaagcggccaucgaucagauuaacggcaagcugaauagauugaucgguaagacuaacgaaaaauuccaccagaucgagaaggaauuuagugagguggaagggaggauucaggaccucgagaaauacgucgaggauacaaagauagaccugugguccuauaaugcagaauuacugguugcucucgagaaccaacauaccaucgaucuuacggacagcgaaaugaauaaacuguucgagaagaccaagaaacaguugcgggaaaacgccgaggauaugggcaacggaugcuuuaagauuuaccacaaaugugacaaugcuugcaucggcucuauucgaaacgggacauaugaccaugauguguaccgcgacgaggcccuaaauaacagauuccagaucaagggaguagaacugaaaucagguuacaaggauuggauacucuggaucaguuuugcaauuagcugcuuccugcuuuguguggcccuguugggcuuuaucaugugggcuugccagaaggggaauauuagguguaacaucugcauauga

SEQ ID NO: 135460 - RNA, 1701 nt, Artificial Sequence
  derived and/or modified sequence opt3 from hemagglutinin__InfluenzaA__ALE31945
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaagggagccaacaggcuguaauuccaaauguuggaaguaggccccggauccgcgauauuccuucuagaaucuccaucuacuggacaauugugaagccaggugacauauugcugaucaacagcaccggcaaucuaauugccccgaggggguauuuuaaaauccggucgggaaagucuuccauaaugcgcucagacgcgcccauuggcaaauguaagagugaaugcaucacgccuaacgguagcaucccaaaugauaagcccuuccagaacgucaaucgaauuacuuacggggcauguccuagauaugugaaacacuccacacucaagcuggccaccggaaugaggaacgugccagagaaacagacucggggcaucuuuggcgcuauugccggguucauagaaaauggaugggaggguauggucgacggcugguacggguuucgucaccaaaacucugagggacgcggccaggcagcugaucuuaagagcacacaggccgcgaucgaccaaauuaaugguaaacugaacagauugaucgggaagaccaaugaaaaauuccaucagaucgagaaggaauuuucagagguugaaggcaggauucaggauauagagaaguauguggaggacacgaaaaucgaucucuggaguuacaacgccgaacuguuaguagcacuggagaaucagcacaccauugaccucacagauuccgaaaugaacaaacuuuuugagaagacuaagaaacaacugcgggaaaacgcugaggacaugggaaauggcugcuucaagaucuaucauaagugugauaacgccugcauugggagcauccgaaauggaaccuacgaccacaacguguaccgcgacgaggcuuugaauaacagauuucagauaaaaggugucgaacuaaagucuggcuauaaagauuggauccuguggauuucauucgccaucaguugcuuucuccuguguguggcacuucugggguucauuaugugggccugccagaagggaaauaucagguguaacauaugcauuuga

SEQ ID NO: 135461 - RNA, 1701 nt, Artificial Sequence; identical to SEQ ID NO: 135115
  derived and/or modified sequence opt3 from hemagglutinin__InfluenzaA__ALE31946

SEQ ID NO: 135462 - RNA, 1701 nt, Artificial Sequence; identical to SEQ ID NO: 135115
  derived and/or modified sequence opt3 from hemagglutinin__InfluenzaA__ALE31947

SEQ ID NO: 135463 - RNA, 1701 nt, Artificial Sequence
  derived and/or modified sequence opt3 from hemagglutinin__InfluenzaA__ALE31948
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuauacuuacccagcauuaaaugugaccaugcccaacaacgagcaguuugacaagcuguauauuuggggaguccaccauccuggcacagauaaagaccagaucuuccuuuacgcccguucuuccggcagaauaacugugucaaccaagaggagccagcaagcuguaauuccaaauaucgggagucggccccgcauuagagauaucccuucuaggaucuccauuuacuggacaauaguuaaaccaggagacaucuugcugauuaacagcaccgguaaucuaaucgccccgcggggcuauuuuaagauacgcucggggaaaucuuccauuaugcgaucagacgcgcccaucggaaaguguaagagugaaugcaucacgccuaacggcagcauuccaaaugauaaacccuuccagaacgugaauagaaucacuuacggugcauguccuagguaugucaagcacuccacacucaaacuggccaccgggaugcggaacgugccagagaagcagacucguggaauuuuuggcgcuauagccggcuucaucgaaaaugggugggagggaaugguggacgguugguacggcuuucgccaccagaacucugaggggagaggacaagcagcugaucuuaaaagcacacaggccgcgauugaccagaucaauggcaagcugaacagguuggucgguaaaaccaaugaaaaguuccaucaaaucgagaaggaauuuucagagguugaagggcggauucaggaucucgagaaauauguggaggacacgaagauagaucuguggaguuacaacgccgaauuuuuaguagcacuggagaaucagcacaccaucgaccucacagauuccgaaaugaacaaacuuuucgagaagacuaaaaagcagcugcgagaaaacgcugaggacaugggcaauggaugcuuuaagauuuaucauaaaugugauaacgccugcaucggcagcauucgcaaugggaccuacgaccacaacguguacagagacgaggcuuugaauaacagguuccaaaucaagggagucgaacuaaaaucugguuauaaggauuggauacuguggaucucauuugccauuaguugcuuccuccuguguguggcacuucugggcuuuaucaugugggccugccagaaagggaauauucgguguaacaucugcauauga

SEQ ID NO: 135464 - RNA, 1701 nt, Artificial Sequence; identical to SEQ ID NO: 135115
  derived and/or modified sequence opt3 from hemagglutinin__InfluenzaA__ALE31949

SEQ ID NO: 135465 - RNA, 1701 nt, Artificial Sequence; identical to SEQ ID NO: 134457
  derived and/or modified sequence opt3 from hemagglutinin__InfluenzaA__ALE31950

SEQ ID NO: 135466 - RNA, 1701 nt, Artificial Sequence; identical to SEQ ID NO: 135001
  derived and/or modified sequence opt3 from hemagglutinin__InfluenzaA__ALE31951

SEQ ID NO: 135467 - RNA, 1701 nt, Artificial Sequence; identical to SEQ ID NO: 134457
  derived and/or modified sequence opt3 from hemagglutinin__InfluenzaA__ALE31952

SEQ ID NO: 135468 - RNA, 1701 nt, Artificial Sequence
  derived and/or modified sequence opt3 from hemagglutinin__InfluenzaA__ALE31953
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuuuagccgacugaauuggcugacgcaucucaacuauacuuacccagcauuaaaugugaccaugcccaacaacgagcaguuugacaagcuguauauuuggggaguccaccauccuggcacagauaaagaccagaucuuccuuuuugcccguucuuccggcagaauaacugugucaaccaagaggagccagcaagcuguaauuccaaauaucgggagucggccccgcauuagagauaucccuucuaggaucuccauuuacuggacaauaguuaaaccaggagacaucuugcugauuaacagcaccgguaaucuaaucgccccgcggggcuacuucaagauacgcucggggaaaucuuccauuaugcgaucagacgcgcccaucggaaaguguaagagugaaugcaucacgccuaacggcagcauuccaaaugauaaacccuuucagaacgugaauagaaucacuuauggugcauguccuagguacgucaagcacuccacacucaaacuggccaccgggaugcggaacgugccagagaagcagacucguggaauuuucggcgcuauagccggcuuuaucgaaaaugggugggagggaaugguggacgguugguauggcuuccgccaccagaacucugaggggagaggacaagcagcugaucuuaaaagcacacaggccgcgauugaccagaucaauggcaagcugaacagguugaucgguaaaaccaaugaaaaguuccaucaaauugagaaggaauuuucagaggucgaagggcggauacaggaucucgagaaauacguugaggacacgaagaucgaucuguggaguuauaacgccgaauuacugguggcacucgagaaucagcacaccauugaccuuacagauuccgaaaugaacaaacuguucgagaagacuaaaaagcaguugcgagaaaacgcugaggacaugggcaauggaugcuuuaagaucuaccauaaaugugauaacgccugcauuggcagcauccgcaaugggaccuaugaccacaacguauacagagacgaggcucuaaauaacagguuccaaauaaagggaguggaacugaaaucugguuacaaggauuggauccucuggauuucauuugccaucaguugcuuccugcuuugugucgcacuguugggcuuuauuaugugggccugccagaaagggaauauccgguguaacauaugcauuuga

SEQ ID NO: 135469 - RNA, 1701 nt, Artificial Sequence
  derived and/or modified sequence opt3 from hemagglutinin__InfluenzaA__ALE31954
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcaaaaacuguacacucaucgacgcucugcuuggggauccgcagugcgacggauuucagaauaagaggugggaucuguucguggaacggagcaaagccuauuccaacuguuaccccuaugacgucccugauuacgcaucuuugcgcucgcucguggccucaagcggcacccuggaguuuaaugacgaaaguuucaacugggcugguguuacucaaaaugggacauccucugcaugcauucgaggaagcaacuccucauuuuucagucgucugaauuggcucacccauagcaacuuuaaguauccagccuuaaaugugacgaugcccaacaacgagcaguucgauaagcuguacaucuggggcguccaccauccuggcacugacaaagaucagauuuuucuuuaugcucacucuuccgggagaaucaccgugucaacaaagaggagccagcaagccguaauaccaaauguuggaagucggccccgcauuagaaacaucccuucuaggauuuccaucuacuggacuaucgugaaaccaggugacauuuugcugauaaauagcaccggcaaccuaaucgcgccgcggggguacuucaagauucagucgggaaaaucuuccaucaugcgcucagacgcacccauaggcaaguguaagagugagugcauuacaccuaaugguagcaucccaaacgauaaacccuuucagaaugucaaccgaaucaccuauggggccuguccuagauacgugaagcaguccacgcucaaacuggcuacuggaaugaggaaugugccagaaaagcaaacacggggcauuuucggcgccaucgcaggguuuauugagaacggaugggaagguaugaaagacggcugguauggguuccgucaccaaaauucugagggacgcggccaggcugccgaucuuaagagcacccaggcggccauagaccagaucaacgguaaacugaauagauuggucgggaagacuaacgagaaguuccaucagauugaaaaagaguuuucagaaguugagggcaggauccaggaucucgaaaaguacguggaggacacaaaaaucgaucuguggaguuauaaugcagaguuacugguagcucucgaaaaccaacacaccauugaccuuacggauuccgagaugaacaagcuguucgagaaaaccaagaagcaguugcgggaaaaugccgaagacaugggaaacggcugcuuuaaaauauaccauaagugugauaaugcuugcaucgggagcauucgaaacggaacauaugaccacuacguguaccgcgacgaggcccuaaauaacagauuccagaucaaaggugucgagcugaagucuggcuauaaagauuggauucucuggaucucauuugcaauaaguugcuuccugcuuuguguggcccuguugggguuuaucaugugggcuugccagaagggaaauauuagguguaacaucugcauuuga

SEQ ID NO: 135470 - RNA, 1701 nt, Artificial Sequence; identical to SEQ ID NO: 134457
  derived and/or modified sequence opt3 from hemagglutinin__InfluenzaA__ALE31955

SEQ ID NO: 135471 - RNA, 1701 nt, Artificial Sequence
  derived and/or modified sequence opt3 from hemagglutinin__InfluenzaA__ALE31956
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcaacaguccacaccagauccuggacggcgaaaauuguacacuaauugaugcucuccugggggacccgcagugcgauggauuucagaacaaaaagugggaccuuuucguggagaggagcaaagccuauuccaauuguuaccccuaugaugucccugacuacgcaucucugcggucguugguggccucaagcggcacccucgaauuuaacaaugagaguuucaacuggacugguguuacacaaaaugggaccuccucugcuugcauccgccgaagcuccucaaguuucuucagccgucugaacuggcugacgcaucucaauuauacuuacccagcauuaaacgugaccaugcccaacaaugagcaguuugauaagcuguauauuuggggaguccaccauccuggcacagacaaggaucagaucuuccuuuacgcccagucuuccggcagaauaacugugucaaccaaaaggagccaacaggcuguaauuccaaacaucgggagucggccccgcauuagagacaucccuucuaggaucuccauuuacuggacaauaguuaagccaggagauaucuugcugauuaauagcaccgguaaccuaaucgccccgcggggcuauuuuaaaauacgcucggggaagucuuccauuaugcgaucagacgcgcccaucggaaaauguaagagugaaugcaucacgccuaauggcagcauuccaaacgacaagcccuuccagaaugugaacagaaucacuuacggugcauguccuagguaugucaaacacuccacacucaagcuggccaccgggaugcggaaugugccagagaaacagacucguggaauuuuuggcgcuauagccggcuucaucgaaaacgggugggagggaaugguggaugguugguacggcuuucgccaccaaaauucugaggggagaggacaggcagcugaccuuaagagcacacaggccgcgauugaucaaaucaacggcaaacugaauagguugaucgguaagaccaacgaaaaauuccaucagauugagaaggaauuuucagaggucgaagggcggauacaggaccucgagaaguauguugaggauacgaaaaucgaccuguggaguuacaaugccgaauuacugguggcacucgagaaccagcacaccauugaucuuacagacuccgaaaugaacaagcuguuugagaaaacuaagaaacaauugcgagaaaaugcugaggauaugggcaacggaugcuucaagaucuaucauaagugugacaaugccugcauuggcagcauccgcaacgggaccuacgaucacaauguauacagagacgaggcucuaaacaauagguuucagauaaaaggaguggaacugaagucugguuauaaagacuggauccucuggauuucauucgccaucaguugcuuucugcuuugugucgcacuguugggcuucauuaugugggccugccagaaggggaacauccgguguaauauaugcauuuga

SEQ ID NO: 135472 - RNA, 1701 nt, Artificial Sequence; identical to SEQ ID NO: 135063
  derived and/or modified sequence opt3 from hemagglutinin__InfluenzaA__ALE31957

SEQ ID NO: 135473 - RNA, 1701 nt, Artificial Sequence
  derived and/or modified sequence opt3 from hemagglutinin__InfluenzaA__ALE31958
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggaguaagccccggauucgcgauaucccuucuagaaucuccauuuacuggacaauaguuaaaccaggagacaucuugcugauuaacagcaccgguaaucuaaucgccccgaggggcuauuuuaagauacggucggggaaaucuuccauuaugcgcucagacgcgcccaucggaaaguguaagagugaaugcaucacgccuaacggcagcauuccaaaugauaaacccuuccagaacgugaaucgaaucacuuacggugcauguccuagauaugucaagcacuccacacucaaacuggccaccgggaugaggaacgugccagagaagcagacucggggaauuuuuggcgcuauagccggcuucaucgaaaaugggugggagggaaugguggacgguugguacggcuuucgucaccaaaacucugaggggcgcggacaggcagcugaucuuaaaagcacacaggccgcgauugaccaaaucaauggcaagcugaacagauugaucgguaaaaccaaugaaaaguuccaucagauugagaaggaauuuucagaggucgaagggaggauacaggaucucgagaaauauguugaggacacgaagaucgaucuguggaguuacaacgccgaauuacugguggcacucgagaaucagcacaccauugaccuuacagauuccgaaaugaacaaacuguuugagaagacuaaaaagcaauugcgggaaaacgcugaggacaugggcaauggaugcuucaagaucuaucauaaaugugauaacgccugcauuggcagcauccgaaaugggaccuacgaccacaacguauaccgcgacgaggcucuaaauaacagauuucagauaaagggaguggaacugaaaucugguuauaaggauuggauccucuggauuucauucgccaucaguugcuuucugcuuugugucgcacuguugggcuucauuaugugggccugccagaaagggaauaucagguguaacauaugcauuuga

SEQ ID NO: 135474 - RNA, 1701 nt, Artificial Sequence
  derived and/or modified sequence opt3 from hemagglutinin__InfluenzaA__ALE31959
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuaugcauacccagccuuaaaugugacuaugcccaacaacgagcaguuugacaagcuguauauuuggggaguccaccauccuggcaccgauaaagaccagaucuuccuuuacgcucguucuuccggcagaauaacagugucaacuaagaggagccagcaagccguaauuccaaauaucgggagucggccccgcauuagagauaucccuucuaggaucuccauuuacuggaccauaguuaaaccaggagacaucuugcugauuaacagcacagguaaucuaaucgcgccgcggggcuauuuuaagauacgcucggggaaaucuuccauuaugcgaucagacgcacccaucggaaaguguaagagugaaugcaucaccccuaacggcagcauuccaaaugauaaacccuuccagaacgugaauagaaucacguacggugccuguccuagguaugucaagcacuccacucucaaacuggcuacagggaugcggaacgugccagagaagcagacccguggaauuuuuggcgccauagcaggcuucaucgaaaaugggugggagggaaugguggacgguugguacggcuuucgccaccagaacucugaggggagaggacaagcugccgaucuuaaaagcacucaggcggccauugaccagaucaauggcaagcugaacagguugaucgguaaaacaaaugaaaaguuccaucaaauugagaaggaauuuucagaggucgaagggcggauacaggaucucgagaaauauguugaggacaccaagaucgaucuguggaguuacaacgcagaauuacugguggcucucgagaaucagcacacgauugaccuuaccgauuccgaaaugaacaaacuguuugagaagacuaaaaagcaguugcgagaaaacgccgaggacaugggcaauggaugcuucaagaucuaucauaaaugugauaacgcuugcauuggcagcauccgcaaugggacauacgaccacaacguauacagagacgaggcccuaaauaacagguuucaaauaaagggaguggaacugaaaucugguuauaaggauuggauccucuggauuucauucgcaaucaguugcuuucugcuuugugucgcccuguugggcuucauuaugugggcuugccagaaagggaauauccgguguaacauaugcauuuga

SEQ ID NO: 135475 - RNA, 1701 nt, Artificial Sequence; identical to SEQ ID NO: 134457
  derived and/or modified sequence opt3 from hemagglutinin__InfluenzaA__ALE31960

SEQ ID NO: 135476 - RNA, 1701 nt, Artificial Sequence; identical to SEQ ID NO: 134646
  derived and/or modified sequence opt3 from hemagglutinin__InfluenzaA__ALE31961

SEQ ID NO: 135477 - RNA, 1701 nt, Artificial Sequence
  derived and/or modified sequence opt3 from hemagglutinin__InfluenzaA__ALE31962
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggauguccaucuacuggacaauuguuaagccaggagacauauugcugaucaacagcaccgguaaucuaauugccccgcggggcuauuuuaaaauccgcucggggaagucuuccauaaugcgaucagacgcgcccauuggaaaauguaagagugaaugcaucacgccuaacggcagcaucccaaaugauaagcccuuccagaacgugaauagaauuacuuacggugcauguccuagguaugucaaacacuccacacucaagcuggccaccgggaugcggaacgugccagagaaacagacucguggaaucuuuggcgcuauugccggcuucauagaaaaugggugggagggaaugguggacgguugguacggcuuucgccaccaaaacucugaggggagaggacaggcagcugaucuuaagagcacacaggccgcgaucgaccaaauuaauggcaaacugaacagguugaucgguaagaccaaugaaaaauuccaucagaucgagaaggaauuuucagaggucgaagggcggauucaggaucucgagaaguauguugaggacacgaaaauagaucuguggaguuacaacgccgaauuacugguggcacucgagaaucagcacaccaucgaccuuacagauuccgaaaugaacaagcuguuugagaaaacuaagaaacaauugcgagaaaacgcugaggacaugggcaauggaugcuucaagauuuaucauaagugugauaacgccugcaucggcagcauucgcaaugggaccuacgaccacaacguauacagagacgaggcucuaaauaacagguuucagaucaaaggaguggaacugaagucugguuauaaagauuggauacucuggaucucauucgccauuaguugcuuucugcuuugugucgcacuguugggcuucaucaugugggccugccagaaggggaauauucgguguaacaucugcauauga

SEQ ID NO: 135478 - RNA, 1701 nt, Artificial Sequence
  derived and/or modified sequence opt3 from hemagglutinin__InfluenzaA__ALE31963
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagacuuuccuuuacgcccagucuuccggcagaaucaccgugucaacaaaaaggagccaacaggcuguaauaccaaauauugggagucggccccgcaucagagauauuccuucuaggaucuccaucuacuggaccauuguuaagccaggagacauauugcugaucaacagcacggguaaucuaauugccccgcggggcuauuuuaaaauccgcucggggaagucuuccauaaugcgaucagacgcgcccauuggaaaauguaagagugaaugcaucacuccuaacggcagcaucccaaaugauaagcccuuccagaacgugaauagaauuacauacggugcauguccuagguaugucaaacacuccacccucaagcuggccacugggaugcggaacgugccagagaaacagacacguggaaucuuuggcgcuauugccggcuucauagaaaaugggugggagggaaugguggacgguugguacggcuuucgccaccaaaacucugaggggagaggacaggcagcugaucuuaagagcacccaggccgcgaucgaccaaauuaauggcaaacugaacagguugaucgguaagacgaaugaaaaauuccaucagaucgagaaggaauuuucagaggucgaagggcggauucaggaucucgagaaguauguugaggacaccaaaauagaucuguggaguuacaacgccgaauuacugguggcacucgagaaucagcacacaaucgaccuuacugauuccgaaaugaacaagcuguuugagaaaaccaagaaacaauugcgagaaaacgcugaggacaugggcaauggaugcuucaagauuuaucauaagugugauaacgccugcaucggcagcauucgcaaugggacauacaaccacaauguauacagagacgaggcucuaaacaauagguuucagaucaaaggaguggaacugaagucugguuauaaagacuggauacucuggaucucauucgccauuaguugcuuucugcuuugugucgcacuguugggcuucaucaugugggccugccagaaggggaacauucgguguaauaucugcauauga

SEQ ID NO: 135479 - RNA, 1701 nt, Artificial Sequence
  derived and/or modified sequence opt3 from hemagglutinin__InfluenzaA__ALE31964
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuauuacgucccugacuaugcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuacacuuauccagcauuaaaugugaccaugcccaacaacgagcaguuugauaagcuguacauuuggggaguccaccauccuggcacagacaaggaucagaucuuccuuuacgcccagucuuccggcagaauaacugugucaaccaaaaggagccaacaggcuguaauuccaaauaucgggagucggccccgcauuagagacaucccuucuaggaucuccauuuauuggacaauaguuaagccaggagauaucuugcugauuaacagcaccgguaaucuaaucgccccgcggggcuacuuuaaaauacagucggggaagucuuccauuaugcgcucagacgcgcccaucggaaaauguaagagugaaugcaucacgccuaacggcagcauuccaaaugacaagcccuuccagaacgugaaucgaaucacuuauggugcauguccuagauacgucaaacacuccacacucaagcuggccaccgggaugaggaacgugccagagaaacaaacucggggaauuuuuggcgcuauagccggcuucaucgaaaaugggugggagggaaugguggaugguugguauggcuuucgucaccagaacucugaggggcgcggacaggcagcugaccuuaagagcacacaagccgcgauugaucagaucaauggcaaacugaacagauugaucgguaagaccaaugaaaaauuccaucagauugagaaggaauuuucagaggucgaagggaggauacaggaccucgagaaguacguugaggauacgaaaaucgaccuguggaguuauaacgccgaauuacugguggcacucgagaaucaacacaccauugaucuuacagacuccgaaaugaacaagcuguuugagaaaacuaagaaacaguugcgggaaaacgcugaggauaugggcaauggaugcuucaagaucuaccauaagugugacaacgccugcauuggcagcauccgaaaugggaccuacgaucacaacguauaucgcgacgaggcucuaaauaacagauuucagauaaaaggaguggaacugaagucugguuacaaagacuggauccucuggauuucauucgccaucaguugcuuucugcuuugugucgcacuguugggcuucauuaugugggccugccagaaggggaauaucagguguaacauaugcauuuga

SEQ ID NO: 135480 - RNA, 1701 nt, Artificial Sequence; identical to SEQ ID NO: 134457
  derived and/or modified sequence opt3 from hemagglutinin__InfluenzaA__ALE31965

SEQ ID NO: 135481 - RNA, 1701 nt, Artificial Sequence; identical to SEQ ID NO: 135115
  derived and/or modified sequence opt3 from hemagglutinin__InfluenzaA__ALE31966

SEQ ID NO: 135482 - RNA, 1701 nt, Artificial Sequence; identical to SEQ ID NO: 135385
  derived and/or modified sequence opt3 from hemagglutinin__InfluenzaA__ALE31967

SEQ ID NO: 135483 - RNA, 1701 nt, Artificial Sequence; identical to SEQ ID NO: 135001
  derived and/or modified sequence opt3 from hemagglutinin__InfluenzaA__ALE31968

SEQ ID NO: 135484 - RNA, 1701 nt, Artificial Sequence; identical to SEQ ID NO: 135108
  derived and/or modified sequence opt3 from hemagglutinin__InfluenzaA__ALE31969

SEQ ID NO: 135485 - RNA, 1701 nt, Artificial Sequence; identical to SEQ ID NO: 134457
  derived and/or modified sequence opt3 from hemagglutinin__InfluenzaA__ALE31970

SEQ ID NO: 135486 - RNA, 1701 nt, Artificial Sequence
  derived and/or modified sequence opt3 from hemagglutinin__InfluenzaA__ALE31971
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuaugcauacccagccuuaaaugugacuaugcccaacaacgagcaguuugacaagcuguauauuuggggaguccaccauccuggcaccgauaaggaccagaucuuccuuuacgcucagucuuccggcagaauaacagugucaacuaaagggagccaacaggccguaauuccaaauaucggaaguaggccccggauucgcgauaucccuucuagaaucuccauuuacuggaccauaguuaagccaggugacaucuugcugauuaacagcacaggcaaucuaaucgcgccgaggggguauuuuaaaauacggucgggaaagucuuccauuaugcgcucagacgcacccaucggcaaauguaagagugaaugcaucaccccuaacgguagcauuccaaaugauaagcccuuccagaacgugaaucgaaucacguacggggccuguccuagauaugucaaacacuccacucucaagcuggcuacaggaaugaggaacgugccagagaaacagacccggggcauuuuuggcgccauagcaggguucaucgaaaauggaugggaggguaugguggacggcugguacggguuucgucaccaaaacucugagggacgcggccaggcugccgaucuuaagagcacucaggcggccauugaccaaaucaaugguaaacugaacagauugaucgggaagacaaaugaaaaauuccaucagauugagaaggaauuuucagaggucgaaggcaggauacaggaucucgagaaguauguugaggacaccaaaaucgaucuguggaguuacaacgcagaauuacugguggcucucgagaaucagcacacgauugaccuuaccgauuccgaaaugaacaagcuguuugagaaaacaaagaaacaauugcgggaaaacgccgaggacaugggaaauggcugcuucaagaucuaucauaagugugauaacgcuugcauugggagcauccgaaauggaacuuacgaccacaacguauaccgcgacgaggcccuaaauaacagauuucagauaaaagguguggaacugaagucuggcuauaaagauuggauccucuggauuucauucgcaaucaguugcuuucugcuuugugucgcccuguugggguucauuaugugggcuugccagaagggaaauaucagguguaacauaugcauuuga

SEQ ID NO: 135487 - RNA, 1701 nt, Artificial Sequence; identical to SEQ ID NO: 135001
  derived and/or modified sequence opt3 from hemagglutinin__InfluenzaA__ALE31972

SEQ ID NO: 135488 - RNA, 1701 nt, Artificial Sequence; identical to SEQ ID NO: 135001
  derived and/or modified sequence opt3 from hemagglutinin__InfluenzaA__ALE31973

SEQ ID NO: 135489 - RNA, 1701 nt, Artificial Sequence; identical to SEQ ID NO: 134646
  derived and/or modified sequence opt3 from hemagglutinin__InfluenzaA__ALE31974

SEQ ID NO: 135490 - RNA, 1701 nt, Artificial Sequence; identical to SEQ ID NO: 135001
  derived and/or modified sequence opt3 from hemagglutinin__InfluenzaA__ALE31975

SEQ ID NO: 135491 - RNA, 1701 nt, Artificial Sequence; identical to SEQ ID NO: 134457
  derived and/or modified sequence opt3 from hemagglutinin__InfluenzaA__ALE31976

SEQ ID NO: 135492 - RNA, 1701 nt, Artificial Sequence; identical to SEQ ID NO: 134457
  derived and/or modified sequence opt3 from hemagglutinin__InfluenzaA__ALE31977

SEQ ID NO: 135493 - RNA, 1701 nt, Artificial Sequence
  derived and/or modified sequence opt3 from hemagglutinin__InfluenzaA__ALE31978
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuauacuuacccagcauuaaaugugaccaugcccaacaacgagcaguuugacaagcuguauauuuggggaguccaccauccuggcacagauaaagaccagaucuuccuuuacgcccguucuuccggcagaauaacugugucaaccaagaggagccagcaagcuguaauuccaaauaucgggagucggccccgcauuagagauaucccuucuaggaucuccauuuacuggacaauaguuaaaccaggagacaucuugcugauucacagcaccgguaaccuaaucgccccgcggggcuauuuuaagauacgcucggggaaaucuuccauuaugcgaucagacgcgcccaucggaaaguguaagagugaaugcaucacgccuaauggcagcauuccaaacgauaaacccuuccagaaugugaacagaaucacuuacggugcauguccuagguaugucaagcacuccacacucaaacuggccaccgggaugcggaaugugccagagaagcagacucguggaauuuuuggcgcuauagccggcuucaucgaaaacgggugggagggaaugguggacgguugguacggcuuucgccaucaaaauucugaggggagaggacaggcagcugaucuuaaaagcacacaggccgcgauugaccagaucaacggcaagcugaauagguugaucgguaaaaccaacgaaaaguuccaccaaauugagaaggaauuuucagaggucgaagggcggauacaggaucucgagaaauauguugaggacacgaagaucgaucuguggaguuacaaugccgaauuacugguggcacucgagaaccagcauaccauugaccuuacagauuccgaaaugaauaaacuguuugagaagacuaaaaagcaguugcgagaaaacgcugaggacaugggcaacggaugcuucaagaucuaucacaaaugugauaaugccugcauuggcagcauccgcaacgggaccuacgaccacaauguauacagagacgaggcucuaaacaauagguuucaaauaaagggaguggaacugaaaucugguuauaaggauuggauccucuggauuucauucgccaucaguugcuuucugcuuugugucgcacuguugggcuucauuaugugggccugccagaaagggaacauccgguguaauauaugcauuuga

SEQ ID NO: 135494 - RNA, 1701 nt, Artificial Sequence; identical to SEQ ID NO: 134457
  derived and/or modified sequence opt3 from hemagglutinin__InfluenzaA__ALE31979

SEQ ID NO: 135495 - RNA, 1701 nt, Artificial Sequence
  derived and/or modified sequence opt3 from hemagglutinin__InfluenzaA__ALE31980
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacucaagcuggccaccgggaugcggaacgugccagagaaacagacucguggaauuuuuggcgcuauagccggcuucaucgaaaaugggugggagggaaugguggacgguugguacggcuuucgccaccaaaacucugaggggagaggacaggcagcugaucuuaagagcacacaggccgcgauugaccaaaucaauggcaaacugaacagguugaucgguaagaccaaugaaaaauuccaucagauugagaaggaauuuucagaggucgaagggcggauacaggaucucgagaaguauguugaggacacgaaaaucgaucuguggaguuacaacgccgaauuacugguggcacucgagaaucagcacaccauugaccuuacagauuccgaaaugaacaagcuguuugagaaaacuaagaaacaauugcgagaaaacgcugaggacaugggcaauggaugcuucaagaucuaucauaagugugauaacgccugcauuggcagcauccgcaaugggaccuacgaccacaacguauacagagacgaggcucuaaauaacagguuucagauaaaaggaguggaacugaagucugaguauaaagauuggauccucuggauuucauucgccaucaguugcuuucugcuuugugucgcacuguuggguuucauuaugugggccugccagaagggcaauauccgguguaacauaugcauuuga

SEQ ID NO: 135496 - RNA, 1701 nt, Artificial Sequence; identical to SEQ ID NO: 134457
  derived and/or modified sequence opt3 from hemagglutinin__InfluenzaA__ALE31981

SEQ ID NO: 135497 - RNA, 1701 nt, Artificial Sequence; identical to SEQ ID NO: 134997
  derived and/or modified sequence opt3 from hemagglutinin__InfluenzaA__ALE31995

SEQ ID NO: 135498 - RNA, 1701 nt, Artificial Sequence
  derived and/or modified sequence opt3 from hemagglutinin__InfluenzaA__ALE31996
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagagucacuuacggugcauguccuagguaugugaaacacuccacacucaagcuggccaccgggaugcggaacgugccagagaaacagacucguggaaucuuuggcgcuauugccggcuucauagaaaaugggugggagggaauggucgacgguugguacggcuuucgccaccaaaacucugaggggagaggacaggcagcugaucuuaagagcacacaggccgcgaucgaccaaauuaauggcaaacugaacagguugaucgguaagaccaaugaaaaauuccaucagaucgagaaggaauuuucagagguugaagggcggauucaggaucucgagaaguauguggaggacacgaaaauagaucuguggaguuacaacgccgaauuacugguagcacucgagaaucagcacaccaucgaccuuacagauuccgaaaugaacaagcuguuugagaaaacuaagaaacaauugcgagaaaacgcugaggacaugggcaauggaugcuucaagauuuaucauaagugugauaacgccugcaucggcagcauucgcaaugggaccuacgaccacaacguguacagagacgaggcucuaaauaacagguuucagaucaaaggagucgaacugaagucugguuauaaagauuggauacucuggaucucauucgccauuaguugcuuucugcuuuguguggcacuguugggcuucaucaugugggccugccagaaggggaauauucgguguaacaucugcauauga

SEQ ID NO: 135499 - RNA, 1701 nt, Artificial Sequence
  derived and/or modified sequence opt3 from hemagglutinin__InfluenzaA__ALE31997
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucaucgagaggagcaaagccuauuccaacuguuaccccuaugacgugccugauuacgcaucucugcggucguuggucgccucaagcggcacccucgaauuuaauaacgagaguuucaauuggacuggugugacacaaaacgggaccuccucugcuugcauucgccgaagcuccucaaguuucuucagccgucugaauuggcugacgcaucucaacuauacuuacccagcauuaaauguuaccaugcccaacaacgagcaguuugacaagcuguauaucuggggagugcaccauccuggcacagauaaggaccagauauuccuuuacgcccagucuuccggcagaauuacugucucaaccaaaaggagccaacaggcugugaucccaaauauugggagucggccccgcaucagagauaucccuucuaggauuuccauauacuggacaaucguaaagccaggagacauuuugcugaucaacagcaccgguaaucuaauagccccgcggggcuauuuuaaaauucgcucggggaagucuuccaucaugcgaucagacgcgcccaucggaaaauguaagagugaaugcauuacgccuaacggcagcaucccaaaugauaagcccuuccagaacguuaauagaauuacuuacggugcauguccuagguaugugaaacacuccacacucaagcuggccaccgggaugcggaacgucccagagaaacagacucguggaauauuuggcgcuaucgccggcuucauugaaaaugggugggagggaaugguggacgguugguacggcuuucgccaccaaaacucugaggggagaggacaggcagcugaucuuaagagcacacaggccgcgaucgaccaaaucaauggcaaacugaacagguugauugguaagaccaaugaaaaauuccaucagauagagaaggaauuuucagagguggaagggcggauccaggaucucgagaaguaugucgaggacacgaaaauugaucuguggaguuacaacgccgaauuacugguugcacucgagaaucagcacaccaucgaccuuacagauuccgaaaugaacaagcuguuugagaaaacuaagaaacaauugcgagaaaacgcugaggacaugggcaauggaugcuucaagauuuaucauaagugugauaacgccugcaucggcagcauacgcaaugggaccuacgaccacaacguguacagagacgaggcucuaaauaacagguuucagaucaaaggaguagaacugaagucugguuauaaagauuggauucucuggaucucauucgccauuaguugcuuucugcuuuguguggcacuguugggcuucaucaugugggccugccagaaggggaauauacgguguaacauuugcaucuga

SEQ ID NO: 135500 - RNA, 1701 nt, Artificial Sequence; identical to SEQ ID NO: 134457
  derived and/or modified sequence opt3 from hemagglutinin__InfluenzaA__ALE31998

SEQ ID NO: 135501 - RNA, 1701 nt, Artificial Sequence
  derived and/or modified sequence opt3 from hemagglutinin__InfluenzaA__ALE31999
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucuccacuauacuuacccagcauuaaacgugaccaugcccaauaacgagcaguuugacaagcuguauauuuggggaguccaucacccuggcacagauaaggaccagaucuuccuuuacgcccagucuuccggcagaauaacugugucaaccaaaaggagccaacaggcuguaauuccaaacaucgggagucggccccgcauuagagauaucccuucuaggaucuccauuuacuggacaauaguuaagccaggagacaucuugcugauuaauagcaccgguaaccuaaucgccccgcggggcuauuuuaaaauacgcucggggaagucuuccauuaugcgaucagacgcgcccaucggaaaauguaagagugaaugcaucacgccuaauggcagcauuccaaacgauaagcccuuccagaaugugaacagaaucacuuacggugcauguccuagguaugucaaacacuccacacucaagcuggccaccgggaugcggaaugugccagagaaacagacucguggaauuuuuggcgcuauagccggcuucaucgaaaacgggugggagggaaugguggacgguugguacggcuuucgccaucaaaauucugaggggagaggacaggcagcugaucuuaagagcacacaggccgcgauugaccaaaucaacggcaaacugaauagguugaucgguaagaccaacgaaaaauuccaccagauugagaaggaauuuucagaggucgaagggcggauacaggaucucgagaaguauguugaggacacgaaaaucgaucuguggaguuacaaugccgaauuacugguggcacucgagaaccagcauaccauugaccuuacagauuccgaaaugaauaagcuguuugagaaaacuaagaaacaauugcgagaaaacgcugaggacaugggcaacggaugcuucaagaucuaucacaagugugauaaugccugcauuggcagcauccgcaacgggaccuacgaccacaauguauacagagacgaggcucuaaacaauagguuucagauaaaaggaguggaacugaagucugguuauaaagauuggauccucuggauuucauucgccaucaguugcuuucugcuuugugucgcacuguugggcuucauuaugugggccugccagaaggggaacauccgguguaauauaugcauuuga

SEQ ID NO: 135502 - RNA, 1701 nt, Artificial Sequence
  derived and/or modified sequence opt3 from hemagglutinin__InfluenzaA__ALE32000
augaagaccaucauugcccugagccacauacucugccuuguguucgcucagaaacugcccgagaacgacaauuccacagcaacuuuguguuuaggccaucacgccgucccuaacgggacgaucguuaagaccauuacaucugauagaaucgaagugacuaaugcgaccgagcugguacaaaacucaaguauuggagaaaucugcgacagcccacaucagauacuagaugguaaaaauuguacacucaucgacgcucugcuuggcgauccgcagugcgacggguuucagaacaagaaaugggaucuguucguggagagguccaaggccuacucuaauuguuaucccuacgacgucccugauuaugcaucguugcggucacucguggccagcaguggaacccuggaauuuaacgacgaguccuucaauugggcuggcguuacucaaaacgguacaucuagcgcaugcauucgcggguccaauucaaguuucuuuagccgacugaacuggcucacccacucuaauuuuaaguacccagccuuaaacgugacgaugcccaauaacgagcaguucgauaaacuguauaucuggggaguccaucacccuggcacugacaaggaucagauuuuucuuuacgcucaguccucaggccguaucaccgugagcacaaaaagaagucaacaggccguaauaccaaacauugggucuaggccccggauccgcaauauuccuuccagaaucagcaucuauuggacuauuguuaagccaggagacauauugcugaucaacucgaccgguaaucuaauugcgccgaggggcuacuucaaaauccggucugggaaguccucaauaaugcgcagugacgcacccauuggaaaguguaaaagcgaaugcaucacaccuaacggcuccaucccaaaugauaagcccuuucagaacgugaaucgaauuaccuacggugccuguccuagauaugucaaacagucuacgcucaagcuggcuacugggaugaggaacgugccagagaaacaaacacggggaaucuucggcgccauugcaggcuuuauagaaaaugggugggagggaaugaaggacgguugguacggcuuccgucaccagaacagcgaggggcgcggacaggcugccgaucuuaaaucaacccaagcggccaucgaccagauuaauggcaagcugaacagauugaucgguaagacuaaugaaaaauuccaucagaucgagaaggaauuuagugagguggaagggaggauucaggaucucgagaaauaugucgaggacacaaagauagaucugugguccuacaacgcagaauuacugguugcucucgagaaucaacacaccaucgaccuuacggauagcgaaaugaacaaacuguucgagaagaccaagaaacaguugcgggaaaacgccgaggacaugggcaauggaugcuuuaagauuuaucauaaaugugauaacgcuugcaucggcucuauucgaaaugggacauacgaccacgacguguaucgcgaugaggcccuaaacaauagauuccagaucaagggaguagaacugaaaucagguuacaaggacuggauacucuggaucaguuuugcaauuagcugcuuccugcuuuguguggcccuguugggcuuuaucaugugggcuugccagaaggggaacauuagguguaauaucugcauauga

SEQ ID NO: 135503 - RNA, 1701 nt, Artificial Sequence; identical to SEQ ID NO: 134457
  derived and/or modified sequence opt3 from hemagglutinin__InfluenzaA__ALE32001

SEQ ID NO: 135504 - RNA, 1701 nt, Artificial Sequence; identical to SEQ ID NO: 134457
  derived and/or modified sequence opt3 from hemagglutinin__InfluenzaA__ALE32002

SEQ ID NO: 135505 - RNA, 1701 nt, Artificial Sequence; identical to SEQ ID NO: 134557
  derived and/or modified sequence opt3 from hemagglutinin__InfluenzaA__ALE32003

SEQ ID NO: 135506 - RNA, 1701 nt, Artificial Sequence; identical to SEQ ID NO: 134457
  derived and/or modified sequence opt3 from hemagglutinin__InfluenzaA__ALE32004

SEQ ID NO: 135507 - RNA, 1701 nt, Artificial Sequence; identical to SEQ ID NO: 134457
  derived and/or modified sequence opt3 from hemagglutinin__InfluenzaA__ALE32005

SEQ ID NO: 135508 - RNA, 1701 nt, Artificial Sequence; identical to SEQ ID NO: 135001
  derived and/or modified sequence opt3 from hemagglutinin__InfluenzaA__ALE32006

SEQ ID NO: 135509 - RNA, 1701 nt, Artificial Sequence; identical to SEQ ID NO: 134457
  derived and/or modified sequence opt3 from hemagglutinin__InfluenzaA__ALE32007

SEQ ID NO: 135510 - RNA, 1701 nt, Artificial Sequence; identical to SEQ ID NO: 135008
  derived and/or modified sequence opt3 from hemagglutinin__InfluenzaA__ALE32008

SEQ ID NO: 135511 - RNA, 1701 nt, Artificial Sequence
  derived and/or modified sequence opt3 from hemagglutinin__InfluenzaA__ALE32009
augaagaccaucauugcccugagcuacauacucugccuuguguucgcucagaaacugcccgagaacgacaauuccacagcaacuuuguguuuaggccaccaugccgucccuaacgggacgaucguuaagaccauuacaucugauagaaucgaagugacuaaugcgaccgagcugguacaaaacucaaguauuggagaaaucugcgacagcccacaccagauacuagaugguaaaaauuguacacucaucgacgcucugcuuggcgauccgcagugcgacggguuucagaacaagaaaugggaucuguucguggagagguccaaggccuauucuaauuguuaccccuaugacgucccugauuacgcaucguugcggucacucguggccagcaguggaacccuggaauuuaacgacgaguccuucaauugggcuggcguuacucaaaacgguacaucuagcgcaugcauucgcggguccaauucaaguuucuuuagccgacugaacuggcucacccauucuaauuuuaaguauccagccuuaaacgugacgaugcccaauaacgagcaguucgauaaacuguacaucuggggaguccaccauccuggcacugacaaggaucagauuuuucuuuaugcucaguccucaggccguaucaccgugagcacaaaaagaagucaacaggccguaauaccaaacauugggucuaggccccggauccgcaauauuccuuccagaaucagcaucuacuggacuauuguuaagccaggagacauauugcugaucaacucgaccgguaaucuaauugcgccgaggggcuacuucaaaauccggucugggaaguccucaauaaugcgcagugacgcacccauuggaaaguguaaaagcgaaugcaucacaccuaacggcuccaucccaaaugauaagcccuuucagaacgugaaucgaauuaccuauggugccuguccuagauacgucaaacagucuacgcucaagcuggcuacugggaugaggaacgugccagagaaacaaacacggggaaucuucggcgccauugcaggcuuuauagaaaaugggugggagggaaugaaggacgguugguauggcuuccgucaccagaacagcgaggggcgcggacaggcugccgaucuuaaaucaacccaagcggccaucgaccagauuaauggcaagcugaacagauugaucgguaagacuaaugaaaaauuccaccagaucgagaaggaauuuagugagguggaagggaggauucaggaucucgagaaauacgucgaggacacaaagauagaucugugguccuauaacgcagaauuacugguugcucucgagaaucaacauaccaucgugcuuacggacagcgaaaugaacaaacuguucgagaagaccaagaaacaguugcgggaaaacgccgaggauaugggcaauggaugcuuuaagauuuaccacaaaugugacaacgcuugcaucggcucuauucgaaaugggacauaugaucaugacguauaccgcgacgaggcccuaaacaauagauuccagaucaagggaguggaacugaaaucagguuacaaggauuggauacucuggaucaguuuugcaauuagcugcuuccugcuuugugucgcccuguugggcuuuaucaugugggcuugccaggaggggaacauuagguguaauaucugcauauga

SEQ ID NO: 135512 - RNA, 1701 nt, Artificial Sequence
  derived and/or modified sequence opt3 from hemagglutinin__InfluenzaA__ALE32010
augaagaccaucauugcccugagcuacauacucugccuugcuuucgcacagaaaauccccggcaacgacaauuccacagccacucuguguuuggggcaccaugcggugccuaacggaacgauugucaagaccaucacaaaugauagaauugagguuacuaacgcuaccgaauuagugcaaaauucuucaaucggugagauaugcgacaguccacaccagauccuggauggcgaaaacuguacacuaauugacgcccuccugggggauccgcagugcgacggauuucagaauaaaaagugggaucuuuucguagagaggagcaaagcauauuccaacuguuaccccuaugacgugccugauuacgccucucugcggucguuggucgcuucaagcggcacccucgaauuuaauaacgagaguuucaauuggacuggugugacacaaaacgggaccuccucugcaugcauccgccgaagcuccucaaguuucuucagccgucugaauuggcugacgcaucuccacuauacuuacccagccuuaaacguuaccaugcccaauaacgagcaguuugacaagcuguauauuuggggagugcaucacccuggcacagauaaggaccagaucuuccuuuacgcucagucuuccggcagaauaacugucucaaccaaaaggagccaacaggccgugauuccaaacaucgggagucggccccgcauuagagauaucccuucuaggaucuccauuuacuggacaauaguaaagccaggagacaucuugcugauuaauagcaccgguaaccuaaucgcgccgcggggcuauuuuaaaauacgcucggggaagucuuccauuaugcgaucagacgcacccaucggaaaauguaagagugaaugcaucacgccuaauggcagcauuccaaacgauaagcccuuccagaauguuaacagaaucacuuacggugccuguccuagguaugugaaacacuccacacucaagcuggcuaccgggaugcggaaugucccagagaaacagacucguggaauuuuuggcgccauagcaggcuucaucgaaaacgggugggagggaaugguggacgguugguacggcuuucgccaucaaaauucugaggggagaggacaggcugccgaucuuaagagcacacaggcggccauugaccaaaucaacggcaaacugaauagguugaucgguaagaccaacgaaaaauuccaccagauugagaaggaauuuucagagguggaagggcggauacaggaucucgagaaguaugucgaggacacgaaaaucgaucuguggaguuacaaugcagaauuacugguugcucucgagaaccagcauaccauugaccuuacagauuccgaaaugaauaagcuguuugagaaaacuaagaaacaauugcgagaaaacgccgaggacaugggcaacggaugcuucaagaucuaucacaagugugauaaugcuugcauuggcagcauccgcaacgggaccuacgaccacaauguguacagagacgaggcccuaaacaauagguuucagauaaaaggaguagaacugaagucugguuauaaagauuggauccucuggauuucauucgcaaucaguugcuuucugcuuuguguggcccuguugggcuucauuaugugggcuugccagaaggggaacauccgguguaauauaugcauuuga

SEQ ID NO: 135513 - RNA, 1701 nt, Artificial Sequence; identical to SEQ ID NO: 135471
  derived and/or modified sequence opt3 from hemagglutinin__InfluenzaA__ALE32011

SEQ ID NO: 135514 - RNA, 1701 nt, Artificial Sequence; identical to SEQ ID NO: 135014
  derived and/or modified sequence opt3 from hemagglutinin__InfluenzaA__ALE32012

SEQ ID NO: 135515 - RNA, 1701 nt, Artificial Sequence; identical to SEQ ID NO: 134457
  derived and/or modified sequence opt3 from hemagglutinin__InfluenzaA__ALE32013

SEQ ID NO: 135516 - RNA, 1701 nt, Artificial Sequence
  derived and/or modified sequence opt3 from hemagglutinin__InfluenzaA__ALE32014
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcagcucaacuauacuuacccagcauuaaaugugaccaugcccaacaacgagcaguuugacaagcuguauauuuggggaguccaucacccuggcacagauaaagaccagaucuuccuuuacgcccaaucuuccggccguauaacugugucaaccaagagaagccagcaggcuguaauuccaaauaucgggaguaggccccggauucgcgauaucccuucuagaaucuccauuuacuggacaauaguuaaaccaggagacaucuugcugauuaacagcaccgguaaucuaaucgccccgaggggcuauuuuaagauacggucggggaaaucuuccauuaugcgcucagacgcgcccaucggaaaguguaagagugaaugcaucacgccuaacggcagcauuccaaaugauaaacccuuccagaacgugaaucgaaucacuuacggugcauguccuagauaugucaagcauuccacacucaaacuggccaccgggaugaggaacgugccagagaagcaaacucggggaauuuuuggcgcuauagccggcuucaucgaaaaugggugggagggaaugguggacgguugguacggcuuucgucaccagaacucugaggggcgcggacaggcagcugaucuuaaaagcacacaagccgcgauugaccagaucaauggcaagcugaacagauugaucgguaaaaccaaugaaaaguuccaccagauugagaaggaauuuucagaggucgaagggaggauacaggaucucgagaaauauguugaggacacgaagaucgaucuguggaguuacaacgccgaauuacugguggcacucgagaaucaacauaccauugaccuuacagauuccgaaaugaacaaacuguuugagaagacuaaaaagcaguugcgggaaaacgcugaggacaugggcaauggaugcuucaagaucuaucacaaaugugauaacgccugcauuggcagcauccgaaaugggaccuacgaccauaacguauaccgcgacgaggcucuaaauaacagauuucagauaaagggaguggaacugaaaucugguuauaaggauuggauccucuggauuucauucgccaucaguugcuuucugcuuugugucgcacuguugggcuucauuaugugggccugccagaaagggaauaucagguguaacauaugcauuuga

SEQ ID NO: 135517 - RNA, 1701 nt, Artificial Sequence; identical to SEQ ID NO: 135342
  derived and/or modified sequence opt3 from hemagglutinin__InfluenzaA__ALE32015

SEQ ID NO: 135518 - RNA, 1701 nt, Artificial Sequence; identical to SEQ ID NO: 134457
  derived and/or modified sequence opt3 from hemagglutinin__InfluenzaA__ALE32016

SEQ ID NO: 135519 - RNA, 1701 nt, Artificial Sequence; identical to SEQ ID NO: 134457
  derived and/or modified sequence opt3 from hemagglutinin__InfluenzaA__ALE32017

SEQ ID NO: 135520 - RNA, 1701 nt, Artificial Sequence; identical to SEQ ID NO: 134457
  derived and/or modified sequence opt3 from hemagglutinin__InfluenzaA__ALE32018

SEQ ID NO: 135521 - RNA, 1701 nt, Artificial Sequence; identical to SEQ ID NO: 135001
  derived and/or modified sequence opt3 from hemagglutinin__InfluenzaA__ALE32020

SEQ ID NO: 135522 - RNA, 1701 nt, Artificial Sequence; identical to SEQ ID NO: 135108
  derived and/or modified sequence opt3 from hemagglutinin__InfluenzaA__ALE32021

SEQ ID NO: 135523 - RNA, 1701 nt, Artificial Sequence; identical to SEQ ID NO: 135188
  derived and/or modified sequence opt3 from hemagglutinin__InfluenzaA__ALE32022

SEQ ID NO: 135524 - RNA, 1701 nt, Artificial Sequence; identical to SEQ ID NO: 134457
  derived and/or modified sequence opt3 from hemagglutinin__InfluenzaA__ALE32023

SEQ ID NO: 135525 - RNA, 1701 nt, Artificial Sequence
  derived and/or modified sequence opt3 from hemagglutinin__InfluenzaA__ALE32024
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcaaaaacuguacacucaucgacgcucugcuuggggauccgcagugcgacggauuucagaauaagaggugggaucuguucguggaacggagcaaagccuauuccaacuguuaccccuaugacgucccugauuacgcaucuuugcgcucgcucguggccucaagcggcacccuggaguuuaaugacgaaaguuucaacugggcugguguuacucaaaaugggaaguccucugcaugcauucgaggaagcaacuccucauuuuucagucgucugaauuggcucacacauagcaacuuuaaguauccagccuuaaaugugaccaugcccaacaacgagcaguucgauaaacuguacaucuggggcguccaccauccuggcacggacaaggaucagauuuuucuuuaugcucacucuuccgggagaaucacugugucaaccaaaaggagccagcaagccguaauaccaaauauuggaagucggccccgcaucagaaacauuccuucuaggaucuccaucuacuggacaauuguuaagccaggugacauauugcugaucaauagcacuggcaaccuaauugcgccgcggggguacuucaaaauccagucgggaaagucuuccauaaugcgcucagacgcacccauuggcaaguguaaaagugagugcaucaccccuaaugguagcaucccaaacgauaagcccuuucagaaugugaaccgaauuacauaugggaccuguccuagauacgucaaacaguccacgcucaagcuggccacuggaaugaggaaugugccagaaaaacaaacacggggcaucuucggcgcuauugccggguuuauagagaacggaugggaagguaugaaggacggcugguauggguuccgucaccaaaauucugagggacgcggccaggcagcugaucuuaaaagcacccaggccgcgaucgaccagauuaacgguaagcugaauagauugaucgggaagacuaacgagaaauuccaucagaucgaaaaggaguuuucagaaguggagggcaggauucaggaucucgaaaaauacgucgaggacacaaagauagaucuguggaguuauaaugccgaguuacugguugcacucgaaaaccaacacaccaucgaccuuacggauuccgagaugaacaaacuguucgaaaagaccaagaaacaguugcgggagaaugcugaagacaugggaaacggcugcuuuaagauuuaccauaaaugugauaaugccugcaucgggagcauucgaaacggaacauaugaccacuacguguaccgcgacgaggcucuaaauaacagauuccagaucaaggguguagagcugaaaucuggcuauaaggauuggauacucuggaucucauuugccauuaguugcuuccugcuuuguguggcacuguugggguuuaucaugugggccugccagaagggaaauauuagguguaacaucugcauauga

SEQ ID NO: 135526 - RNA, 1701 nt, Artificial Sequence
  derived and/or modified sequence opt3 from hemagglutinin__InfluenzaA__ALE32025
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuauacuuacccagcauuaaaugugaccaugcccaacaacgagcaguuugacaagcuguauauuuggggaguccaccauccuggcacagauaaagaccagaucuuccuuuacgcccguucuuccggcagaauaacugugucaaccaagaggagccagcaagcuguaauuccaaauaucgggagucggccccgcauuagagauaucccuucuaggaucuccauuuacuggacaauaguuaaaagcggagacaucuugcugauuaacucgaccgguaaucuaaucgccccacggggcuauuuuaagauacgcucugggaaauccucaauuaugcgaagugacgcgccgaucggaaaguguaagagcgaaugcaucacgcccaacggcuccauuccuaaugauaaaccauuccagaacgugaauagaaucacuuacggugcaugucccagguaugucaagcacucuacacucaaacuggccaccgggaugcggaacgugccugagaagcagacucguggaauuuuuggcgcuauagccggcuucaucgaaaaugggugggagggaaugguggacgguugguacggcuuucgccaccagaacagcgaggggagaggacaagcagcugaucuuaaaucaacacaggccgcgauugaccagaucaauggcaagcugaacagguugaucgguaaaaccaaugaaaaguuccaucaaauugagaaggaauuuagugaggucgaagggcggauacaggaucucgagaaauauguugaggacacgaagaucgaucugugguccuacaacgccgaauuacugguggcacucgagaaucagcacaccauugaccuuacagauagcgaaaugucuaaacuguuugagaagacuaaaaagcaguugcgagaaaacgcugaggacaugggcaacggaugcuucaagaucuaucauaaaugugauaaugccugcauuggcucaauccgcaacgggaccuacgaccacaauguauacagagacgaggcucuaaacaauagguuucaaauaaagggaguggaacugaaaagugguuauaaggauuggauccucuggauuagcuucgccaucuccugcuuucugcuuugugucgcacuguugggcuucauuaugugggccugccagaaagggaacauccgguguaauauaugcauuuga

SEQ ID NO: 135527 - RNA, 1701 nt, Artificial Sequence; identical to SEQ ID NO: 134457
  derived and/or modified sequence opt3 from hemagglutinin__InfluenzaA__ALE32026

SEQ ID NO: 135528 - RNA, 1701 nt, Artificial Sequence; identical to SEQ ID NO: 135001
  derived and/or modified sequence opt3 from hemagglutinin__InfluenzaA__ALE32027

SEQ ID NO: 135529 - RNA, 1701 nt, Artificial Sequence
  derived and/or modified sequence opt3 from hemagglutinin__InfluenzaA__ALE32028
augaagaccaucauugcccugagccacauacucugccuuguguucgcucagaaaauccccggcaacgacaauuccacagcaacucuguguuuggggcaucacgccgucccuaacggaacgauuguuaagaccaucacaaaugauagaauugaggugacuaacgcgaccgaauuaguacaaaauucuucaaucggugagauaugcgacaguccacaucagauccuggauggcgaaaacuguacacuaauugacgcucuccugggggauccgcagugcgacggauuucagaauaaaaagugggaucuuuucguggagaggagcaaagccuacuccaacuguuaucccuacgacgucccugauuaugcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaccucaacuacacuuauccagcauuaaaugugaccaugcccaacaacgagcaguuugacaagcuguacauuuggggaguccaucacccuggcacagauaaggaccagaucuuccuuuaugcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuacuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuauggugcauguccuagguacgucaaacacuccacacucaagcuggccaccgggaugcggaacgugccagagaaacagacucguggaauuuuuggcgcuauagccggcuucaucgaaaaugggugggagggaaugauggacgguugguauggcuuucgccaucaaaacucugaggggagaggacaggcagcugaucuuaagagcacacaggccgcgauugaccaaaucaauggcaaacugaacagguugaucgguaagaccaaugaaaaauuccaccagauugagaaggaauuuucagagguggaagggcggauacaggaucucgagaaguacgucgaggacacgaaaaucgaucuguggaguuauaacgccgaauuacugguugcacucgagaaucagcauaccauugaccuuacagauuccgaaaugaacaagcuguuugagaaaacuaagaaacaauugcgagaaaacgcugaggacaugggcaauggaugcuucaagaucuaccacaagugugauaacgccugcauuggcagcauccgcaaugggaccuaugaccacaacguguacagagacgaggcucuaaauaacagguuucagauaaaaggaguagaacugaagucugguuacaaagauuggauccucuggauuucauucgccaucaguugcuuucugcuuuguguggcacuguugggcuucauuaugugggccugccagaaggggaauauccgguguaacauaugcauuuga

SEQ ID NO: 135530 - RNA, 1701 nt, Artificial Sequence; identical to SEQ ID NO: 135108
  derived and/or modified sequence opt3 from hemagglutinin__InfluenzaA__ALE32029

SEQ ID NO: 135531 - RNA, 1701 nt, Artificial Sequence
  derived and/or modified sequence opt3 from hemagglutinin__InfluenzaA__ALE32030
augaagaccaucauugcccugagccacauacucugccuuguguucgcucagaaaauccccggcaacgacaauuccacagcaacucuguguuuggggcaucacgccgucccuaacggaacgauuguuaagaccaucacaaaugauagaauugaggugacuaacgcgaccgaauuaguacaaaauucuucaaucggugagauaugcgacaguccacaucagauccuggauggcgaaaacuguacacuaauugacgcucuccugggggauccgcagugcgacggauuucagaauaaaaagugggaucuuuucguggagaggagcaaagccuacuccaacuguuaucccuacgacgucccugauuaugcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaccucaacuacauuuauccagcauuaaaugugacuaugcccaacaacgagcaguuugacaagcuguacaucuggggaguccaucacccuggcaccgauaaggaccagauauuccuuuaugcccagucuuccggcagaauuacagugucaacuaaaaggagccaacaggcuguaaucccaaauauugggagucggccccgcaucagagauaucccuucuaggauuuccauauacuggaccaucguuaagccaggagacauuuugcugaucaacagcacagguaaucuaauagccccgcggggcuacuuuaaaauucgcucggggaagucuuccaucaugcgaucagacgcgcccaucggaaaauguaagagugaaugcauuaccccuaacggcagcaucccaaaugauaagcccuuccagaacgugaauagaauuacguauggugcauguccuagguacgucaaacacuccacucucaagcuggccacagggaugcggaacgugccagagaaacagacccguggaauauuuggcgcuaucgccggcuucauugaaaaugggugggagggaaugauggacgguugguauggcuuucgccaucaaaacucugaggggagaggacaggcagcugaucuuaagagcacucaggccgcgaucgaccaaaucaauggcaaacugaacagguugauugguaagacaaaugaaaaauuccaccagauagagaaggaauuuucagagguggaagggcggauccaggaucucgagaaguacgucgaggacaccaaaauugaucuguggaguuauaacgccgaauuacugguugcacucgagaaucagcauacgaucgaccuuaccgauuccgaaaugaacaagcuguuugagaaaacaaagaaacaauugcgagaaaacgcugaggacaugggcaauggaugcuucaagauuuaccacaagugugauaacgccugcaucggcagcauacgcaaugggacuuaugaccacaacguguacagagacgaggcucuaaauaacagguuucagaucaaaggaguagaacugaagucugguuacaaagauuggauucucuggaucucauucgccauuaguugcuuucugcuuuguguggcacuguugggcuucaucaugugggccugccagaaggggaauauacgguguaacauuugcaucuga

SEQ ID NO: 135532 - RNA, 1701 nt, Artificial Sequence
  derived and/or modified sequence opt3 from hemagglutinin__InfluenzaA__ALE32031
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacucaagcuggccaccgggaugcggaacgugccagagaaacagacucguggaauuuuuggcgcuauagccggcuucaucgaaaaugggugggagggaaugauggacgguugguacggcuuucgccaccaaaacucugaggggagaggacaggcagcugaucuuaagagcacacaggccgcgauugaccaaaucaauggcaaacugaacagguugaucgguaagaccaaugaaaaauuccaucagauugagaaggaauuuucagagguggaagggcggauacaggaucucgagaaguaugucgaggacacgaaaaucgaucuguggaguuacaacgccgaauuacugguugcacucgagaaucagcacaccauugaccuuacagauuccgaaaugaacaagcuguuugagaaaacuaagaaacaauugcgagaaaacgcugaggacaugggcaauggaugcuucaagaucuaucauaagugugauaacgccugcauuggcagcauccgcaaugggaccuacgaccacaacguguacagagacgaggcucuaaauaacagguuucagauaaaaggaguagaacugaagucugguuauaaagauuggauccucuggauuucauucgccaucaguugcuuucugcuuuguguggcacuguugggcuucauuaugugggccugccagaaggggaauauccgguguaacauaugcauuuga

SEQ ID NO: 135533 - RNA, 1701 nt, Artificial Sequence
  derived and/or modified sequence opt3 from hemagglutinin__InfluenzaA__ALE32032
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauagcugugucaacuaaaaggagccaacaggccguaauuccaaauaucgggagucggccccgcauuagagauaucccuucuaggaucuccauuuacuggaccauaguuaagccaggagacaucuugcugauuaacagcacagguaaucuaaucgcgccgcggggcuauuuuaaaauacgcucggggaagucuuccauuaugcgaucagacgcacccaucggaaaauguaagagugaaugcaucaccccuaacggcagcauuccaaaugauaagcccuuccagaacgugaauagaaucacguacggugccuguccuagguaugucaaacacuccacucucaagcuggcuacagggaugcggaacgugccagagaaacagacccguggaauuuuuggcgccauagcaggcuucaucgaaaaugggugggagggaaugauggacgguugguacggcuuucgccaccaaaacucugaggggagaggacaggcugccgaucuuaagagcacucaggcggccauugaccaaaucaauggcaaacugaacagguugaucgguaagacaaaugaaaaauuccaucagauugagaaggaauuuucagagguggaagggcggauacaggaucucgagaaguaugucgaggacaccaaaaucgaucuguggaguuacaacgcagaauuacugguugcucucgagaaucagcacacgauugaccuuaccgauuccgaaaugaacaagcuguuugagaaaacaaagaaacaauugcgagaaaacgccgaggacaugggcaauggaugcuucaagaucuaucauaagugugauaacgcuugcauuggcagcauccgcaaugggacuuacgaccacaacguguacagagacgaggcccuaaauaacagguuucagauaaaaggaguagaacugaagucugguuauaaagauuggauccucuggauuucauucgcaaucaguugcuuucugcuuuguguggcccuguugggcuucauuaugugggcuugccagaaggggaauauccgguguaacauaugcauuuga

SEQ ID NO: 135534 - RNA, 1701 nt, Artificial Sequence; identical to SEQ ID NO: 134457
  derived and/or modified sequence opt3 from hemagglutinin__InfluenzaA__ALE32033

SEQ ID NO: 135535 - RNA, 1701 nt, Artificial Sequence
  derived and/or modified sequence opt3 from hemagglutinin__InfluenzaA__ALE32034
augaagaccaucauugcccugggcuacauacucugccuuguguucgcucagaaaauccccgggaacgacaauagcacagcaacucuguguuugggacaccaugccgucccuaacgguacgauuguuaagaccaucacaaaugauagaauugaggugacuaacgcgaccgaauuaguacaaaauuccucuaucggcgagauaugcgacucaccacacaaaauccuggauggggaaaacuguacacuaauugacgcucuccugggagauccgcagugcgacggcuuucagaauaagaaaugggaucuuuucguggagaggaguaaggccuauagcaacuguuaccccuaugacgucccugauuacgcaucccugcggucuuugguggccucgucagguacccucgaauuuaauaacgagagcuucaauuggacugggguuacacagaacggaaccaguuccgcuugcauccgccgaucuagcuccucauuuuucagucgucugaauuggcugacgcaucucaaguauacuuacccagcauuaaacgugaccaugcccaauaacgagcaauuugacaaacuguauauuuggggcguccaccauccuggcacagauaaggaccagaucuuccuuuacgcccagagcucugggagaauaacuguguccaccaaaaggucacagcaagcuguaauuccaaacaucggaagccggccccgcauuagagauaucccuaguaggaucucuauuuacuggacaauaguuaagccaggugacaucuugcugauuaauuccaccggcaaccuaaucgccccgcggggguauuuuaaaauacgcagcggaaagucgucuauuaugcgauccgacgcgcccaucggcaaguguaaaucagaaugcaucacgccuaaugguaguauuccaaacgauaagcccuuccagaaugugaacagaaucacuuacggggcauguccuagguaugucaaacacagcacacucaagcuggccaccggaaugcggaaugugccagagaaacagacucguggcauuuuuggcgcuauagccggguucaucgaaaacggaugggaggguaugguggacggcugguacggguuucgccaccagaauagcgagggaagaggccaagcagcugaucuuaagucuacacaggccgcgauugaccagaucaacgguaaacugaauagguugaucgggaagaccaacgaaaaguuccaucaaauugagaaagaguucagcgaagucgaaggccggauacaggaucucgagaaguauguugaggacacgaaaaucgaucuguggucauacaaugccgaauuacugguggcacucgagaaccagcacaccauugaccuuacagauagugaaaugaauaagcuguuugagaaaacuaagaagcaguugcgagaaaacgcugaggacaugggaaacggcugcuucaaaaucuaucauaagugugauaaugccugcauuggguccauccgcaacggaaccuacgaccacaauguauacagagacgaggcucuaaacaauagguuucaaauaaaagguguggaacugaaguccggcuauaaagauuggauccucuggauuucuuucgccaucucaugcuuucugcuuugugucgcacuguugggguucauuaugugggccugccagaagggaaacauccgguguaauauaugcauuuga

SEQ ID NO: 135536 - RNA, 1701 nt, Artificial Sequence; identical to SEQ ID NO: 135347
  derived and/or modified sequence opt3 from hemagglutinin__InfluenzaA__ALE32035

SEQ ID NO: 135537 - RNA, 1701 nt, Artificial Sequence
  derived and/or modified sequence opt3 from hemagglutinin__InfluenzaA__ALE32036
augaagaccaucauugcccugggcuacauacucugccuuguguucgcucagaaaauccccgggaacgacaauagcacagcaacucuguguuugggacaccaugccgucccuaacgguacgauuguuaagaccaucacaaaugauagaauugaggugacuaacgcgaccgaauuaguacaaaauuccucuaucggcgagauaugcgacucaccacacaaaauccuggauggggaaaacuguacacuaauugacgcucuccugggagauccgcagugcgacggcuuucagaauaagaaaugggaucuuuucguggagaggaguaaggccuauagcaacuguuaccccuaugacgucccugauuacgcaucccugcggucuuugguggccucgucagguacccucgaauuuaauaacgagagcuucaauuggacugggguuacacagaacggaaccaguuccgcuugcauccgccgaucuagcuccucauuuuucagucgucugaauuggcugacgcaucuccacuauacuuacccagcauuaaacgugaccaugcccaauaacgagcaauuugacaagcuguauauuuggggcguccaucacccuggcacagauaaagaccagaucuuccuuuacgcccagagcucugggagaauaacuguguccaccaagaggucacagcaagcuguaauuccaaacaucggaagccggccccgcauuagagauaucccuaguaggaucucuauuuacuggacaauaguuaaaccaggugacaucuugcugauuaauuccaccggcaaccuaaucgccccgcggggguauuuuaagauacgcagcggaaaaucgucuauuaugcgauccgacgcgcccaucggcaaguguaagucagaaugcaucacgccuaaugguaguauuccaaacgauaaacccuuccagaaugugaacagaaucacuuacggggcauguccuagguaugucaagcacagcacacucaaacuggccaccggaaugcggaaugugccagagaagcagacucguggcauuuuuggcgcuauagccggguucaucgaaaacggaugggaggguaugguggacggcugguacggguuucgccaucaaaauuccgagggaagaggccaggcagcugaucuuaaaucuacacaggccgcgauugaccagaucaacgguaagcugaauagguugaucgggaaaaccaacgaaaaguuccaccaaauugagaaggaguucagcgaagucgaaggccggauacaggaucucgagaaauauguugaggacacgaagaucgaucuguggucauacaaugccgaauuacugguggcacucgagaaccagcauaccauugaccuuacagauagugaaaugaauaaacuguuugagaagacuaaaaagcaguugcgagaaaacgcugaggacaugggaaacggcugcuucaagaucuaucacaaaugugauaaugccugcauuggguccauccgcaacggaaccuacgaccacaauguauacagagacgaggcucuaaacaauagguuucaaauaaaggguguggaacugaaaagcggcuauaaggauuggauccucuggauuucuuucgccaucucaugcuuucugcuuugugucgcacuguugggguucauuaugugggccugccagaaaggaaacauccgguguaauauaugcauuuga

SEQ ID NO: 135538 - RNA, 1701 nt, Artificial Sequence
  derived and/or modified sequence opt3 from hemagglutinin__InfluenzaA__ALE32037
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauaaguacccagcauuaaaugugacuaugcccaacaacgagcaguuugacaagcuguauauuuggggaguccaccauccuggcaccgauaaagaccagaucuuccuuuacgcccagucuuccggcagaauaacagugucaacuaagaggagccaacaggcuguaauuccaaauaucgggagucggccccgcauuagagauaucccuucuaggaucuccauuuacuggaccauaguuaaaccaggagacaucuugcugauuaacagcacagguaaucuaaucgccccgcggggcuauuuuaagauacucucggggaaaucuuccauuaugcgcucagacgcgcccaucggaaaguguaagagugaaugcaucaccccuaacggcagcauuccaaaugauaaacccuuccagaacgugaaucgaaucacguacggugcauguccuagauaugucaagcacuccacucugaaacuugccacagggaugaggaacgugccagagaagcagacccggggaauuuuuggcgcuauagccggcuucaucgaaaaugggugggagggaaugguggacgguugguacggcuuucgucaccaaaacucugaggggcgcggacaggcagcugaucugaaaagcacucaggccgcgauugaccaaaucaauggcaaguugaacagacucaucgguaaaacaaaugaaaaguuccaucagauugagaaggaauuuucagaggucgaagggaggauacaggaucuggagaaauauguugaggacaccaagaucgauuuauggaguuacaacgccgaacugcucguggcacuugagaaucagcacacgauugaccugaccgauuccgaaaugaacaaauuguuugagaagacuaaaaagcaacuacgggaaaacgcugaggacaugggcaauggaugcuucaagaucuaucauaaaugugauaacgccugcauuggcagcauccgaaaugggacauacgaccacaacguauaccgcgacgaggcucugaauaacagauuucagauaaagggaguggaacucaaaucugguuauaaggauuggauccuguggauuucauucgccaucaguugcuuucuucugugugucgcauugcucggcuucauuaugugggccugccagaaagggaauaucagguguaacauaugcauuuga

SEQ ID NO: 135539 - RNA, 1701 nt, Artificial Sequence
  derived and/or modified sequence opt3 from hemagglutinin__InfluenzaA__ALE32038
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaaagguaaucuaaucgccccgcggggcuauuuuaagauacgcucggggaaaucuuccauuaugcgaucagacgcgcccaucggaaaguguaagagugaaugcaucaccccuaacggcagcauuccaaaugauaaacccuuccagaacgugaauagaaucacguacggugcauguccuagguaugucaagcacuccacucucaaacuggccacagggaugcggaacgugccagagaagcagacccguggaauuuuuggcgcuauagccggcuucaucgaaaaugggugggagggaaugguggacgguugguacggcuuucgccaccuuaacucugaggggagaggacaagcagcugaucugaaaagcacucaggccgcgauugaccagaucaauggcaaguugaacaggcucaucgguaaaacaaaugaaaaguuccaucaaauugagaaggaauuuucagaggucgaagggcggauacaggaucuggagaaauauguugaggacaccaagaucgauuuauggaguuacaacgccgaacugcucguggcacuugagaaucagcacacgauugaccugaccgauuccgaaaugaacaaauuguuugagaagacuaaaaagcagcuacgagaaaacgcugaggacaugggcaauggaugcuucaagaucuaucauaaaugugauaacgccugcauuggcagcauccgcaaugggacauacgaccacaacguauacagagacgaggcucugaauaacagguuucaaauaaagggaguggaacucaaaucugguuauaaggauuggauccuguggauuucauucgccaucaguugcuuucuucugugugucgcauugcucggcuucauuaugugggccugccagaaagggaauauccgguguaacauaugcauuuga

SEQ ID NO: 135540 - RNA, 1701 nt, Artificial Sequence; identical to SEQ ID NO: 135115
  derived and/or modified sequence opt3 from hemagglutinin__InfluenzaA__ALE32039

SEQ ID NO: 135541 - RNA, 1701 nt, Artificial Sequence
  derived and/or modified sequence opt3 from hemagglutinin__InfluenzaA__ALE32040
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggacgucuuccauuaugcgaucagacgcgcccaucggaaaguguaaaagugaaugcaucacuccuaacggcagcauuccaaaugauaagcccuuccagaacgugaauagaaucacauacggugcauguccuagguaugucaagcacuccacccucaaacuggccacugggaugcggaacgugccagagaagcagacacguggaauuuuuggcgcuauagccggcuucaucgaaaaugggugggagggaaugguggacgguugguacggcuuucgccaccaaaacucugaggggagaggacaggcagcugaucuuaaaagcacccaggccgcgauugaccaaaucaauggcaagcugaacagguugaucgguaaaacgaaugaaaaguuccaucagauugagaaagaauuuucagaggucgaagggcggauacaggaucucgagaaguauguugaggacaccaagaucgaucuguggaguuacaacgccgaauuacugguggcacucgagaaucagcacacaauugaccuuacugauuccgaaaugaacaaacuguuugagaagaccaaaaagcaauugcgagaaaacgcugaggacaugggcaauggaugcuucaaaaucuaucauaagugugauaacgccugcauuggcagcauccgcaaugggacauacgaccacaacguauacagagacgaggcucuaaauaacagguuucagauaaagggaguggaacugaaaucugguuauaaggauuggauccucuggauuucauucgccaucaguugcuuucugcuuugugucgcacuguugggcuucauuaugugggccugccagaaagggaauauccgguguaacauaugcauuuga

SEQ ID NO: 135542 - RNA, 1701 nt, Artificial Sequence; identical to SEQ ID NO: 134457
  derived and/or modified sequence opt3 from hemagglutinin__InfluenzaA__ALE32041

SEQ ID NO: 135543 - RNA, 1701 nt, Artificial Sequence; identical to SEQ ID NO: 134457
  derived and/or modified sequence opt3 from hemagglutinin__InfluenzaA__ALE32042

SEQ ID NO: 135544 - RNA, 1701 nt, Artificial Sequence
  derived and/or modified sequence opt3 from hemagglutinin__InfluenzaA__ALE32043
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacaccucucugcggucguugguggcaucaagcggcacucucgaauuuaauaacgagaguuucaauuggacagguguuacccaaaacgggacguccucugccugcauccgccgaagcuccucaaguuucuucagccgucugaauuggcugacucaucucaacuauaccuacccagcuuuaaaugugacaaugcccaacaacgagcaguuugacaagcuguauauuuggggaguccaccauccuggcacugauaaggaccagaucuuccuuuacgcacagucuuccggcagaauaaccgugucaacaaaaaggagccaacaggccguaauuccaaauaucgggagucggccccgcauuagagauaucccuucuaggaucuccauuuacuggaccauaguuaagccaggagacaucuugcugauuaacagcacggguaaucuaaucgcuccgcggggcuauuuuaaaauacgcucggggaagucuuccauuaugcgaucagacgcccccaucggaaaauguaagagugaaugcaucacuccuaacggcagcauuccaaaugauaagcccuuccagaacgugaauagaaucacauacggugcguguccuagguaugucaaacacuccacccucaagcuggcaacugggaugcggaacgugccagagaaacagacacguggaauuuuuggcgccauagcuggcuucaucgaaaaugggugggagggaaugguggacgguugguacggcuuucgccaccaaaacucugaggggagaggacaggccgcagaucuuaagagcacccaggcugccauugaccaaaucaauggcaaacugaacagguugaucgguaagacgaaugaaaaauuccaucagauugagaaggaauuuucagaggucgaagggcggauacaggaucucgagaaguauguugaggacaccaaaaucgaucuguggaguuacaacgcggaauuacugguggcccucgagaaucagcacacaauugaccuuacugauuccgaaaugaacaagcuguuugagaaaaccaagaaacaauugcgagaaaacgcagaggacaugggcaauggaugcuucaagaucuaucauaagugugauaacgcuugcauuggcagcauccgcaaugggacauacgaccacaacguauacagagacgaggcccuaaauaacagguuucagauaaaaggaguggaacugaagucugguuauaaagauuggauccucuggauuucauucgcuaucaguugcuuucugcuuugugucgcccuguugggcuucauuaugugggcaugccagaaggggaauauccgguguaacauaugcauuuga

SEQ ID NO: 135545 - RNA, 1701 nt, Artificial Sequence; identical to SEQ ID NO: 134457
  derived and/or modified sequence opt3 from hemagglutinin__InfluenzaA__ALE32044

SEQ ID NO: 135546 - RNA, 1701 nt, Artificial Sequence; identical to SEQ ID NO: 134457
  derived and/or modified sequence opt3 from hemagglutinin__InfluenzaA__ALE32045

SEQ ID NO: 135547 - RNA, 1701 nt, Artificial Sequence; identical to SEQ ID NO: 134457
  derived and/or modified sequence opt3 from hemagglutinin__InfluenzaA__ALE32046

SEQ ID NO: 135548 - RNA, 1701 nt, Artificial Sequence
  derived and/or modified sequence opt3 from hemagglutinin__InfluenzaA__ALE32047
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccaggugcuggauggcgaaaacuguacacuaaucgacgcucuccugggggauccgcagugcgacggauuucagaauaaaaagugggaucuuuucgucgagaggagcaaagccuauuccaacuguuaccccuaugacgugccugauuacgcaucucugcggucguugguugccucaagcggcacccucgaauuuaauaacgagaguuucaauuggacuggugugacacaaaacgggaccuccucugcuugcauucgccgaagcuccucaaguuucuucagccgucugaauuggcugacgcaucucaacuauacuuacccagcauuaaaugucaccaugcccaacaacgagcaguuugacaagcuguauaucuggggagugcaccauccuggcacagauaaggaccagauuuuccuuuacgcccagucuuccggcagaaucacuguaucaaccaaaaggagccaacaggcuguuauaccaaauauugggagucggccccgcaucagagauauuccuucuaggaucuccaucuacuggacaauugugaagccaggagacauauugcugaucaacagcaccgguaaucuaauugccccgcggggcuauuuuaaaauccgcucggggaagucuuccauaaugauuucagacgcgcccaucggaaaauguaagagugaaugcaucacgccuaacggcagcauuccauccgauaagcccuuccagaaugucaaccgaaucacuuacggugcauguccuagauaugugaaacacucuacacucaagcuggccaccgggaugaggaaugugccagagaaacagacucggggaauuuuuggcgcuauagccggcuucaucgaaaacgggugggagggaauggucgacgguugguacggcuuucgucaccaaaauagcgaggggcgcggacaggcagcugaucuuaagucaacacaggccgcgauugaccaaaucaacggcaaacugaauagauugaucgguaagaccaacgaaaaauuccaucagauugagaaggaauuuagugagguugaagggaggauacaggaucucgagaaguauguggaggacacgaaaaucgaucugugguccuacaaugccgaauuacugguagcacucgagaaccagcacaccauugaccuuacagauagcgaaaugaauaagcuguuugagaaaacuaagaaacaauugcgggaaaacgcugaggacaugggcaacggaugcuucaagaucuaucauaagugugauaaugccugcauuggcucuauccgaaacgggaccuacgaccacaauguguaccgcgacgaggcucuaaacaauagauuucagauaaaaggagucgaacugaagucagguuauaaagauuggauccucuggauuaguuucgccaucagcugcuuucugcuuuguguggcacuguugggcuucauuaugugggccugccagaaggggaacaucagguguaauauaugcauuuga

SEQ ID NO: 135549 - RNA, 1701 nt, Artificial Sequence; identical to SEQ ID NO: 134457
  derived and/or modified sequence opt3 from hemagglutinin__InfluenzaA__ALE32048

SEQ ID NO: 135550 - RNA, 1701 nt, Artificial Sequence; identical to SEQ ID NO: 135115
  derived and/or modified sequence opt3 from hemagglutinin__InfluenzaA__ALE32049

SEQ ID NO: 135551 - RNA, 1701 nt, Artificial Sequence
  derived and/or modified sequence opt3 from hemagglutinin__InfluenzaA__ALE32050
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaagacgggaccuccucugcuugcauccgccgaagcuccucaaguuucuucagccgucugaacuggcugacgcaucucaauuauacuuacccagcauuaaacgugaccaugcccaauaacgagcaguuugauaagcuguauauuuggggaguccaccauccuggcacagacaaggaucagaucuuccuuuacgcccagucuuccggcagaauaacugugucaaccaaaaggagccaacaggcuguaauuccaaacaucgggagucggccccgcauuagagacaucccuucuaggaucuccauuuacuggacaauaguuaagccaggagacaucuugcugauuaauagcaccgguaaccuaaucgccccgcggggcuauuuuaaaauacgcucggggaagucuuccauuaugcgaucagaugcgcccaucggaaaauguaagagugaaugcaucacgccuaauggcagcauuccaaacgacaagcccuuccagaaugugaacagaaucacuuacggugcauguccuagguaugucaaacacuccacacucaagcuggccaccgggaugcggaaugugccagagaaacagacucguggaauuuuuggcgcuauagccggcuucaucgaaaacgggugggagggaaugguggaugguugguacggcuuucgccaccaaaauucugaggggagaggacaggcagcugaccuuaagagcacacaggccgcgauugaucaaaucaacggcaaacugaauagguugaucgguaagaccaacgaaaaauuccaucagauugagaaggaauuuucagaggucgaagggcggauacaggaccucgagaaguauguugaggauacgaaaaucgaccuguggaguuacaaugccgaauuacugguggcacucgagaaccagcacaccauugaucuuacagacuccgaaaugaauaagcuguuugagaaaacuaagaaacaauugcgagaaaacgcugaggauaugggcaacggaugcuucaagaucuaucauaagugugacaaugccugcauuggcagcauccgcaacgggaccuacgaccacaauguauacagagaugaggcucuaaacaauagguuucagauaaaaggaguggaacugaagucugguuauaaagacuggauccucuggauuucauucgccaucaguugcuuucugcuuugugucgcacuguugggcuucauuaugugggccugccagaaggggaacauccgguguaauauaugcauuuga

SEQ ID NO: 135552 - RNA, 1701 nt, Artificial Sequence
  derived and/or modified sequence opt3 from hemagglutinin__InfluenzaA__ALE32051
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagagucacuuacggugcauguccuagguaugugaaacacuccacacucaagcuggccaccgggaugcggaacgugccagagaaacagacucguggaaucuuuggcgcuauugccggcuucauagaaaaugggugggagggaauggucgacgguugguacggcuuucgccaccaaaacucugaggggagaggacaggcagcugaucuuaagagcacacaggccgcgaucgaccaaauuaauggcaaacugaacagguugaucgguaagaccaaugaaaaauuccaucagaucgagaaggaauuuucagagguugaagggcggauucaggaucucgagaaguauguggaggacacgaaaauagaucuguggaguuacaacgccgaauuacugguagcacucgagaaucagcacaccaucgaccuuacagauuccgaaaugaacaagcuguuugagaaaacuaagaaacaauugcgagaaaacgcugaggacaugggcaauggaugcuucaagauuuaucauaagugugauaacgccugcaucggcagcauucgcaaugggaccuacgaccacaacguguacagagacgaggcucuaaucaauagguuucagauaaaaggagucgaacugaagucugguuauaaagauuggauccucuggauuucauucgccaucaguugcuuucugcuuuguguggcacuguugggcuucauuaugugggccugccagaaggggaacauccgguguaauauaugcauuuga

SEQ ID NO: 135553 - RNA, 1701 nt, Artificial Sequence; identical to SEQ ID NO: 134457
  derived and/or modified sequence opt3 from hemagglutinin__InfluenzaA__ALE32052

SEQ ID NO: 135554 - RNA, 1701 nt, Artificial Sequence; identical to SEQ ID NO: 134457
  derived and/or modified sequence opt3 from hemagglutinin__InfluenzaA__ALE32053

SEQ ID NO: 135555 - RNA, 1701 nt, Artificial Sequence
  derived and/or modified sequence opt3 from hemagglutinin__InfluenzaA__ALE32054
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgaaaguccacaccagauccuggacggcgagaacuguacacuaauugaugcucuccugggggacccgcagugcgauggauuucagaauaaaaagugggaccuuuucguggaaaggagcaaagccuauuccaacuguuaccccuaugaugucccugacuacgcaucucugcggucguugguggccucaagcggcacccucgaguuuaauaacgagaguuucaauuggacugguguuacacaaaacgggaccuccucugcuugcauccgccgaagcuccucaaguuucuuuagccgucugaauuggcugacgcaucucaacuauacuuacccagcauuaaaugugaccaugcccaacaacgaacaguuugauaagcuguauauuuggggaguccaccauccuggcacagacaaggaucagaucuuccuuuacgcccagucuuccggcagaauaacugugucaaccaaagggagccaacaggcuguaauuccaaauaucggaaguaggccccggauucgcgacaucccuucuagaaucuccauuuacuggacaauaguuaagccaggugauaucuugcugauuaacagcaccggcaaucuaaucgccccgaggggguauuuuaaaauacggucgggaaagucuuccauuaugcgcucagacgcgcccaucggcaaauguaagagugagugcaucacgccuaacgguagcauuccaaaugacaagcccuuccagaacgugaaucgaaucacuuacggggcauguccuagauaugucaaacacuccacacucaagcuggccaccggaaugaggaacgugccagaaaaacagacucggggcauuuuuggcgcuauagccggguucaucgagaauggaugggaggguaugguggauggcugguacggguuucgucaccaaaacucugaaggacgcggccaggcagcugaccuuaagagcacacaggccgcgauugaucaaaucaaugguaaacugaacagauugaucgggaagaccaaugagaaauuccaucagauugaaaaggaguucucagaagucgagggcaggauacaggaccucgagaaguauguugaagauacgaaaaucgaccuguggaguuacaacgccgaguuacugguggcacucgaaaaucagcacaccauugaucuuacagacuccgagaugaacaagcuguuugagaaaacuaagaaacaauugcgggaaaacgcugaggauaugggaaauggcugcuucaagaucuaucauaagugugacaacgccugcauugggagcauccgaaauggaaccuacgaucacaacguauaccgcgacgaagcucuaaauaacagauuucagauaaaagguguggagcugaagucuggcuauaaagacuggauccucuggauuucauucgccaucaguugcuuucugcuuugugucgcacuguugggguucauuaugugggccugccagaagggaaauaucagguguaaccacugcauauga

SEQ ID NO: 135556 - RNA, 1701 nt, Artificial Sequence
  derived and/or modified sequence opt3 from hemagglutinin__InfluenzaA__ALE32055
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauaaguacccagcauuaaaugugacuaugcccaacaacgagcaguuugacaagcuguauauuuggggaguccaccauccuggcaccgauaaagaccagaucuuccuuuacgcccagucuuccggcagaauaacagugucaacuaagaggagccaacaggcuguaauuccaaauaucgggagucggccccgcauuagagauaucccuucuaggaucuccauuuacuggaccauaguuaaaccaggagacaucuugcugauuaacagcacagguaaucuaaucgccccgcggggcuauuuuaagauacgcucggggaaaucuuccauuaugcgaucagacgcgcccaucggaaaguguaagagugaaugcaucaccccuaacggcagcauuccaaaugauaaacccuuccagaacgugaauagaaucacguacggugcauguccuagguaugucaagcacuccacucucaaacuggccacagggaugcggaacgugccagagaagcagacccguggaauuuuuggcgcuauagccggcuucaucgaaaaugggugggagggaaugguggacgguugguacggcuuucgccaccaaaacucugaggggagaggacaggcagcugaucuuaaaagcacucaggccgcgauugaccaaaucaauggcaagcugaacagguugaucgguaaaacaaaugaaaaguuccaucagauugagaaggaauuuucagaggucgaagggcggauacaggaucucgagaaauauguugaggacaccaagaucgaucuguggaguuacaacgccgaauuacugguggcacucgagaaucagcacacgauugaccuuaccgauuccgaaaugaacaaacuguuugagaagacuaaaaagcaauugcgagaaaacgcugaggacaugggcaauggaugcuucaagaucuaucauaaaugugauaacgccugcauuggcagcauccgcaaugggacauacgaccacaacguauacagagacgaggcucuaaauaacagguuucagauaaagggaguggaacugaaaucugguuauaaggauuggauccucuggauuucauucgccaucaguugcuuucugcuuugugucgcacuguugggcuucauuaugugggccugccagaaugggaacauccgguguaauauaugcauuuga

SEQ ID NO: 135557 - RNA, 1701 nt, Artificial Sequence; identical to SEQ ID NO: 135108
  derived and/or modified sequence opt3 from hemagglutinin__InfluenzaA__ALE32056

SEQ ID NO: 135558 - RNA, 1701 nt, Artificial Sequence
  derived and/or modified sequence opt3 from hemagglutinin__InfluenzaA__ALE32057
augaagaccaucauugcccugagcuacgugcucugccuugucuucgcucagaaaauacccggcaacgacaauuccacagcaacucuguguuuggggcaccaugccguuccuaacggaacgaucgugaagaccauuacaaaugauagaaucgagguaacuaacgcgaccgaauuagugcaaaauucuucaauuggugagaucugcgacaguccacaccagauacuggauggcgaaaacuguacacuaaucgacgcucuccugggggauccgcagugcgacggauuucagaauaaaaagugggaucuuuucgucgagaggagcaaagccuauuccaacuguuaccccuaugacgugccugauuacgcaucucugcggucguugguugccucaagcggcacccucgaauuuaauaacgagaguuucaauuggacuggugugacacaaaacgggaccuccucugcuugcauucgccgaagcuccucaaguuucuucagccgucugaauuggcugacgcaucucaacuauacuuacccagcauuaaaugucaccaugcccaacaacgagcaguuugacaagcuguauaucuggggagugcaccauccuggcacagauaaggaccagauuuuccuuuacgcccagucuuccggcagaaucacuguaucaaccaaaaggagccaacaggcuguuauaccaaauauugggagucggccccgcaucagagauauuccuucuaggaucuccaucuacuggacaauugugaagccaggagacauauugcugaucaacagcaccgguaaucuaauugccccgcggggcuauuuuaaaauccgcucggggaagucuuccauaaugcgaucagacgcgcccauuggaaaauguaagagugaaugcaucacgccuaacggcagcaucccaaaugauaagcccuuccagaacgucaauagaauuacuuacggugcauguccuagguaugugaaacacuccacacucaagcuggccaccgggaugcggaacgugccagagaaacagacucguggaaucuuuggcgcuauugccggcuucauagaaaaugggugggagggaauggucgacgguugguacggcuuucgccaccaaaacucugaggggagaggacaggcagcugaucuuaagagcacacaggccgcgaucgaccaaauuaauggcaaacugaacagguugaucgguaagaccaaugaaaaauuccaucagaucgagaaggaauuuucagagguugaagggcggauucaggaucucgagaaguauguggaggacacgaaaauagaucuguggaguuacaacgccgaauuacugguagcacucgagaaucagcacaccaucgaccuuacagauuccgaaaugaacaagcuguuugagaaaacuaagaaacaauugcgagaaaacgcugaggacaugggcaauggaugcuucaagauuuaucauaagugugauaacgccugcaucggcagcauucgcaaugggaccuacgaccacaacguguacagagacgaggcucuaaauaacagguuucagaucaaaggagucgaacugaagucugguuauaaagauuggauacucuggaucucauucgccauuaguugcuuucugcuuuguguggcacuguugggcuucaucaugugggccugccagaaggggaauauucgguguaacaucugcauauga

SEQ ID NO: 135559 - RNA, 1701 nt, Artificial Sequence; identical to SEQ ID NO: 134457
  derived and/or modified sequence opt3 from hemagglutinin__InfluenzaA__ALE32058

SEQ ID NO: 135560 - RNA, 1701 nt, Artificial Sequence; identical to SEQ ID NO: 134457
  derived and/or modified sequence opt3 from hemagglutinin__InfluenzaA__ALE32059

SEQ ID NO: 135561 - RNA, 1701 nt, Artificial Sequence
  derived and/or modified sequence opt3 from hemagglutinin__InfluenzaA__ALE32060
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagguguuccuuuacgcccagucuuccggcagaaucacuguaucaaccaaaaggagccaacaggcuguuauaccaaauauugggagucggccccgcaucagagauauuccuucuaggaucuccaucuacuggacaauugugaagccaggagacauauugcugauccacagcaccgguaaccuaauugccccgcggggcuauuuuaaaauccgcucggggaagucuuccauaaugcgaucagacgcgcccauuggaaaauguaagagugaaugcaucacgccuaauggcagcaucccaaacgauaagcccuuccagaaugucaacagaauuacuuacggugcauguccuagguaugugaaacacuccacacucaagcuggccaccgggaugcggaaugugccagagaaacagacucguggaaucuuuggcgcuauugccggcuucauagaaaacgggugggagggaauggucgacgguugguacggcuuucgccaucaaaauucugaggggagaggacaggcagcugaucuuaagagcacacaggccgcgaucgaccaaauuaacggcaaacugaauagguugaucgguaagaccaacgaaaaauuccaccagaucgagaaggaauuuucagagguugaagggcggauucaggaucucgagaaguauguggaggacacgaaaauagaucuguggaguuacaaugccgaauuacugguagcacucgagaaccagcauaccaucgaccuuacagauuccgaaaugaauaagcuguuugagaaaacuaagaaacaauugcgagaaaacgcugaggacaugggcaacggaugcuucaagauuuaucacaagugugauaaugccugcaucggcagcauucgcaacgggaccuacgaccacaauguguacagagacgaggcucuaaacaauagguuucagaucaaaggagucgaacugaagucugguuauaaagauuggauacucuggaucucauucgccauuaguugcuuucugcuuuguguggcacuguugggcuucaucaugugggccugccagaaggggaacauucgguguaauaucugcauauga

SEQ ID NO: 135562 - RNA, 1701 nt, Artificial Sequence
  derived and/or modified sequence opt3 from hemagglutinin__InfluenzaA__ALE32061
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaaguauacuuacccagcauuaaacgugaccaugcccaauaacgagcaguuugacaagcuguauauuuggggaguccaccauccuggcacagauaacgaccagaucuuccuuuacgccagaucuuccggcaggauaacugugucaaccaaagggagccagcaagcuguaauuccaaauaucggaagucggccccgcauuagagauaucccuucuaggaucuccauuuacuggacaauaguuaagccaggugacaucuugcugauuaacagcaccggcaaucuaaucgccccgcggggguauuuuaaaauacgcucgggaaagucuuccauuaugcgaucagacgcgcccaucggcaaauguaagagugaaugcaucacgccuaacgguagcauuccaaaugauaagcccuuccagaacgugaauagaaucacuuacggggcauguccuagguaugucaaacacuccacacucaagcuggccaccggaaugcggaacgugccagagaaacagacucguggcauuuuuggcgcuauagccggguucaucgaaaauggaugggaggguaugguggacggcugguacggguuucgccaccagaacucugagggaagaggccaagcagcugaucuuaagagcacacaggccgcgauugaccagaucaaugguaaacugaacagguugaucgggaagaccaaugaaaaauuccaucaaauugagaaggaauuuucagaggucgaaggccggauacaggaucucgagaaguauguugaggacacgaaaaucgaucuguggaguuacaacgccgaauuacugguggcacucgagaaucagcacaccauugaccuuacagauuccgaaaugaacaagcuguuugagaaaacuaagaaacaguugcgagaaaacgcugaggacaugggaaauggcugcuucaagaucuaucauaagugugauaacgccugcauugggagcauccgcaauggaaccuacgaccacaacguauacagagacgaggcucuaaauaacagguuucaaauaaaagguguggaacugaagucuggcuauaaagauuggauccucuggauuucauucgccaucaguugcuuucugcuuugugucgcacuguugggguucauuaugugggccugccagaagggaaauauccgguguaacauaugcauuuga

SEQ ID NO: 135563 - RNA, 1701 nt, Artificial Sequence
  derived and/or modified sequence opt3 from hemagglutinin__InfluenzaA__ALE32062
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuuauagcaccgguaaccuaaucgccccgcggggcuacuuuaaaauacgcucggggaagucuuccauuaugcgaucagacgcgcccaucggaaaauguaagagugaaugcaucacgccuaauggcagcauuccaaacgauaagcccuuccagaaugugaacagaaucacuuauggugcauguccuagguacgucaaacacuccacacucaagcuggccaccgggaugcggaaugugccagagaaacagacucguggaauuuuuggcgcuauagccggcuucaucgaaaacgggugggagggaaugguggacgguugguauggcuuucgccaccaaaauucugaggggagaggacaggcagcugaucuuaagagcacacaggccgcgauugaccaaaucaacggcaaacugaauagguugaucgguaagaccaacgaaaaauuccaucagauugagaaggaauuuucagaggucgaagggcggauacaggaucucgagaaguacguugaggacacgaaaaucgaucuguggaguuauaaugccgaauuacugguggcacucgagaaccagcacaccauugaccuuacagauuccgaaaugaauaagcuguuugagaaaacuaagaaacaauugcgagaaaacgcugaggacaugggcaacggaugcuucaagaucuaccauaagugugauaaugccugcauuggcagcauccgcaacgggaccuacgaccacaauguauauagagacgaggcucuaaacaauagguuucagauaaaaggaguggaacugaagucugguuacaaagauuggauccucuggauuucauucgccaucaguugcuuucugcuuugugucgcacuguugggcuucauuaugugggccugccagaaggggaacauccgguguaauauaugcauuuga

SEQ ID NO: 135564 - RNA, 1701 nt, Artificial Sequence; identical to SEQ ID NO: 134457
  derived and/or modified sequence opt3 from hemagglutinin__InfluenzaA__ALE32063

SEQ ID NO: 135565 - RNA, 1701 nt, Artificial Sequence
  derived and/or modified sequence opt3 from hemagglutinin__InfluenzaA__ALE32064
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccaauucauuuuucagucgucugaacuggcugacgcaucucaauuauacuuacccagcauuaaacgugaccaugcccaacaaugagcaguuugacaagcuguauauuuggggaguccaccauccuggcacagauaaggaccagaucuuccuuuacgcccagagcucuggcagaauaacuguguccaccaaaaggucacaacaggcuguaauuccaaacaucgggagccggccccgcauuagagauaucccuaguaggaucucuauuuacuggacaauaguuaagccaggagacaucuugcugauuaauuccaccgguaaccuaaucgccccgcggggcuauuuuaaaauacgcagcgggaagucgucuauuaugcgauccgacgcgcccaucggaaaauguaagucagaaugcaucacgccuaauggcaguauuccaaacgauaagcccuuccagaaugugaacagaaucacuuacggugcauguccuagguaugucaaacacagcacacucaagcuggccaccgggaugcggaaugugccagagaaacagacucguggaauuuuuggcgcuauagccggcuucaucgaaaacgggugggagggaaugguggacgguugguacggcuuucgccaccaaaauuccgaggggagaggacaggcagcugaucuuaagucuacacaggccgcgauugaccaaaucaacggcaaacugaauagguugaucgguaagaccaacgaaaaauuccaucagauugagaaggaguucagcgaagucgaagggcggauacaggaucucgagaaguauguugaggacacgaaaaucgaucuguggucauacaaugccgaauuacugguggcacucgagaaccagcacaccauugaccuuacagauagugaaaugaacaagcuguuugagaaaacuaagaaacaauugcgagaaaaugcugaggacaucggcaacggaugcuucaagauuuaucauaagugugauaaugccugcaucggcuccauacgcaacgggaccuacgaccacaauguauacagagacgaggcucuaaacaauagguuucagaucaaaggaguggaacucaagagcgguuauaaagauuggauucuguggaucucuuucgccauuucaugcuuucugcuuugugucgcacuguugggcuucaucaugugggccugccagaaggggaacauacgguguaauauuugcaucuga

SEQ ID NO: 135566 - RNA, 1701 nt, Artificial Sequence; identical to SEQ ID NO: 134457
  derived and/or modified sequence opt3 from hemagglutinin__InfluenzaA__ALE32065

SEQ ID NO: 135567 - RNA, 1701 nt, Artificial Sequence
  derived and/or modified sequence opt3 from hemagglutinin__InfluenzaA__ALE32066
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugucuaugcccaacaacgagcaguuugacaagcuguauauuuggggaguccaccauccuggcaccgauaaggaccagaucuuccuuuacgcccaguccucaggcagaauaacagugagcacuaaaaggagucaacaggcuguaauuccaaauaucgggucucggccccgcauuagagauaucccuuccaggaucagcauuuacuggaccauaguuaagccaggagacaucuugcugauuaacucgacagguaaucuaaucgccccgcggggcuauuuuaaaauacgcucugggaaguccucaauuaugcgaagugacgcgcccaucggaaaauguaagagcgaaugcaucaccccuaacggcuccauuccaaaugauaagcccuuccagaacgugaauagaaucacguacggugcauguccuagguaugucaaacacucuacucucaagcuggccacagggaugcggaacgugccagagaaacagacccguggaauuuuuggcgcuauagccggcuucaucgaaaaugggugggagggaaugguggacgguugguacggcuuucgccaccaaaacagcgaggggagaggacaggcagcugaucuuaagucaacucaggccgcgauugaccaaaucaauggcaaacugaacagguugaucgguaagacaaaugaaaaauuccaucagauugagaaggaauuuagugaggucgaagggcggauacaggaucucgagaaguauguugaggacaccaaaaucgaucugugguccuacaacgccgaauuacugguggcacucgagaaucagcacacgauugaccuuaccgauagcgaaaugaacaagcuguuugagaaaacaaagaaacaauugcgagaaaacgcugaggacaugggcaauggaugcuucaagaucuaucauaagugugauaacgccugcauuggcucuauccgcaaugggacuuacgaccacaacguauacagagacgaggcucuaaauaacagguuucagauaaaaggaguggaacugaagucagguuauaaagauuggauccucuggauuaguuucgccaucagcugcuuucugcuuugugucgcacuguugggcuucauuaugugggccugccagaaggggaauauccgguguaacauaugcauuuga

SEQ ID NO: 135568 - RNA, 1701 nt, Artificial Sequence; identical to SEQ ID NO: 135239
  derived and/or modified sequence opt3 from hemagglutinin__InfluenzaA__ALE32067

SEQ ID NO: 135569 - RNA, 1701 nt, Artificial Sequence; identical to SEQ ID NO: 134457
  derived and/or modified sequence opt3 from hemagglutinin__InfluenzaA__ALE32068

SEQ ID NO: 135570 - RNA, 1701 nt, Artificial Sequence; identical to SEQ ID NO: 134457
  derived and/or modified sequence opt3 from hemagglutinin__InfluenzaA__ALE32069

SEQ ID NO: 135571 - RNA, 1701 nt, Artificial Sequence
  derived and/or modified sequence opt3 from hemagglutinin__InfluenzaA__ALE32070
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugucuguccuagguaugugaaacacuccacacucaagcuggcaaccgggaugcggaacgugccagagaaacagacucguggaauuuuuggcgccauagcuggcuucaucgaaaaugggugggagggaauggucgacgguugguacggcuuucgccaccaaaacucugaggggagaggacaggccgcagaucuuaagagcacacaggcugccauugaccaaaucaauggcaaacugaacagguugaucgguaagaccaaugaaaaauuccaucagauugagaaggaauuuucagagguugaagggcggauacaggaucucgagaaguauguggaggacacgaaaaucgaucuguggaguuacaacgcggaauuacugguagcccucgagaaucagcacaccauugaccuuacagauuccgaaaugaacaagcuguuugagaaaacuaagaaacaauugcgagaaaacgcagaggacaugggcaauggaugcuucaagaucuaucauaagugugauaacgcuugcauuggcagcauccgcaaugggaccuacgaccacaacguguacagagacgaggcccuaaauaacagguuucagauaaaaggagucgaacugaagucugguuauaaagauuggauccucuggauuucauucgcuaucaguugcuuucugcuuuguguggcccuguugggcuucauuaugugggcaugccagaaggggaauauccgguguaacauaugcauuuga

SEQ ID NO: 135572 - RNA, 1701 nt, Artificial Sequence; identical to SEQ ID NO: 134457
  derived and/or modified sequence opt3 from hemagglutinin__InfluenzaA__ALE32071

SEQ ID NO: 135573 - RNA, 1701 nt, Artificial Sequence; identical to SEQ ID NO: 135454
  derived and/or modified sequence opt3 from hemagglutinin__InfluenzaA__ALE32072

SEQ ID NO: 135574 - RNA, 1701 nt, Artificial Sequence
  derived and/or modified sequence opt3 from hemagglutinin__InfluenzaA__ALE32073
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuauacuuacccagcauuaaaugugaccaugcccaacaacgagcaguuugacaagcuguauauuuggggaguccaccauccuggcacagauaaagaccagaucuuccuuuacgcccagucuuccggccguauaacugugucaaccaagagaagccaacaggcuguaauuccaaauaucgggaguaggccccggauucgcgauaucccuucuagaaucuccauuuacuggacaauaguuaaaccaggagacaucuugcugauuaacagcaccgguaaucuaaucgccccgaggggcuauuuuaagauacucucggggaaaucuuccauuaugcggucagacgcgcccaucggaaaguguaagagugaaugcaucacgccuaacggcagcauuccaaaugauaaacccuuccagaacgugaaucgcaucacuuacggugcauguccucgauaugucaagcacuccacacugaaacuugccaccgggaugagaaacgugccagagaagcagacuaggggaauuuuuggcgcuauagccggcuucaucgaaaaugggugggagggaaugguggacgguugguacggcuuucggcaccaaaacucugaggggcguggacaggcagcugaucugaaaagcacacaggccgcgauugaccaaaucaauggcaaguugaaccgccucaucgguaaaaccaaugaaaaguuccaucagauugagaaggaauuuucagaggucgaagggagaauacaggaucuggagaaauauguugaggacacgaagaucgauuuauggaguuacaacgccgaacugcucguggcacuugagaaucagcacaccauugaccugacagauuccgaaaugaacaaauuguuugagaagacuaaaaagcaacuaagggaaaacgcugaggacaugggcaauggaugcuucaagaucuaucauaaaugugauaacgccugcauuggcagcauccggaaugggaccuacgaccacaacguauaccgagacgaggcucugaauaaccgcuuucagauaaagggaguggaacucaaaucugguuauaaggauuggauccuguggauuucauucgccaucaguugcuuucuucugugugucgcauugcucggcuucauuaugugggccugccagaaagggaauaucagauguaacauaugcauuuga

SEQ ID NO: 135575 - RNA, 1701 nt, Artificial Sequence
  derived and/or modified sequence opt3 from hemagglutinin__InfluenzaA__ALE32074
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucuagcugcauccgccgauccucaaguagcuuuuucucucgucugaauuggcugacgcaucucaacuauacuuacccagcuuuaaaugugaccaugcccaacaacgagcaguuugacaagcuguauauuuggggaguccaccauccuggcacagauaaggaccagaucuuccuuuacgcacaguccucaggcagaauaacugugagcaccaaaaggagucaacaggccguaauuccaaauaucgggucucggccccgcauuagagauaucccuuccaggaucagcauuuacuggacaauaguuaagccaggagacaucuugcugauuaacucgaccgguaaucuaaucgcuccgcggggcuauuuuaaaauacucucugggaaguccucaauuaugcgcagugacgcccccaucggaaaauguaagagcgaaugcaucacgccuaacggcuccauuccaaaugauaagcccuuccagaacgugaaucgaaucacuuacggugcguguccuagauaugucaaacacucuacacugaaacuugcaaccgggaugaggaacgugccagagaagcagacucggggaauuuuuggcgccauagcuggcuucaucgaaaaugggugggagggaaugguggacgguugguacggcuuucgucaccaaaacagcgaggggcgcggacaggccgcagaucugaagucaacacaggcugccauugaccaaaucaauggcaaauugaacagacucaucgguaagaccaaugaaaaauuccaucagauugagaaggaguucagugaagucgaagggaggauacaggaucuggagaaguauguugaggacacgaaaaucgauuuaugguccuacaacgcggaacugcucguggcccuugagaaucagcacaccauugaccugacagauagcgaaaugaacaaguuguuugagaaaacuaagaaacaacuacgggaaaacgcagaggacaugggcaauggaugcuucaagaucuaucauaagugugauaacgcuugcauuggcucuauccgaaaugggaccuacgaccacaacguauaccgcgacgaggcccugaauaacagauuucagauaaaaggaguggaacucaagucagguuauaaagauuggauccuguggauuaguuucgcuaucagcugcuuucuucugugugucgccuugcucggcuucauuaugugggcaugccagaaggggaauaucagguguaacauaugcauuuga

SEQ ID NO: 135576 - RNA, 1701 nt, Artificial Sequence
  derived and/or modified sequence opt3 from hemagglutinin__InfluenzaA__ALE32075
augaagaccaucauugcccugagcuacauacucugccuuguguucgcucagaaacugcccgagaacgacaauuccacagcaacuuuguguuuaggccaccaugccgucccuaacgggacgaucguuaagaccauuacaucugauagaaucgaagugacuaaugcgaccgagcugguacaaaacucaaguauuggagaaaucugcgacagcccacaccagauacuagaugguaaaaauuguacacucaucgacgcucugcuuggcgauccgcagugcgacggguuucagaacaagaaaugggaucuguucguggagagguccaaggccuauucuaauuguuaccccuaugacgucccugauuacgcaucguugcggucacucguggccagcaguggaacccuggaauuuaacgacgaguccuucaauugggcuggcguuacucaaaacgguacaucuagcuccugcauucgcgggucaaauaguagcuuuuucucucgacugaacuggcucacccauuccaauuuuaaguauccagcauuaaacgugacgaugcccaauaacgagcaguucgauaaacuguacaucuggggaguccaccauccuggcacugacaaggaucagauuuuucuuuaugcccagucaagcggccguaucaccgugaguacaaaaagaucucaacaggcuguaauaccaaacauuggguccaggccccggauccgcaauauuccuagcagaaucucgaucuacuggacuauuguuaagccaggagacauauugcugaucaacucuaccgguaaucuaauugccccgaggggcuacuucaaaauccgguccgggaagucaaguauaaugcgcagcgacgcgcccauuggaaaguguaaauccgaaugcaucacaccuaacggcucuaucccaaaugauaagcccuuucagaacgugaaucgaauuaccuauggugcauguccuagauacgucaaacagagcacgcucaagcuggccacugggaugaggaacgugccagagaaacaaacacggggaaucuucggcgcuauugccggcuuuauagaaaaugggugggagggaaugaaggacgguugguauggcuuccgucaccagaacucagaggggcgcggacaggcagcugaucuuaaaaguacccaagccgcgaucgaccagauuaauggcaagcugaacagauugaucgguaagacuaaugaaaaauuccaccagaucgagaaggaauuuuccgagguggaagggaggauucaggaucucgagaaauacgucgaggacacaaagauagaucuguggagcuauaacgccgaauuacugguugcacucgagaaucaacauaccaucgaccuuacggauucugaaaugaacaaacuguucgagaagaccaagaaacaguugcgggaaaacgcugaggacaugggcaauggaugcuuuaagauuuaccacaaaugugauaacgccugcaucggcucaauucgaaaugggacauaugaccaugacguguaccgcgaugaggcucuaaacaauagauuccagaucaagggaguagaacugaaaagugguuacaaggacuggauacucuggaucagcuuugccauuuccugcuuccugcuuuguguggcacuguugggcuuuaucaugugggccugccagaaggggaacauuagguguaauaucugcauauga

SEQ ID NO: 135577 - RNA, 1701 nt, Artificial Sequence; identical to SEQ ID NO: 135014
  derived and/or modified sequence opt3 from hemagglutinin__InfluenzaA__ALE32076

SEQ ID NO: 135578 - RNA, 1701 nt, Artificial Sequence
  derived and/or modified sequence opt3 from hemagglutinin__InfluenzaA__ALE32077
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagcccauuccaacuguuaucccuacgacgucccugauuaugcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaccucaacuacacuuauccagcauuaaaugugaccaugcccaacaacgagcaguuugacaagcuguacauuuggggaguccaucacccuggcacagauaaggaccagaucuuccuuuaugccagaucuuccggcaggauaacugugucaaccaaagggagccagcaagcuguaauuccaaauaucggaagucggccccgcauuagagauaucccuucuaggaucuccauuuacuggacaauaguuaagccaggugacaucuugcugauuaacagcaccggcaaucuaaucgccccgcggggguacuuuaaaauacgcucgggaaagucuuccauuaugcgaucagacgcgcccaucggcaaauguaagagugaaugcaucacgccuaacgguagcauuccaaaugauaagcccuuccagaacgugaauagaaucacuuauggggcauguccuagguacgucaaacacuccacacucaagcuggccaccggaaugcggaacgugccagagaaacagacucguggcauuuuuggcgcuauagccggguucaucgaaaauggaugggaggguaugguggacggcugguauggguuucgccaucagaacucugagggaagaggccaagcagcugaucuuaagagcacacaggccgcgauugaccagaucaaugguaaacugaacagguugaucgggaagaccaaugaaaaauuccaccaaauugagaaggaauuuucagaggucgaaggccggauacaggaucucgagaaguacguugaggacacgaaaaucgaucuguggaguuauaacgccgaauuacugguggcacucgagaaucagcauaccauugaccuuacagauuccgaaaugaacaagcuguuugagaaaacuaagaaacaguugcgagaaaacgcugaggacaugggaaauggcugcuucaagaucuaccacaagugugauaacgccugcauugggagcauccgcaauggaaccuaugaccacaacguauacagagacgaggcucuaaauaacagguuucaaauaaaagguguggaacugaagucuggcuacaaagauuggauccucuggauuucauucgccaucaguugcuuucugcuuugugucgcacuguugggguucauuaugugggccugccagaagggaaauauccgguguaacauaugcauuuga

SEQ ID NO: 135579 - RNA, 1701 nt, Artificial Sequence; identical to SEQ ID NO: 135115
  derived and/or modified sequence opt3 from hemagglutinin__InfluenzaA__ALE32078

SEQ ID NO: 135580 - RNA, 1701 nt, Artificial Sequence; identical to SEQ ID NO: 135001
  derived and/or modified sequence opt3 from hemagglutinin__InfluenzaA__ALE32079

SEQ ID NO: 135581 - RNA, 1701 nt, Artificial Sequence
  derived and/or modified sequence opt3 from hemagglutinin__InfluenzaA__ALE32080
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucuagcugcauccgccgauccucaaguagcuuuuucucucgucugaauuggcugacgcaucucaacuauacuuacccagcuuuaaaugugaccaugcccaacaacgagcaguuugacaagcuguauauuuggggaguccaccauccuggcacagauaaggaccagaucuuccuuuacgcacaguccucaggcagaauaacugugagcaccaaaaggagucaacaggccguaauuccaaauaucgggucucggccccgcauuagagauaucccuuccaggaucagcauuuacuggacaauaguuaagccaggagacaucuugcugauuaacucgaccgguaaucuaaucgcuccgcggggcuauuuuaaaauacgcucugggaaguccucaauuaugcgaagugacgcccccaucggaaaauguaagagcgaaugcaucacgccuaacggcuccauuccaaaugauaagcccuuccagaacgugaauagaaucacuuacggugcguguccuagguaugucaaacacucuacacucaagcuggcaaccgggaugcggaacgugccagagaaacagacucguggaauuuuuggcgccauagcuggcuucaucgaaaaugggugggagggaaugguggacgguugguacggcuuucgccaccaaaacagcgaggggagaggacaggccgcagaucuuaagucaacacaggcugccauugaccaaaucaauggcaaacugaacagguugaucgguaagaccaaugaaaaauuccaucagauugagaaggaguucagugaagucgaagggcggauacaggaucucgagaaguauguugaggacacgaaaaucgaucugugguccuacaacgcggaauuacugguggcccucgagaaucagcacaccauugaccuuacagauagcgaaaugaacaagcuguuugagaaaacuaagaaacaauugcgagaaaacgcagaggacaugggcaauggaugcuucaagaucuaucauaagugugauaacgcuugcauuggcucuauccgcaaugggaccuacgaccacaacguauacagagacgaggcccuaaauaacagguuucagauaaaaggaguggaacugaagucagguuauaaagauuggauccucuggauuaguuucgcuaucagcugcuuucugcuuugugucgcccuguugggcuucauuaugugggcaugccagaaggggaauauccgguguaacauaugcauuuga

SEQ ID NO: 135582 - RNA, 1701 nt, Artificial Sequence; identical to SEQ ID NO: 135115
  derived and/or modified sequence opt3 from hemagglutinin__InfluenzaA__ALE32081

SEQ ID NO: 135583 - RNA, 1701 nt, Artificial Sequence; identical to SEQ ID NO: 135115
  derived and/or modified sequence opt3 from hemagglutinin__InfluenzaA__ALE32082

SEQ ID NO: 135584 - RNA, 1701 nt, Artificial Sequence
  derived and/or modified sequence opt3 from hemagglutinin__InfluenzaA__ALE32083
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauaaguacccagcauuaaaugugacuaugcccaacaacgagcaguuugacaagcuguauauuuggggaguccaccauccuggcaccgauaaagaccagaucuuccuuuacgccagaucuuccggcaggauaacagugucaacuaaggggagccagcaagcuguaauuccaaauaucggaagucggccccgcauuagagauaucccuucuaggaucuccauuuacuggaccauaguuaaaccaggugacaucuugcugauuaacagcacaggcaaucuaaucgccccgcggggguauuuuaagauacgcucgggaaaaucuuccauuaugcgaucagacgcgcccaucggcaaguguaagagugaaugcaucaccccuaacgguagcauuccaaaugauaaacccuuccagaacgugaauagaaucacguacggggcauguccuagguaugucaagcacuccacucucaaacuggccacaggaaugcggaacgugccagagaagcagacccguggcauuuuuggcgcuauagccggguucaucgaaaauggaugggaggguaugguggacggcugguacggguuucgccaccagaacucugagggaagaggccaagcagcugaucuuaaaagcacucaggccgcgauugaccagaucaaugguaagcugaacagguugaucgggaaaacaaaugaaaaguuccaucaaauugagaaggaauuuucagaggucgaaggccggauacaggaucucgagaaauauguugaggacaccaagaucgaucuguggaguuacaacgccgaauuacugguggcacucgagaaucagcacacgauugaccuuaccgauuccgaaaugaacaaacuguuugagcgaacaaagaaacaguugcgcgaaaacgcugaggacaugggaaauggcugcuucaagaucuaucauaagugugauaacgccugcauugggagcaucagaaauggaacuuacgaccacaacguauacagggacgaggcucuaaauaaccgguuucaaauaaaagguguggaacugaagucuggcuauaaagauuggauccucuggauuucauucgccaucaguugcuuucugcuuugugucgcacuguugggguucauuaugugggccugccagaagggaaauauccgcuguaacauaugcauuuga

SEQ ID NO: 135585 - RNA, 1701 nt, Artificial Sequence; identical to SEQ ID NO: 135072
  derived and/or modified sequence opt3 from hemagglutinin__InfluenzaA__ALE32084

SEQ ID NO: 135586 - RNA, 1701 nt, Artificial Sequence; identical to SEQ ID NO: 135115
  derived and/or modified sequence opt3 from hemagglutinin__InfluenzaA__ALE32085

SEQ ID NO: 135587 - RNA, 1701 nt, Artificial Sequence
  derived and/or modified sequence opt3 from hemagglutinin__InfluenzaA__ALE32086
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuauacuuacccagcauuaaaugugaccaugcccaacaacgagcaguuugacaagcuguauauuuggggaguccaccauccuggcacagauaaagaccagaucuuccuuuacgcccguucuuccggcagaauaacugugucaaccaagaggagccagcaagcuguaauuccaaauaucgggagucggccccgcauuagagauaucccuucuaggaucuccauuuacuggacaauaguuaaaccaggagacaucuugcugauuaacagcaccgguaaucuaaucgccccgcggggcuauuuuaagauacgcucggggaaaucuuccauuaugcgaucagacgcgcccaucaguaaguguaagagcgaaugcaucacgccuaacggauccauuccaaaugauaaacccuuccagaacgugaauagaaucacuuacggcgcauguccuagguaugucaagcacucuacacucaaacuggccaccgguaugcggaacgugccagagaagcagacucgugggauuuuuggagcuauagccggcuucaucgaaaauggcugggaggggaugguggacggaugguacgguuuucgccaccagaacagcgagggcagagggcaagcagcugaucuuaaaucaacacaggccgcgauugaccagaucaauggaaagcugaacagguugaucggcaaaaccaaugaaaaguuccaucaaauugagaaggaauuuagugaggucgaaggucggauacaggaucucgagaaauauguugaggacacgaagaucgaucugugguccuacaacgccgaauuacugguggcacucgagaaucagcacaccauugaccuuacagauagcgaaaugaacaaacuguuugagaagacuaaaaagcaguugcgagaaaacgcugaggacauggggaauggcugcuucaagaucuaucauaaaugugauaacgccugcauuggaucuauccgcaauggcaccuacgaccacaacguauacagagacgaggcucuaaauaacagguuucaaauaaaggggguggaacugaaaucaggauauaaggauuggauccucuggauuaguuucgccaucagcugcuuucugcuuugugucgcacuguuggguuucauuaugugggccugccagaaaggcaauauccgguguaacauaugcauuuga

SEQ ID NO: 135588 - RNA, 1701 nt, Artificial Sequence
  derived and/or modified sequence opt3 from hemagglutinin__InfluenzaA__ALE32087
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucgacuauacuuacccagcauuaaacgugaccaugcccaauaacgagcaguuugauaagcuguauauuuggggaguccaccauccuggcacagacaaagaucagaucuuccuuuacgcccguucuuccggcagaauaacugugucaaccaagaggagccagcaagcuguaauuccaaacaucgggagucggccccgcauuagagacaucccuucuaggaucuccauuuacuggacaauaguuaaaccaggagacaucuugcugauuaauagcaccgguaaccuaaucgccccgcggggcuauuuuaagauacgcucggggaaaucuuccauuaugcgaucagaugcgcccaucggaaaguguaagagugaaugcaucacgccuaauggcagcauuccaaacgacaaacccuuccagaaugugaacagaaucacuuacggugcauguccuagguaugucaagcacuccacacucaaacuggccaccgggaugcggaaugugccagagaagcagacucguggaauuuuuggcgcuauagccggcuucaucgaaaacgggugggagggaaugguggaugguugguacggcuuucgccaccaaaauucugaggggagaggacaggcagcugaccuuaaaagcacacaggccgcgauugaucagaucaacggcaaucugaacagguugaucgguaagaccaaugaaaaauuccaucaaauugagaaggaauuuucagaggucgaagggcggauacaggaccucgagaaguauguugaggauacgaaaaucgaccuguggaguuacaacgccgaauuacugguggcacucgagaaucagcacaccauugaucuuacagacuccgaaaugaacaagcuguuugagaaaacuaagaaacaguugcgagaaaacgcugaggauaugggcaauggaugcuucaagaucuaucauaagugugacaacgccugcauuggcagcauccgcaaugggaccuacgaccacaacguauacagagaugaggcucuaaauaacagguuucaaauaaaaggaguggaacugaagucugguuauaaagacuggauccucuggauuucauucgccaucaguugcuuucugcuuugugucgcacuguugggcuucauuaugugggccugccagaaggggaauauccgguguaacauaugcauuuga

SEQ ID NO: 135589 - RNA, 1701 nt, Artificial Sequence
  derived and/or modified sequence opt3 from hemagglutinin__InfluenzaA__ALE32088
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuauacuuacccagcauuaaaugugaccaugcccaacaacgagcaguuugacaagcuguauauuuggggaguccuucacccuggcacagauaaagaccagaucuucuuguacgcccguucuuccggcagaauaacugugucaaccaagaggagccagcaagcuguaauuccaaauaucgggagucggccccgcauuagagauaucccuucuaggaucuccauuuacuggacaauaguuaaaccaggagacauccugcuaauuaacagcaccgguaaucucaucgccccgcggggcuauuuuaagauacgcucggggaaaucuuccauuaugcgaucagacgcgcccaucggaaaguguaagagugaaugcaucacgccuaacggcagcauuccaaaugauaaacccuuccagaacgugaauagaaucacuuacggugcauguccuagguaugucaagcauuccacacugaaacuugccaccgggaugcggaacgugccagagaagcagacucguggaauuuuuggcgcuauagccggcuucaucgaaaaugggugggagggaaugguggacgguugguacggcuuucgccaccagaacucugaggggagaggacaagcagcugaucugaaaagcacacaggccgcgauugaccagaucaauggcaaguugaacaggcucaucgguaaaaccaaugaaaaguuccaccaaauugagaaggaauuuucagaggucgaagggcggauacaggaucuggagaaauauguugaggacacgaagaucgauuuauggaguuacaacgccgaacugcucguggcacuugagaaucagcauaccguagaccugacagauuccgaaaugaacaaauuguuugagaagacuaaaaagcagcuacgagaaaacgcugaggacaugggcaauggaugcuucaagauuuaucacaaaugugauaacgccugcaucggcagcauucgcaaugggaccuacgaccauaacguguacagagacgaggcucugaauaacagguuucaaaucaagggagucgaacucaaaucugguuauaaggauuggauacuguggaucucauucgccauuaguugcuuucuucuguguguggcauugcucggcuucaucaugugggccugccagaaagggaauauucgguguaacaucugcauauga

SEQ ID NO: 135590 - RNA, 1701 nt, Artificial Sequence; identical to SEQ ID NO: 134457
  derived and/or modified sequence opt3 from hemagglutinin__InfluenzaA__ALE32089

SEQ ID NO: 135591 - RNA, 1701 nt, Artificial Sequence; identical to SEQ ID NO: 134457
  derived and/or modified sequence opt3 from hemagglutinin__InfluenzaA__ALE32090

SEQ ID NO: 135592 - RNA, 1701 nt, Artificial Sequence; identical to SEQ ID NO: 134457
  derived and/or modified sequence opt3 from hemagglutinin__InfluenzaA__ALE32091

SEQ ID NO: 135593 - RNA, 1701 nt, Artificial Sequence
  derived and/or modified sequence opt3 from hemagglutinin__InfluenzaA__ALE32092
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguagaagugaaugcaucacgccuaacggcagcauuccaaaugauaagcccuuccagaacgugaauaggaucacuuacggugcauguccucgguaugucaagcacuccacacucaaacuggccaccgggaugcguaacgugccagagaagcagacucgcggaauuuuuggcgcuauagccggcuucaucgaaaaugggugggagggaaugguggacgguugguacggcuuuagacaccaaaacucugaggggaggggacaggcagcugaucuuaaaagcacacaggccgcgauugaccaaaucaauggcaagcugaaccgguugaucgguaaaaccaaugaaaaguuccaucagauugagaaagaauuuucagaggucgaagggcgaauacaggaucucgagaaguauguugaggacacgaagaucgaucuguggaguuacaacgccgaauuacugguggcacucgagaaucagcacaccauugaccuuacagauuccgaaaugaacaaacuguuugagaagacuaaaaagcaauugcgcgaaaacgcugaggacaugggcaauggaugcuucaaaaucuaucauaagugugauaacgccugcauuggcagcaucagaaaugggaccuacgagcacaacguauacagggacgaagcucuaaauaaccgguuucagauaaagggaguggagcugaaaucugguuauaaggacuggauccucuggauuucauucgccaucaguugcuuucugcuuugugucgcacuguugggcuucauuaugugggccugccagaaagggaauauccgcuguaacauaugcauuuga

SEQ ID NO: 135594 - RNA, 1701 nt, Artificial Sequence; identical to SEQ ID NO: 135063
  derived and/or modified sequence opt3 from hemagglutinin__InfluenzaA__ALE32093

SEQ ID NO: 135595 - RNA, 1701 nt, Artificial Sequence
  derived and/or modified sequence opt3 from hemagglutinin__InfluenzaA__ALE32094
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaccagcacggguaaccuaaucgccccgcggggcuauuuuaaaauacgcucggggaagucuuccauuaugcgaucagacgcgcccaucggaaaauguaagagugaaugcaucacuccuaauggcagcauuccaaacgauaagcccuuccagaaugugaacagaaucacauacggugcauguccuagguaugucaaacacuccacccucaagcuggccacugggaugcggaaugugccagagaaacagacacguggaauuuuuggcgcuauagccggcuucaucgaaaacgggugggagggaaugguggacgguugguacggcuuucgccaccaaaauucugaggggagaggacaggcagcugaucuuaagagcacccaggccgcgauugaccaaaucaacggcaaacugaauagguugaucgguaagacgaacgaaaaauuccaucagauugagaaggaauuuucagaggucgaagggcggauacaggaucucgagaaguauguugaggacaccaaaaucgaucuguggaguuacaaugccgaauuacugguggcacucgagaaccagcacacaauugaccuuacugauuccgaaaugaauaagcuguuugagaaaaccaagaaacaauugcgagaaaacgcugaggacaugggcaacggaugcuucaagaucuaucauaagugugauaaugccugcauuggcagcauccgcaacgggacauacgaccacaauguauacagagacgaggcucuaaacaauagguuucagauaaaaggaguggaacugaagucugguuauaaagauuggauccucuggauuucauucgccaucaguugcuuucugcuuugugucgcacuguugggcuucauuaugugggccugccagaaggggaacauccgguguaauauaugcauuuga

SEQ ID NO: 135596 - RNA, 1701 nt, Artificial Sequence; identical to SEQ ID NO: 134457
  derived and/or modified sequence opt3 from hemagglutinin__InfluenzaA__ALE32095

SEQ ID NO: 135597 - RNA, 1701 nt, Artificial Sequence
  derived and/or modified sequence opt3 from hemagglutinin__InfluenzaA__ALE32096
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucucuuauacuuacccagcauuaaacgugaccaugcccaauaacgagcaguuugacaagcuguauauuuggggaguccaccauccuggcacagauaaggaccagaucuuccuuuacgcccaguccucaggcagaauaacugugagcaccaaaaggagucaacaggcuguaauuccaaacaucgggucucggccccgcauuagagauaucccuuccaggaucagcauuuacuggacaauaguuaagccaggagacaucuugcugauuaauucgaccgguaaccuaaucgccccgcggggcuauuuuaaaauacgcucugggaaguccucaauuaugcgaagugacgcgcccaucggaaaauguaagagcgaaugcaucacgccuaauggcuccauuccaaacgauaagcccuuccagaaugugaacagaaucacuuacggugcauguccuagguaugucaaacacucuacacucaagcuggccaccgggaugcggaaugugccagagaaacagacucguggaauuuuuggcgcuauagccggcuucaucgaaaacgggugggagggaaugguggacgguugguacggcuuucgccaccaaaauagcgaggggagaggacaggcagcugaucuuaagucaacacaggccgcgauugaccaaaucaacggcaaacugaauagguugaucgguaagaccaacgaaaaauuccaucagauugagaaggaauuuagugaggucgaagggcggauacaggaucucgagaaguauguugaggacacgaaaaucgaucugugguccuacaaugccgaauuacugguggcacucgagaaccagcacaccauugaccuuacagauagcgaaaugaauaagcuguuugagaaaacuaagaaacaauugcgagaaaacgcugaggacaugggcaacggaugcuucaagaucuaucauaagugugauaaugccugcauuggcucuauccgcaacgggaccuacgaccacaauguauacagagacgaggcucuaaacaauagguuucagauaaaaggaguggaacugaagucagguuauaaagauuggauccucuggauuaguuucgccaucagcugcuuucugcuuugugucgcacuguugggcuucauuaugugggccugccagaaggggaacauccgguguaauauaugcauuuga

SEQ ID NO: 135598 - RNA, 1701 nt, Artificial Sequence; identical to SEQ ID NO: 134457
  derived and/or modified sequence opt3 from hemagglutinin__InfluenzaA__ALE32097

SEQ ID NO: 135599 - RNA, 1701 nt, Artificial Sequence; identical to SEQ ID NO: 135063
  derived and/or modified sequence opt3 from hemagglutinin__InfluenzaA__ALE32099

SEQ ID NO: 135600 - RNA, 1701 nt, Artificial Sequence
  derived and/or modified sequence opt3 from hemagglutinin__InfluenzaA__ALE32100
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacucaagcuggccaccgggaugcggaacgugccagagaaacagacucguggaauuuuuggcgcuauagccggcuucaucgaaaaugggugggagggaaugguggacgguugguacggcuuucgccaccaaaacucugaggggagaggacaggcagcugaucuuaagagcacacaggccgcgauugaccaaaucaauggcaaacugaacagguugaucgguaagaccaaugaaaaauuccaucagauugagaaggaauuuucagaggucgaagggcggauacaggaucucgagaaguauguugaggacacgaaaaucgaucuguggaguuacaacgccgacuuacugguggcacucgaaaaucagcacaccauugaucuuacagacuccgagaugaacaagcuguuugagaaaacuaagaaacaauugcgagaaaacgcugaagauaugggcaauggaugcuucaagaucuaucauaagugugacaacgccugcauuggcagcauccgcaaugggaccuacgaccacaacguauacagagaugaggcucuaaauaacagguuucagauaaaaggaguggagcugaagucugguuauaaagacuggauccucuggauuucauucgccaucaguugcuuucugcuuugugucgcacuguugggcuucauuaugugggccugccagaaggggaauauccgguguaacauaugcauuuga

SEQ ID NO: 135601 - RNA, 1701 nt, Artificial Sequence
  derived and/or modified sequence opt3 from hemagglutinin__InfluenzaA__ALE32101
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauucccaauguuaccccuaugacgucccugauuacgcaucucugcggucguugguggccucaagcggcacccucgaauuuaacaaugagaguuucaacuggacugguguuacacagaaugggaccuccucugcuugcauccgcaagagcuccggaucauuuuucagucgacugaacuggcugacgcaucucaaguauacuuacccagcauuaaaugugaccaugcccaacaaugagcaguuugacaaacuguauauuuggggcguccaccauccuggcacagauaaggaccagaucuuccuuuacgcccguagcucugggagaauaacuguguccaccaaaaggucacaacaggcuguaauuccaaacaucggaagccggccccgcauuagagauaucccuaguaggaucucuauuuacuggacaauaguuaagccaggugacaucuugcugauuaacuccaccggcaaucuaaucgccccgcggggguauuuuaaaauacgcagcggaaagucgucuauuaugcgauccgacgcgcccaucggcaaguguaaaucagaaugcaucacgccuaacgguaguauuccaaaugauaagcccuuccagaacgugaauagaaucacuuacggggcauguccuagguaugucaaacacagcacacucaagcuggccaccggaaugcggaacgugccagagaaacagacucguggcauuuuuggcgcuauagccggguucaucgaaaauggaugggaggguaugguggacggcugguacggguuucgccaccaaaacuccgagggaagaggccaggcagcugaucuuaagucuacacaggccgcgauugaccaaaucaaugguaaacugaacagguugaucgggaagaccaaugaaaaguuccaucagauugagaaagaguucagcgaagucgaaggccggauacaggaucucgagaaguauguugaggacacgaaaaucgaucuguggucauacaacgccgaauuacugguggcacucgagaaucagcacaccauugaccuuacagauagugaaaugaacaagcuguuugagaaaacuaagaagcaauugcgagaaaaugcugaggacaugggaaacggcugcuucaaaaucuaucauaagugugauaacgccugcauuggguccauccgcaauggaaccuacgaccacaacguauacagagacgaggcucuaaauaacagguuucagauaaaagguguggaacucaagagcggcuauaaagauuggauccuguggauuucuuucgccaucucaugcuuucugcuuugugucgcacuguugggguucauuaugugggccugccagaagggaaauauccgguguaacauaugcauuuga

SEQ ID NO: 135602 - RNA, 1701 nt, Artificial Sequence
  derived and/or modified sequence opt3 from hemagglutinin__InfluenzaA__ALE32102
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaaguauacuuacccagcauuaaacgugaccaugcccaauaacgagcaguuugacaaacuguauauuuggggaguccaccauccuggcacagauaaggaccagaucuuccuuuacgcccguucuuccggcagaauaacugugucaaccaaaaggagccagcaagcuguaauuccaaacaucgggagucggccccgcauuagagauaucccuucuaggaucuccauuuacuggacaauaguuaagccaggagacaucuugcugauuaauagcaccgguaaccuaaucgccccgcggggcuauuuuaaaauacgcucggggaagucuuccauuaugcgaucagacgcgcccaucggaaaguguaaaagugaaugcaucacgccuaauggcagcauuccaaacgauaagcccuuccagaaugugaacagaaucacuuacggugcauguccuagguaugucaaacacuccacacucaagcuggccaccgggaugcggaaugugccagagaaacagacucguggaauuuuuggcgcuauagccggcuucaucgaaaacgggugggagggaaugguggacgguugguacggcuuucgccaccaaaauucugaggggagaggacaggcagcugaucuuaagagcacacaggccgcgauugaccagaucaacggcaaacugaauagguugaucgguaagaccaacgaaaaguuccaucaaauugagaaagaauuuucagaggucgaagggcggauacaggaucucgagaaguauguugaggacacgaaaaucgaucuguggaguuacaaugccgaauuacugguggcacucgagaaccagcacaccauugaccuuacagauuccgaaaugaauaagcuguuugagaaaacuaagaagcaguugcgagaaaacgcugaggacaugggcaacggaugcuucaaaaucuaucauaagugugauaaugccugcauuggcagcauccgcaacgggaccuacgaccacaauguauacagagacgaggcucuaucuaacagguuucaaauaaaaggaguggaacugaagucagguuauaaagauuggauccucuggauuaguuucgccaucagcugcuuucugcuuugugucgcacuguugggcuucauuaugugggccugccagaaggggaauauccgguguaacauaugcauuuga

SEQ ID NO: 135603 - RNA, 1701 nt, Artificial Sequence; identical to SEQ ID NO: 135170
  derived and/or modified sequence opt3 from hemagglutinin__InfluenzaA__ALE32103

SEQ ID NO: 135604 - RNA, 1701 nt, Artificial Sequence
  derived and/or modified sequence opt3 from hemagglutinin__InfluenzaA__ALE32104
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagagaagcaaagccuauuccaacuguuaccccuaugacgucccugauuacgcaucucugaggucguugguggccucaagcggcacccucgaauuuaauaacgagaguuucaauuggacugguguuacacagaacgggaccuccucugcuugcauccggcgcagcuccucaaguuucuucagccgacugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccaaucuuccggccguauaacugugucaaccaaaagaagccagcaggcuguaauuccaaauaucgggaguaggccccggauucgcgauaucccuucuagaaucuccauuuacuggacaauaguuaagccaggagacaucuugcugauuaacagcaccgguaaucuaaucgccccgaggggcuauuuuaaaauacggucggggaagucuuccauuaugcgcucagacgcgcccaucggaaaauguaagagugaaugcaucacgccuaacggcagcauuccaaaugauaagcccuuccagaacgugaaucgaaucacuuacggugcauguccuagauaugucaaacacuccacacucaagcuggccaccgggaugaggaacgugccagagaaacaaacucggggaauuuuuggcgcuauagccggcuucaucgaaaaugggugggagggaaugguggacgguugguacggcuuucgucaccagaacucugaggggcgcggacaggcagcugaucuuaagagcacacaagccgcgauugaccagaucaauggcaaacugaacagauugaucgguaagaccaaugaaaaauuccaucagauugagaaggaauuuucagaggucgaagggaggauacaggaucucgagaaguauguugaggacacgaaaaucgaucuguggaguuacaacgccgaauuacugguggcacucgagaaucaacacaccauugaccuuacagauuccgaaaugaacaagcuguuugagaaaacuaagaaacaguugcgggaaaacgcugaggacaugggcaauggaugcuucaagaucuaucauaagugugauaacgccugcauuggcagcauccgaaaugggaccuacgaccacaacguauaccgcgacgaggcucuaaauaacagauuucagauaaaaggaguggaacugaagucugguuauaaagauuggauccucuggauuucauucgccaucaguugcuuucugcuuugugucgcacuguugggcuucauuaugugggccugccagaaggggaauaucagguguaacauaugcauuuga

SEQ ID NO: 135605 - RNA, 1701 nt, Artificial Sequence; identical to SEQ ID NO: 135115
  derived and/or modified sequence opt3 from hemagglutinin__InfluenzaA__ALE32105

SEQ ID NO: 135606 - RNA, 1701 nt, Artificial Sequence; identical to SEQ ID NO: 135115
  derived and/or modified sequence opt3 from hemagglutinin__InfluenzaA__ALE32106

SEQ ID NO: 135607 - RNA, 1701 nt, Artificial Sequence; identical to SEQ ID NO: 135170
  derived and/or modified sequence opt3 from hemagglutinin__InfluenzaA__ALE32107

SEQ ID NO: 135608 - RNA, 1701 nt, Artificial Sequence; identical to SEQ ID NO: 135400
  derived and/or modified sequence opt3 from hemagglutinin__InfluenzaA__ALE32108

SEQ ID NO: 135609 - RNA, 1701 nt, Artificial Sequence; identical to SEQ ID NO: 135014
  derived and/or modified sequence opt3 from hemagglutinin__InfluenzaA__ALE32109

SEQ ID NO: 135610 - RNA, 1701 nt, Artificial Sequence; identical to SEQ ID NO: 135001
  derived and/or modified sequence opt3 from hemagglutinin__InfluenzaA__ALE32110

SEQ ID NO: 135611 - RNA, 1701 nt, Artificial Sequence; identical to SEQ ID NO: 134457
  derived and/or modified sequence opt3 from hemagglutinin__InfluenzaA__ALE32111

SEQ ID NO: 135612 - RNA, 1701 nt, Artificial Sequence
  derived and/or modified sequence opt3 from hemagglutinin__InfluenzaA__ALE32112
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuaugcauacccagccuuaaaugugacuaugcccaacaacgagcaguuugacaagcuguauauuuggggaguccaccauccuggcaccgauaaggaccagaucuuccuuuacgcucagucuuccggcagaauaacagugucaacuaaaaggagccaacaggccguaauuccaaauaucgggagucggccccgcauuagagauaucccuucuaggaucuccauuuacuggaccauaguuaagccaggagacaucuugcugauuaacagcacagguaaucuaaucgcgccgcggggcuauuuuaaaauacgcucggggaagucuuccauuaugcgaucagacgcacccaucggaaaauguaagagugaaugcaucaccccuaacggcagcauuccaaaugauaagcccuuccagaacgugaauagaaucacguacggugccuguccuagguaugucaaacacuccacucucaagcuggcuacagggaugcggaacgugccagagaaacagacccguggaauuuuuggcgccauagcaggcuucaucgaaaaugggugggagggaaugguggacgguugguacggcuuucgccaccaaaacucugaggggagaggacaggcugccgaucuuaagagcacucaggcggccauugaccaaaucaauggcaaacugaacagguugaucgguaagacaaaugaaaaauuccaucagauugagaaggaauuuucagaggucgaagggcggauacaggaucucgagaaguauguugaggacaccaaaaucgaucuguggaguuacaacgcagaauuacugguggcucucgagaaucagcacacgauugaccuuaccgauuccgaaaugaacaagcuguuugagaaaacaaagaaacaauugcgagaaaacgccgaggacaugggcaauggaugcuucaagaucuaucauaagugugauaacgcuugcauuggcagcauccgcaaugggacuuacgaccacaacguauacagagacgaggcccuaaauaacagguuucagauaaaaggaguggaacugaagucugguuauaaagauuggauccucuggauuucauucgcaaucaguugcuuucugcuuugugucgcccuguugggcuucauuaugugggcuugccagaaggggaauauccgguguaacauaugcauuuga

SEQ ID NO: 135613 - RNA, 1701 nt, Artificial Sequence
  derived and/or modified sequence opt3 from hemagglutinin__InfluenzaA__ALE32113
augaagaccaucauugcccugagcuacauacucugccuuguguucgcucagaaaauccccggcaacgacaauuccacagcaacucuguguuuggggcaccaugccgucccuaacggaacgguugugaagaccauuacaaaugauagaaucgagguaacuaacgcgaccgaauuagugcaaaauucuucaauuggugagaucugcgacaguccacaccagauacuggauggcgaaaacuguacacuaaucgacgcucuccugggggauccgcagugcgacggauuucagaauaaaaagugggaucuuuucgucgagaggagcaaagccuauuccaacuguuaccccuaugacgugccugauuacgcaucucugcggucguugguugccucaagcggcacccucgaauuuaauaacgagaguuucaauuggacuggugugacacaaaacgggaccuccucugcuugcauucgcggaagcuccucaaguuucuucagccgacugaauuggcugacgcaucucaacuauacuuacccagcauuaaaugucaccaugcccaacaacgagcaguuugacaagcuguauaucuggggcgugcaccauccuggcacagauaaggaccagauuuuccuuuacgcccagucuuccgggcguaucacuguaucaaccaaaagaagccaacaggcuguuauaccaaauauuggaaguaggccccggauccgcgauauuccuucuagaaucuccaucuacuggacaauugugaagccaggugacauauugcugaucaacagcaccggcaaucuaauugccccgaggggguauuuuaaaaugcggucgggaaagucuuccaucaugcgcucagacgcgcccauaggcaaauguaagagugaaugcauuacgccuaacgguagcaucccaaaugauaagcccuuccagaacgucaaucgaaucacuuacggggcauguccuagauaugugaaacacuccacacucaagcuggccaccggaaugaggaacgugccagagaaacagacucggggcauuuuuggcgcuaucgccggguucauugaaaauggaugggaggguauggucgacggcugguacggguuucgucaccaaaacucugagggacgcggccaggcagcugaucuuaagagcacacaggccgcgauagaccaaaucaaugguaaacugaacagauugauugggaagaccaaugaaaaauuccaucagaucgagaaggaauuuucagagguugaaggcaggauccaggaucucgagaaguauguggaggacacgaaaauugaucuguggaguuacaacgccgaauuacugguagcacucgagaaucagcacaccauagaccuuacagauuccgaaaugaacaagcuguuugagaaaacuaagaaacaauugcgggaaaacgcugaggacaugggaaauggcugcuucaagaucuaucauaagugugauaacgccugcauugggagcauccgaaauggaaccuacgaccacaacguguaccgcgacgaggcucuaaauaacagauuucagauuaaaggugucgaacugaagucuggcuauaaagauuggauccucuggauaucauucgccaucaguugcuuucugcuuuguguggcacuguugggguucauuaugugggccugccagaagggaaauaucagguguaacauuugcaucuga

SEQ ID NO: 135614 - RNA, 1701 nt, Artificial Sequence; identical to SEQ ID NO: 135001
  derived and/or modified sequence opt3 from hemagglutinin__InfluenzaA__ALE32114

SEQ ID NO: 135615 - RNA, 1701 nt, Artificial Sequence; identical to SEQ ID NO: 135001
  derived and/or modified sequence opt3 from hemagglutinin__InfluenzaA__ALE32115

SEQ ID NO: 135616 - RNA, 1701 nt, Artificial Sequence
  derived and/or modified sequence opt3 from hemagglutinin__InfluenzaA__ALE32116
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacucaagcuggccaccgggaugcggaacgugccagagaaacagacucguggaauuuuuggcgcuauagccggcuucaucgaaaaugggugggagggaaugguggacgguugguacggcuuucgccaccaaaacucugaggggagaggacaggcagcugaucuuaagagcacacaggccgcgauugaccaaaucaauggcaaacugaacagguugaucgguaagaccaaugaaaaauuccaucagauugagaaggaauuuucagaggucgaagggcggauacaggaucucgagaaguauguugaggacacgaaaaucgaucuguggaguuacaacgccgaauuacugguggcacucgagaaucagcacaccauugaccuuacagauuccgaaaugaacaagcuguuugagaaaacuaagaaacaauugcgagaaaacgcugaggacaugggcaauggaugcuucaagaucuaucauaagugugauaacgccugcauuggcagcauccgcaaugggaccuacgaccacaacguauacagagacgaggcucuaaauaacagguuucagauaaaaggaguggaacugaagucugguuauaaagauuggauccucuggauuucauucgccaucaguugcuuucugcuuugugucgcacuguugggcuucauuaugugggccugccagaaggggaaugugcgguguaacaucugcauauga

SEQ ID NO: 135617 - RNA, 1701 nt, Artificial Sequence
  derived and/or modified sequence opt3 from hemagglutinin__InfluenzaA__ALE32117
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuuuagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacucaagcuggccaccgggaugcggaacgugccagagaaacagacucguggaauuuuuggcgcuauagccggcuucaucgaaaaugggugggagggaaugguggacgguugguacggcuuucgccaccaaaacucugaggggagaggacaggcagcugauuucaagagcacacaggccgcgauugaccaaaucaauggcaaacuuaacaggcugaucgguaagaccaaugaaaaauuccaucagauugagaaggaauuuucagaggucgaagggcggauacaggauuuggagaaguauguugaggacacgaaaaucgaucucuggaguuacaacgccgaacuguuaguggcacuggagaaucagcacaccauugaccucacagauuccgaaaugaacaaacuuuucgagaagacuaagaaacaacugcgagaaaacgcugaggacaugggcaauggaugcuuuaagaucuaucauaagugugauaacgccugcauuggcagcauccgcaaugggaccuacgaccacaacguauacagagacgaggcuuugaauaacagguuccagauaaaaggaguggaacuaaagucugaguauaaagauuggauccuguggauuucauuugccaucaguugcuuccuccugugugucgcacuucuggguuuuauuaugugggccugccagaagggcaauauccgguguaacauaugcauuuga

SEQ ID NO: 135618 - RNA, 1701 nt, Artificial Sequence; identical to SEQ ID NO: 135063
  derived and/or modified sequence opt3 from hemagglutinin__InfluenzaA__ALE32118

SEQ ID NO: 135619 - RNA, 1701 nt, Artificial Sequence; identical to SEQ ID NO: 124685
  derived and/or modified sequence opt3 from hemagglutinin__InfluenzaA__ALM06086

SEQ ID NO: 135620 - RNA, 1701 nt, Artificial Sequence; identical to SEQ ID NO: 132056
  derived and/or modified sequence opt3 from hemagglutinin__InfluenzaA__ALM06087

SEQ ID NO: 135621 - RNA, 1701 nt, Artificial Sequence
  derived and/or modified sequence opt3 from hemagglutinin__InfluenzaA__ALM06088
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcguggacaagaggguagaaugaacuacuauuggacacugguggaacccggcgacaaaauuacuuucgaggccaccgggaaccuagucguuccuagguacgcuuuuacaauggaacggaaugccggauccggcaucauaauuagcgauaccccagugcaugacugcaacacgacuugucagacaccggagggugcaaucaauaccucgcuccccuuccagaacauucacccuaucacuaucgggaagugcccaaaauauguaaagucuacaaagcugcgccuugcuaccggacugagaaaugugcccuccauucagucaaggggcuuguuuggcgccauagcgggguucaucgaaggagguuggacgggcauggucgaugggugguacggauaucaucaccaaaacgagcagggcagugguuacgccgcagaccucaaaagcacccagaaugcuauugacaagaucacaaacaaaguuaauuccgugauagagaagaugaacacucaguuuaccgccguggggaaagaguucaaucaccuggagaagcggauugaaaacuuaaauaagaaagucgaugacggcuuccuggauaucuggacauacaacgcugagcuccuugugcuguuggaaaaugagcgcacucuagacuaucaugauucuaacguaaagaaccuguacgagaaaguucgaaaucaacucaagaacaaugccaaagaaaucggaaacggcuguuuugaguucuaucacaagugcgacaauaccuguauggaaagcgugaagaacgggacauacgauuauccuaaauacucagaggaagcaaagcugaauagagagaaaauugacggagucaaacuugagaguaccaggaucuaucagauucuggccauauacuccacuguggcuagcucuuugguccucgugguuucacugggugcgaucaguuuuuggaugugcagcaacggcuccuuacagugccggauuuguaucuga

SEQ ID NO: 135622 - RNA, 1701 nt, Artificial Sequence; identical to SEQ ID NO: 132056
  derived and/or modified sequence opt3 from hemagglutinin__InfluenzaA__ALM06089

SEQ ID NO: 135623 - RNA, 1701 nt, Artificial Sequence
  derived and/or modified sequence opt3 from hemagglutinin__InfluenzaA__ALN39661
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacucaagcuggccaccgggaugcggaacgugccagagaaacagacucguggaauuuuuggcgcuauagccggcuucaucgaaaaugggugggagggaaugguggacgguugguacggcuuucgccaccaaaacucugaggggagaggacaggcagcugaucuuaagagcacacaggccgcgauugaccaaaucaauggcaaacugaacagguugaucgguaagaccaaugaaaaauuccaucagauugagaaggaauuuucagaggucgaagggcggauacaggaucucgagaaguauguugaggacacgaaaaucgaucuguggaguuacaacgccgaauuacugguggcacucgagaaucagcacaccauugaccuuacagauuccgaaaugaacaagcuguuugagaaaacuaagaaacaauugcgagaaaacgcugaggacaugggcaauggaugcuucaagaucuaucauaagugugauaacgccugcauuggcagcauccgcaaugggaccuacgaccacaacguauacagagacgaggcucuaaauaacagguuucagauaaaaggaguggaacugaagucugguuauaaagauuggauccucuggauuucauucgccaucaguugcuuucugcuuuguauugcacuguugggcuucaucaugugggccugccagaaggggaauauacgguguaacauuugcaucuga

SEQ ID NO: 135624 - RNA, 1701 nt, Artificial Sequence; identical to SEQ ID NO: 134990
  derived and/or modified sequence opt3 from hemagglutinin__InfluenzaA__ALN39662

SEQ ID NO: 135625 - RNA, 1701 nt, Artificial Sequence; identical to SEQ ID NO: 134457
  derived and/or modified sequence opt3 from hemagglutinin__InfluenzaA__ALN39663

SEQ ID NO: 135626 - RNA, 1701 nt, Artificial Sequence
  derived and/or modified sequence opt3 from hemagglutinin__InfluenzaA__ALN39664
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucuagcugcauucgcggauccaauucaaguuucuucagccgacugaacuggcucacccauuuaaauucuaaguauccagcacugaacgugacgaugcccaacaaugagcaguuugacaagcuguacaucuggggcguccaccauccuggcacugauaaagaccagauuuucuuguaugcccagccauccgggcgugugaccguaucaacaaagagaagccaacaggcuguuauccccaacauaggaaguaggccucggauucgcgauaucccaucuagaauuuccaucuacuggacuaucgugaaaccgggugacauucugcuaauaaauagcaccggcaaccucaucgcccccaggggguacuuuaagauucggucgggaaaaucuuccaucaugcgcucagacgcgccuauaggcaaguguaagagugaaugcauuacaccaaaugguagcauccccaacgauaaaccuuuccagaaugucaaccgaaucaccuauggggcauguccaagauacgugaagcaguccacgcugaaacuugccacuggaaugaggaaugugcccgagcggcaaacacguggcauuuuuggcgcuaucgccggguucauugaaaacggaugggaggguauggucgacggcugguauggguuucgccaccaaaauucugagggaagaggccaggcagcugaucuuaagagcacccaggccgcgauagaccagaucaacgguaaauugaauaggcucauugggaagacuaacgaaaaauuccaccagaucgagaaggaauuuucagagguugaaggccggauccaggaucuggagaaguacguggaggacacaaaaauugauuuauggaguuauaaugccgaacugcucguagcacuugagaaccaacauaccauagaccugacggauuccgaaaugaacaaguuguuugagaaaaccaagaaacagcuacgagaaaaugcugaggacaugggaaacggcugcuucaagaucuaccacaagugugauaaugccugcauugggagcauccgcaacggaacauaugaccaugacguguacagagaugaggcucugaauaacagguuucagauuaaaggugucgaacucaagucuggcuacaaagacuggauccuguggauaucauucgccaucaguugcuuucuucuguguguggcauugcucggguucauuaugugggccugccagaagggaaauauccgguguaacauuugcaucuga

SEQ ID NO: 135627 - RNA, 1701 nt, Artificial Sequence; identical to SEQ ID NO: 134457
  derived and/or modified sequence opt3 from hemagglutinin__InfluenzaA__ALN39665

SEQ ID NO: 135628 - RNA, 1701 nt, Artificial Sequence; identical to SEQ ID NO: 135063
  derived and/or modified sequence opt3 from hemagglutinin__InfluenzaA__ALN39666

SEQ ID NO: 135629 - RNA, 1701 nt, Artificial Sequence
  derived and/or modified sequence opt3 from hemagglutinin__InfluenzaA__ALN39667
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcaacaguccacaccagauacuagacggcgaaaauuguacacucaucgaugcucugcuuggggacccgcagugcgauggauuucagaacaaaaagugggaccuguucguggagaggagcaaagccuauuccaauuguuaccccuaugaugucccugacuacgcaucuuugcggucgcucguggccucaagcggcacccuggaauuuaacaaugagaguuucaacugggcugguguuacucaaaaugggacauccucugcaugcauucgcggaagcaacuccucauuuuucagucgacugaauuggcucacccauagcaacuuuaaguauccagccuuaaacgugacgaugcccaauaacgagcaguucgauaagcuguacaucuggggcguccaccauccuggcacugacaaagaucagauuuuucuuuaugcucagucuuccgggcguaucaccgugucaacaaagagaagccaacaggccguaacuccaaauauaggaaguaggccccggauucgcaacaucccuucuagaauuuccaucuacuggaccaucguuaaaccaggugacauuuugcugauaaauagcacaggcaaccuaaucgcgccgaggggguacuucaagauucggucgggaaaaucuuccaucaugcgcucagaugcacccauaggcaaguguaagagugaaugcauuaccccuaaugguagcaucccaaacgacaaacccuuucagaaugugaaccgaaucacguauggggccuguccuagauacgucaagcaguccacucucaaacuggcuacaggaaugaggaaugugccagagaagcaaacccggggcauuuucggcgccaucgcaggguuuauugaaaacggaugggaggguaugaaagacggcugguauggguuccgucaccaaaauucugagggacgcggccaggcugccgaucuuaagagcacucaggcggccauagaccagaucaacgguaaacugaauagauugauugggaagacaaacgaaaaguuccaccagaucgagaaagaauuuucagagguggaaggcaggauccaggaucucgagaaguacgucgaggacaccaaaauugaucuguggaguuauaacgcagaauuacugguugcucucgagaaucaacauacgauagaccuuaccgauuccgaaaugaacaagcuguucgagaaaacaaagaagcaguugcgggaaaaugccgaggacaugggaaacggcugcuuuaaaaucuaccacaagugugauaaugcuugcauugggagcauccgaaacggaacuuaugaccaugauguguaccgcaaugaggcccuaaacaauagauuccagauuaaagguguagaacugaagucuggcuacaaagacuggauccucuggauaucauuugcaaucaguugcuuccugcuuuguguggcccuguugggguuuauuaugugggcuugccagaagggaaacaucagguguaauauuugcaucuga

SEQ ID NO: 135630 - RNA, 1701 nt, Artificial Sequence; identical to SEQ ID NO: 135532
  derived and/or modified sequence opt3 from hemagglutinin__InfluenzaA__ALN39668

SEQ ID NO: 135631 - RNA, 1701 nt, Artificial Sequence
  derived and/or modified sequence opt3 from hemagglutinin__InfluenzaA__ALN39669
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccaguugucuggcagaauaacuguguccaccaaaaggucacaacaggcuguaauuccaaauaucgggagccggccccgcauuagagauaucccuaguaggaucucuauuuacuggacaauaguuaagccaggagacauccugcuaauuaacuccaccgguaaucucaucgccccgcggggcuauuuuaaaauacgcagcgggaagucgucuauuaugcgauccgacgcgcccaucggaaaauguaagucagaaugcaucacgccuaacggcaguauuccaaaugauaagcccuuccagaacgugaauagaaucacuuacggugcauguccuagguaugucaaacacagcacacugaaacuugccaccgggaugcggaacgugccagagaagcagacucguggaauuuuuggcgcuauagccggcuucaucgaaaaugggugggagggaaugguggacgguugguacggcuuucgccaccaaaacuccgaggggagaggacaggcagcugaucugaagucuacacaggccgcgauugaccaaaucaauggcaaauugaacaggcucaucgguaagaccaaugaaaaauuccaucagauugagaaggaauuuagcgaggucgaagggcggauacaggaucuggagaaguauguugaggacacgaaaaucgauuuauggucauacaacgccgaacugcucguggcacuugagaaucagcacaccauugaccugacagauagugaaaugaacaaguuguuugagaaaacuaagaaacaacuacgagaaaacgcugaggacaugggcaauggaugcuucaagaucuaucauaagugugauaacgccugcauuggcuccauccgcaaugggaccuacgaccacaacguauacagagacgaggcucugaauaacagguuucagauaaaaggaguggaacucaagagcgguuauaaagauuggauccuguggauuucuuucgccaucucaugcuuucuucugugugucgcauugcucggcuucauuaugugggccugccagaaggggaauauccgguguaacauaugcauuuga

SEQ ID NO: 135632 - RNA, 1701 nt, Artificial Sequence; identical to SEQ ID NO: 134457
  derived and/or modified sequence opt3 from hemagglutinin__InfluenzaA__ALN39670

SEQ ID NO: 135633 - RNA, 1701 nt, Artificial Sequence
  derived and/or modified sequence opt3 from hemagglutinin__InfluenzaA__ALN39671
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacucaagcuggccaccgggaugcggaacgugccagagaaacagacucguggaauuuuuggcgcuauagccggcuucaucgaaaaugggugggagggaaugguggacgguugguacggcuuucgccaccaaaacucugaggggagaggacaggcagcugaucuuaagagcacacaggccgcgauugaccaaaucaauggcaaacugaacagguugaucgguaagaccaaugaaaaauuccaucagauugagaaggaauuuucagaggucgaagggcggauacaggaucucgagaaguauguugaggacacgaaaaucgaucuguggaguuacaacgccgaauuacugguggcacucgagaaucagcacaccauugaccuuacagauuccgaaaugaacaagcuguuugagaaaacucgaaagcaauugcgcgaaaacgcugaggacaugggcaauggaugcuucaaaaucuaucauaagugugauaacgccugcauuggcagcaucagaaaugggaccuacgaccacaacguauacagggacgaggcucuaaauaaccgguuucagauaaagggaguggaacugaaaucugguuauaaggauuggauccucuggauuucauucgccaucaguugcuuucugcuuugugucgcacuguugggcuucauuaugugggccugccagaaagggaauauccgcuguaacauaugcauuuga

SEQ ID NO: 135634 - RNA, 1701 nt, Artificial Sequence; identical to SEQ ID NO: 134457
  derived and/or modified sequence opt3 from hemagglutinin__InfluenzaA__ALN39672

SEQ ID NO: 135635 - RNA, 1701 nt, Artificial Sequence
  derived and/or modified sequence opt3 from hemagglutinin__InfluenzaA__ALN39673
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccagauaucgggagucggccccgcauuagagacaucccuucuaggaucuccauuuacuggacaauaguuaagccaggagacaucuugcugauuaauagcaccgguaaccuaaucgccccgcggggcuauuuuaaaauacgcucggggaagucuuccauuaugcgaucagaugcgcccaucggaaaauguaagagugaaugcaucacgccuaauggcagcauuccaaacgacaagcccuuccagaaugugaacagaaucacuuacggugcauguccuagguaugucaaacacuccacacucaagcuggccaccgggaugcggaaugugccagagaaacagacucguggaauuuuuggcgcuauagccggcuucaucgaaaacgggugggagggaaugguggaugguugguacggcuuucgccaccaaaauucugaggggagaggacaggcagcugaccuuaagagcacacaggccgcgauugaucaaaucaacggcaaacugaauagguugaucgguaagaccaacgaaaaauuccaucagauugagaaggaauuuucagaggucgaagggcggauacaggaccucgagaaguauguugaggauacgaaaaucgaccuguggaguuacaaugccgaauuacugguggcacucgagaaccagcacaccauugaucuuacagacuccgaaaugaauaagcuguuugagaaaacuaagaaacaauugcgagaaaacgcugaggauaugggcaacggaugcuucaagaucuaucauaagugugacaaugccugcauuggcagcauccgcaacgggaccuacgaccacaauguauacagagaugaggcucuaaacaauagguuucagauaaaaggaguggaacugaagucugguuauaaagacuggauccucuggauuucauucgccaucaguugcuuucugcuuugugucgcacuguugggcuucauuaugugggccugccagaaggggaacauccgguguaauauaugcauuuga

SEQ ID NO: 135636 - RNA, 1701 nt, Artificial Sequence; identical to SEQ ID NO: 134997
  derived and/or modified sequence opt3 from hemagglutinin__InfluenzaA__ALN39674

SEQ ID NO: 135637 - RNA, 1701 nt, Artificial Sequence; identical to SEQ ID NO: 134457
  derived and/or modified sequence opt3 from hemagglutinin__InfluenzaA__ALN39675

SEQ ID NO: 135638 - RNA, 1701 nt, Artificial Sequence
  derived and/or modified sequence opt3 from hemagglutinin__InfluenzaA__ALN39676
augaagaccaucauugcccugagcugcauacucugucuuguguucgcucagaaacugcccggcaacgacaauuccacagcaacuuugugcuuagggcaccaugccgucccuaacggaacgaucguuaagaccauuacaaaugauagaaucgaggugacuaacgcgaccgaacugguacaaaauucuucaauuggugagaucugugacaguccacaccagauacuagauggcgaaaacugcacacucaucgacgcucugcuuggggauccgcagugugacggauuucagaauaaaaagugggaucuguucguggagaggagcaaagccuacuccaacugcuaucccuacgacgucccugauuaugcaucuuugcggucgcucguggccucaagcggcacccuggaauuuaauaacgagaauuucaacugggcugguguuacucaaaaugggacaaguuccucuuguauucgcggaagcaacuccucauuuuucagucgacugaauuggcucacccauuuaaacagcaaguacccagcacugaacgugacgaugcccaauaacgagcaguuugacaaacuuuauaucuggggcguccaccauccuggcacugauaaggaccagauuuucuuguacgcccagucuuccgggcguaucaccgugucaacaaagagaagccaacaggcuguaauaccaaauauuggaaguaggccccggauccgcgauauuccuucuagaaucuccaucuauuggacuauuguuaaaccaggugacauacugcuaaucaacagcaccggcaaucucauugccccgaggggguacuuucggauccgcucgggaaagucuuccauaaugcgaucagacgcgcccauuggcaaaugcaagagugaauguaucacaccuaacgguagcaucccaaaugauaagcccuuccagaacgugaauagaauuaccuacggggcaugcccuagguaugucaaacagaacacgcugaaacuugccacuggaaugcggaaugugccagagcgucaaacacgcggcaucuuuggcgcuauugccggguucauagaaaacggaugggaggguaugguggacggcugguacggguuuagacaccaaaauuccgagggaaggggccaggcagcugaucugaagucuacccagagcgccaucgaccagauuaacgguaaguugaaucggcucaucgggaaaacuaacgaaaaguuccaccagaucgagaaagaguucucagaagucgaaggccgcauucaggaucuggagaaguauguugaggacacaaagauagauuuauggaguuacaacgcggaacugcucguggcccuugagaaucaacauaccaucgaccugacggauuccgaaaugaacaaauuguuugagaagaccaaaaagcagcuacgagaaaaugcagaggacaugggaaacggcuguuucaaaauuuaucacaagugcgauaaugcuugcaucgggagcauuagaaacggaacauacgaccaugacguauauagggaugaggcccugaauaaccgguuucagaucaaggguguggaacucaaaucuggcuacaaggacuggauacuguggaucucauucgcuauuaguuguuuucuucugugcgucgccuugcucggguucaucaugugggcaugucagaaaggaaauauucgcugcaacaucuguauauga

SEQ ID NO: 135639 - RNA, 1701 nt, Artificial Sequence
  derived and/or modified sequence opt3 from hemagglutinin__InfluenzaA__ALN39677
augaagaccaucauugcccugggcuacauacucugccuuguguucgcucagaaaauccccgggaacgacaauagcacagcaacucuguguuugggacaccaugccgucccuaacgguacgauuguuaagaccaucacaaaugauagaauugaggugacuaacgcgaccgaauuaguacaaaauuccucuaucggcgagauaugcgacucaccacacaaaauccuggauggggaaaacuguacacuaauugacgcucuccugggagauccgcagugcgacggcuuucagaauaagaaaugggaucuuuucguggagaggaguaaggccuauagcaacuguuaccccuaugacgucccugauuacgcaucccugcggucuuugguggccucgucagguacccucgaauuuaauaacgagagcuucaauuggacugggguuacacagaacggaaccaguuccgcuugcauccgccgaucuagcuccucauuuuucagucgucugaauuggcugacgcaucucaacuaugcauacccagccuuaaaugugacuaugcccaacaacgagcaauuugacaagcuguauauuuggggcguccaccauccuggcaccgauaaagaccagaucuuccuuuacgcucagagcucugggagaauaacaguguccacuaagaggucacagcaagccguaauuccaaauaucggaagccggccccgcauuagagauaucccuaguaggaucucuauuuacuggaccauaguuaaaccaggugacaucuugcugauuaacuccacaggcaaucuaaucgcgccgcggggguauuuuaagauacgcagcggaaaaucgucuauuaugcgauccgacgcacccaucggcaaguguaagucagaaugcaucaccccuaacgguaguauuccaaaugauaaacccuuccagaacgugaauagaaucacguacggggccuguccuagguaugucaagcacagcacucucaaacuggcuacaggaaugcggaacgugccagagaagcagacccguggcauuuuuggcgccauagcaggguucaucgaaaauggaugggaggguaugguggacggcugguacggguuucgccaccagaacuccgagggaagaggccaagcugccgaucuuaaaucuacucaggcggccauugaccagaucaaugguaagcugaacagguugaucgggaaaacaaaugaaaaguuccaucaaauugagaaggaguucagcgaagucgaaggccggauacaggaucucgagaaauauguugaggacaccaagaucgaucuguggucauacaacgcagaauuacugguggcucucgagaaucagcacacgauugaccuuaccgauagugaaaugaacaaacuguuugagaagacuaaaaagcaguugcgagaaaacgccgaggacaugggaaauggcugcuucaagaucuaucauaaaugugauaacgcuugcauuggguccauccgcaauggaacauacgaccacaacguauacagagacgaggcccuaaauaacagguuucaaauaaaggguguggaacugaaaagcggcuauaaggauuggauccucuggauuucuuucgcaaucucaugcuuucugcuuugugucgcccuguugggguucauuaugugggcuugccagaaaggaaauauccgguguaacauaugcauuuga

SEQ ID NO: 135640 - RNA, 1701 nt, Artificial Sequence; identical to SEQ ID NO: 135344
  derived and/or modified sequence opt3 from hemagglutinin__InfluenzaA__ALN39678

SEQ ID NO: 135641 - RNA, 1701 nt, Artificial Sequence
  derived and/or modified sequence opt3 from hemagglutinin__InfluenzaA__ALN39679
augaagaccaucauugcccugggcuacauacucugccuuguguucgcucagaaaauccccgggaacgacaauagcacagcaacucuguguuugggacaccaugccgucccuaacgguacgguugugaagaccauuacaaaugauagaaucgagguaacuaacgcgaccgaauuagugcaaaauuccucuauuggcgagaucugcgacucaccacacaaaauacuggauggggaaaacuguacacuaaucgacgcucuccugggagauccgcagugcgacggcuuucagaauaagaaaugggaucuuuucgucgagaggaguaaggccuauagcaacuguuaccccuaugacgugccugauuacgcaucccugcggucuuugguugccucgucagguacccucgaauuuaauaacgagagcuucaauuggacuggggugacacagaacggaaccaguuccgcuugcauucgccgaucuagcuccucauuuuucagucgucugaauuggcugacgcaucucaacuauacuuacccagcauuaaaugucaccaugcccaacaacgagcaauuugacaagcuguauaucuggggcgugcaccauccuggcacagauaaagaccagauuuuccuuuacgcccagagcucugggagaaucacuguauccaccaagaggucacagcaagcuguuauaccaaauauuggaagccggccccgcaucagagauauuccuaguaggaucucuaucuacuggacaauugugaaaccaggugacauauugcugaucaacuccaccggcaaucuaauugccccgcggggguauuuuaagauccgcagcggaaaaucgucuauaaugcgauccgacgcgcccauuggcaaguguaagucagaaugcaucacgccuaacgguaguaucccaaaugauaaacccuuccagaacgucaauagaauuacuuacggggcauguccuagguaugugaagcacagcacacucaaacuggccaccggaaugcggaacgugccagagaagcagacucguggcaucuuuggcgcuauugccggguucauagaaaauggaugggaggguauggucgacggcugguacggguuucgccaccagaacuccgagggaagaggccaagcagcugaucuuaaaucuacacaggccgcgaucgaccagauuaaugguaagcugaacagguugaucgggaaaaccaaugaaaaguuccaucaaaucgagaaggaguucagcgaaguugaaggccggauucaggaucucgagaaauauguggaggacacgaagauagaucuguggucauacaacgccgaauuacugguagcacucgagaaucagcacaccaucgaccuuacagauagugaaaugaacaaacuguuugagaagacuaaaaagcaguugcgagaaaacgcugaggacaugggaaauggcugcuucaagauuuaucauaaaugugauaacgccugcaucggguccauucgcaauggaaccuacgaccacaacguguacagagacgaggcucuaaauaacagguuucaaaucaagggugucgaacugaaaagcggcuauaaggauuggauacucuggaucucuuucgccauuucaugcuuucugcuuuguguggcacuguugggguucaucaugugggccugccagaaaggaaauauucgguguaacaucugcauauga

SEQ ID NO: 135642 - RNA, 1701 nt, Artificial Sequence; identical to SEQ ID NO: 135344
  derived and/or modified sequence opt3 from hemagglutinin__InfluenzaA__ALN39680

SEQ ID NO: 135643 - RNA, 1701 nt, Artificial Sequence; identical to SEQ ID NO: 135344
  derived and/or modified sequence opt3 from hemagglutinin__InfluenzaA__ALN39681

SEQ ID NO: 135644 - RNA, 1701 nt, Artificial Sequence; identical to SEQ ID NO: 135344
  derived and/or modified sequence opt3 from hemagglutinin__InfluenzaA__ALN39682

SEQ ID NO: 135645 - RNA, 1701 nt, Artificial Sequence; identical to SEQ ID NO: 135344
  derived and/or modified sequence opt3 from hemagglutinin__InfluenzaA__ALN39683

SEQ ID NO: 135646 - RNA, 1701 nt, Artificial Sequence; identical to SEQ ID NO: 135344
  derived and/or modified sequence opt3 from hemagglutinin__InfluenzaA__ALN39684

SEQ ID NO: 135647 - RNA, 1701 nt, Artificial Sequence; identical to SEQ ID NO: 135344
  derived and/or modified sequence opt3 from hemagglutinin__InfluenzaA__ALN39685

SEQ ID NO: 135648 - RNA, 1701 nt, Artificial Sequence
  derived and/or modified sequence opt3 from hemagglutinin__InfluenzaA__ALN39686
augaagaccaucauugcccugggcuacauacucugccuugcuuucgcacagaaaauccccgggaacgacaauagcacagccacucuguguuugggacaccaugcggugccuaacgguacgauugucaagaccaucacaaaugauagaauugagguuacuaacgcuaccgaauuagugcaaaauuccucuaucggcgagauaugcgacucaccacacaaaauccuggauggggaaaacuguacacuaauugacgcccuccugggagauccgcagugcgacggcuuucagaauaagaaaugggaucuuuucguagagaggaguaaggcauauagcaacuguuaccccuaugacgugccugauuacaccucccugcggucuuuggucgccucgucagguacucucgaauuuaauaacgagagcuucaauuggacaggggugacccagaacggaacgaguuccgcuugcauccgccgaucuagcuccucauuuuucagucgucugaauuggcugacucaucucaacuauaccuacccagcauuaaauguuacaaugcccaacaacgagcaauuugacaagcuguauauuuggggcgugcaccauccuggcacugauaaagaccagaucuuccuuuacgcccagagcucugggagaauaaccgucuccacaaagaggucacagcaagcugugauuccaaauaucggaagccggccccgcauuagagauaucccuaguaggaucucuauuuacuggaccauaguaaaaccaggugacaucuugcugauuaacuccacgggcaaucuaaucgccccgcggggguauuuuaagauacgcagcggaaaaucgucuauuaugcgauccgacgcgcccaucggcaaguguaagucagaaugcaucacuccuaacgguaguauuccaaaugauaaacccuuccagaacguuaauagaaucacauacggggcauguccuagguaugugaagcacagcacccucaaacuggccacuggaaugcggaacgucccagagaagcagacacguggcauuuuuggcgcuauagccggguucaucgaaaauggaugggaggguaugguggacggcugguacggguuucgccaccagaacuccgagggaagaggccaagcagcugaucuuaaaucuacccaggccgcgauugaccagaucaaugguaagcugaacagguugaucgggaaaacgaaugaaaaguuccaucaaauugagaaggaguucagcgaaguggaaggccggauacaggaucucgagaaauaugucgaggacaccaagaucgaucuguggucauacaacgccgaauuacugguugcacucgagaaucagcacacaauugaccuuacugauagugaaaugaacaaacuguuugagaagaccaaaaagcaguugcgagaaaacgcugaggacaugggaaauggcugcuucaagaucuaucauaaaugugauaacgccugcauuggguccauccgcaauggaacauacgaccacaacguguacagagacgaggcucuaaauaacagguuucaaauaaaggguguagaacugaaaagcggcuauaaggauuggauccucuggauuucuuucgccaucucaugcuuucugcuuuguguggcacuguugggguucauuaugugggccugccagaaaggaaauauccgguguaacauaugcauuuga

SEQ ID NO: 135649 - RNA, 1701 nt, Artificial Sequence; identical to SEQ ID NO: 135344
  derived and/or modified sequence opt3 from hemagglutinin__InfluenzaA__ALN39687

SEQ ID NO: 135650 - RNA, 1701 nt, Artificial Sequence
  derived and/or modified sequence opt3 from hemagglutinin__InfluenzaA__ALN39688
augaagaccaucauugcccugggcuacauacucugccuuguguucgcucagaaaauccccgggaacgacaauagcacagcaacucuguguuugggacaccaugccgucccuaacgguacgauuguuaagaccaucacaaaugauagaauugaggugacuaacgcgaccgaauuaguacaaaauuccucuaucggcgagauaugcgacucaccacacaaaauccuggauggggaaaacuguacacuaauugacgcucuccugggagauccgcagugcgacggcuuucagaauaagaaaugggaucuuuucguggagaggaguaaggccuauagcaacuguuaccccuaugacgucccugauuacgcaucccugcggucuuugguggccucgucagguacccucgaauuuaauaacgagagcuucaauuggacugggguuacacagaacggaaccaguuccgcuugcauccgccgaucuagcuccucauuuuucagucgucugaauuggcugacgcaucucaacuauauuuacccagcauuaaaugugacuaugcccaacaacgagcaauuugacaagcuguauaucuggggcguccaccauccuggcaccgauaaagaccagauauuccuuuacgcccagagcucugggagaauuacaguguccacuaagaggucacagcaagcuguaaucccaaauauuggaagccggccccgcaucagagauaucccuaguaggauuucuauauacuggaccaucguuaaaccaggugacauuuugcugaucaacuccacaggcaaucuaauagccccgcggggguauuuuaagauucgcagcggaaaaucgucuaucaugcgauccgacgcgcccaucggcaaguguaagucagaaugcauuaccccuaacgguaguaucccaaaugauaaacccuuccagaacgugaauagaauuacguacggggcauguccuagguaugucaagcacagcacucucaaacuggccacaggaaugcggaacgugccagagaagcagacccguggcauauuuggcgcuaucgccggguucauugaaaauggaugggaggguaugguggacggcugguacggguuucgccaccagaacuccgagggaagaggccaagcagcugaucuuaaaucuacucaggccgcgaucgaccagaucaaugguaagcugaacagguugauugggaaaacaaaugaaaaguuccaucaaauagagaaggaguucagcgaagucgaaggccggauccaggaucucgagaaauauguugaggacaccaagauugaucuguggucauacaacgccgaauuacugguggcacucgagaaucagcacacgaucgaccuuaccgauagugaaaugaacaaacuguuugagaagacuaaaaagcaguugcgagaaaacgcugaggacaugggaaauggcugcuucaagauuuaucauaaaugugauaacgccugcaucggguccauacgcaauggaacauacgaccacaacguauacagagacgaggcucuaaauaacagguuucaaaucaaggguguggaacugaaaagcggcuauaaggauuggauucucuggaucucuuucgccauuucaugcuuucugcuuugugucgcacuguugggguucaucaugugggccugccagaaaggaaauauacgguguaacauuugcaucuga

SEQ ID NO: 135651 - RNA, 1701 nt, Artificial Sequence
  derived and/or modified sequence opt3 from hemagglutinin__InfluenzaA__ALN39689
augaagaccaucauugcccugggcuacauacucugccuuguguucgcucagaaaauccccgggaacgacaauagcacagcaacucuguguuugggacaccaugccgucccuaacgguacgauuguuaagaccaucacaaaugauagaauugaggugacuaacgcgaccgaauuaguacaaaauuccucuaucggcgagauaugcgacucaccacacaaaauccuggauggggaaaacuguacacuaauugacgcucuccugggagauccgcagugcgacggcuuucagaauaagaaaugggaucuuuucguggagaggaguaaggccuauagcaacuguuaccccuaugacgucccugauuacgcaucccugcggucuuugguggccucgucagguacccucgaauuuaauaacgagagcuucaauuggacugggguuacacagaacggaaccaguuccgcuugcauccgccgaucuagcuccucauuuuucagucgucugaauuggcugacgcaucucaacuauacuuacccagcauuaaaugugaccaugcccaacaacgagcaauuugacaagcuguauauuuggggcguccaccauccuggcacagauaaagaccagaucuuccuuuacgcccagagcucugggagaauaacuguguccaccaagaggucacagcaagcuguaauuccaaauaucggaagccggccccgcauuagagauaucccuaguaggaucucuauuuacuggacaauaguuaaaccaggugacaucuugcugauucacuccaccggcaaccuaaucgccccgcggggguauuuuaagauacgcagcggaaaaucgucuauuaugcgauccgacgcgcccaucggcaaguguaagucagaaugcaucacgccuaaugguaguauuccaaacgauaaacccuuccagaaugugaacagaaucacuuacggggcauguccuagguaugucaagcacagcacacucaaacuggccaccggaaugcggaaugugccagagaagcagacucguggcauuuuuggcgcuauagccggguucaucgaaaacggaugggaggguaugguggacggcugguacggguuucgccaucaaaauuccgagggaagaggccaggcagcugaucuuaaaucuacacaggccgcgauugaccagaucaacgguaagcugaauagguugaucgggaaaaccaacgaaaaguuccaccaaauugagaaggaguucagcgaagucgaaggccggauacaggaucucgagaaauauguugaggacacgaagaucgaucuguggucauacaaugccgaauuacugguggcacucgagaaccagcauaccauugaccuuacagauagugaaaugaauaaacuguuugagaagacuaaaaagcaguugcgagaaaacgcugaggacaugggaaacggcugcuucaagaucuaucacaaaugugauaaugccugcauuggguccauccgcaacggaaccuacgaccacaauguauacagagacgaggcucuaaacaauagguuucaaauaaaggguguggaacugaaaagcggcuauaaggauuggauccucuggauuucuuucgccaucucaugcuuucugcuuugugucgcacuguugggguucauuaugugggccugccagaaaggaaacauccgguguaauauaugcauuuga

SEQ ID NO: 135652 - RNA, 1701 nt, Artificial Sequence
  derived and/or modified sequence opt3 from hemagglutinin__InfluenzaA__ALN39690
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcaaaaacuguacacucaucgacgcucugcuuggggauccgcagugcgacggauuucagaauaagaaaugggaucuguucguggaaaggagcaaggcccauuccaacuguuaucccuacgacgucccugauuaugcaucuuugcggucgcucguggccucaagcggcacccuggaguuuaauaacgaaaguuucaauugggcugguguuacucaaaacgggacauccucuagcugcauucgcggauccaauucaaguuucuuuagccgacugaacuggcucacccacuuaaauucuaucuacccagcacugaacgugacgaugcccaacaaugagcaguuugacaaacuuuauauuuggggcguccaucacccuggcacugauaaagaccagaucuucuuguacgcccaguccucagggcguauaaccgugagcacaaagagaagucaacaggcuguaauuccaaacaucggaucuaggccccggauucgcgauaucccuuccagaaucagcauuuauuggacuauaguuaaaccaggugacauccugcuaauuaauucgaccggcaaccucaucgccccgaggggguacuuuaagauacggucuggaaaauccucaauuaugcgcagugacgcgcccaucggcaaguguaagagcgagugcaucacaccuaaugguuccauuccaaacgauaaacccuuccagaaugugaaccgaaucaccuacggggcauguccuagauaugucaagcagucuacgcugaaacuugccacuggaaugaggaaugugccagaacggcaaacacguggcauuuuuggcgcuauagccggguucaucgagaacggaugggaagguaugguggacggcugguacggguuucgccaccagaauagcgagggaagaggccaggcagcugaucugaagucaacccaagccgcgauugaccagaucaacgguaaauugaauaggcucaucgggaagacuaacgagaaauuccaucagauugaaaaggaguucagugaagucgagggccggauacaggaucuggaaaaguauguugaggacacaaaaaucgauuuaugguccuacaaugccgagcugcucguggcacuugaaaaccaacacaccauugaccugacggauagcgagaugaacaaguuguuugaaaagaccaagaaacagcuacgagagaaugcugaagacaugggaaacggcugcuucaagaucuaucauaagugugauaaugccugcauugggucuauccgcaacggaacauacgaccacaauguauauagagacgaggcucugaacaauagguuucagauaaaagguguggagcucaagucaggcuacaaagauuggauccuguggauuaguuucgccaucagcugcuuucuucugugugucgcauugcucggguucauuaugugggccugccagaagggaaacauccgguguaauauaugcauuuga

SEQ ID NO: 135653 - RNA, 1701 nt, Artificial Sequence
  derived and/or modified sequence opt3 from hemagglutinin__InfluenzaA__ALN39691
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcaaaaacuguacacucaucgacgcucugcuuggggauccgcagugcgacggauuucagaauaagaaaugggaucuguucguggaaaggagcaaggcccauuccaacuguuaucccuacgacgucccugauuaugcaucuuugcggucgcucguggccucaagcggcacccuggaguuuaauaacgaaaguuucaauugggcugguguuacucaaaacgggacauccucuagcugcauucgcggauccaauucaaguuucuuuagccgacugaacuggcucacccacuuaaauucuaaguacccagcacugaacgugacgaugcccaacaaugagcaguuugacaaacuuuauaucuggggcguccaucacccuggcacugauaaggaccagauuuucuuguacgcccagccauccgggcguaucaccgugucaacaaaaagaagccaacaggcuguaauacccaacauuggaaguaggccucggauccgcgauauuccaucuagaaucuccaucuauuggacuauuguuaagccgggugacauacugcuaaucaauagcaccggcaaccucauugcccccaggggguacuuuaaaauccggucgggaaagucuuccauaaugcgcucagacgcgccuauuggcaaguguaaaagugagugcaucacaccaaaugguagcauccccaacgauaagccuuuccagaaugugaaccgaauuaccuacggggcauguccaagauaugucaaacaguccacgcugaaacuugccacuggaaugaggaaugugcccgaaaagcaaacacggggcaucuuuggcgcuauugccggguucauagagaacggaugggaagguaugaaggacggcugguacggguuucgucaccaaaauucugagggacgcggccaggcagcugaucugaaaagcacccaggccgcgaucgaccagauuaacgguaaguugaauagacucaucgggaagacuaacgagaaauuccaucagaucgaaaaggaguucucagaaguggagggcaggauucaggaucuggaaaaauaugucgaggacacaaagauagauuuauggaguuacaaugccgagcugcucguugcacuugaaaaccaacacaccaucgaccugacggauuccgagaugaacaaauuguuugaaaagaccaagaaacagcuacgggagaaugcugaagacaugggaaacggcugcuucaagauuuaucauaaaugugauaaugccugcaucgggagcauucgaaacggaacauacgaccacgacguguaucgcgaugaggcucugaauaacagauuucagaucaaggguguagagcucaaaucuggcuacaaggacuggauacuguggaucucauucgccauuaguugcuuucuucuguguguggcauugcucggguucaucaugugggccugccagaagggaaauauuagguguaacaucugcauauga

SEQ ID NO: 135654 - RNA, 1701 nt, Artificial Sequence; identical to SEQ ID NO: 135344
  derived and/or modified sequence opt3 from hemagglutinin__InfluenzaA__ALN39692

SEQ ID NO: 135655 - RNA, 1701 nt, Artificial Sequence; identical to SEQ ID NO: 135344
  derived and/or modified sequence opt3 from hemagglutinin__InfluenzaA__ALN39693

SEQ ID NO: 135656 - RNA, 1701 nt, Artificial Sequence; identical to SEQ ID NO: 135344
  derived and/or modified sequence opt3 from hemagglutinin__InfluenzaA__ALN39694

SEQ ID NO: 135657 - RNA, 1701 nt, Artificial Sequence; identical to SEQ ID NO: 135344
  derived and/or modified sequence opt3 from hemagglutinin__InfluenzaA__ALN39695

SEQ ID NO: 135658 - RNA, 1701 nt, Artificial Sequence; identical to SEQ ID NO: 135344
  derived and/or modified sequence opt3 from hemagglutinin__InfluenzaA__ALN39696

SEQ ID NO: 135659 - RNA, 1701 nt, Artificial Sequence; identical to SEQ ID NO: 135014
  derived and/or modified sequence opt3 from hemagglutinin__InfluenzaA__ALN39697

SEQ ID NO: 135660 - RNA, 1701 nt, Artificial Sequence
  derived and/or modified sequence opt3 from hemagglutinin__InfluenzaA__ALN39698
augaagaccaucauugcccugagccacauacucugccuuguguucgcucagaaaauccccggcaacgacaauuccacagcaacucuguguuuggggcaucacgccgucccuaacggaacgauuguuaagaccaucacaaaugauagaauugaggugacuaacgcgaccgaauuaguacaaaauucuucaaucggugagauaugcgacaguccacaucagauccuggauggcgaaaacuguacacuaauugacgcucuccugggggauccgcagugcgacggauuucagaauaaaaagugggaucuuuucguggagaggagcaaagccuacuccaacuguuaucccuacgacgucccugauuaugcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaccucaacuacacuuauccagcauuaaaugugaccaugcccaacaacgagcaguuugacaagcuguacauuuggggaguccaucacccuggcacagauaaggaccagaucuuccuuuaugcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuacuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuauggugcauguccuagguacgucaaacacuccacacucaagcuggccaccgggaugcggaacgugccagagaaacagacucguggaauuuuuggcgcuauagccggcuucaucgaaaaugggugggagggaaugauggacgguugguauggcuuucgccaucaaaacucugaggggagaggacaggcagcugaucuuaagagcacacaggccgcgauugaccaaaucaauggcaaacugaacagguugaucgguaagaccaaugaaaaauuccaccagauugagaaggaauuuucagagguggaagggcggauacaggaucucgagaaguacgucgaggacacgaaaaucgaucuguggaguuauaacgccgaauuacugguugcacucgagaaucagcauaccauugaccuuacagauuccgaaaugaacaagcuguuugagaaaacuaagaaacaauugcgagaaaacgcugaggacaugggcaauggaugcuucaagaucuaccacaagugugauaacgccugcaugggcagcauucgcaaugggaccuaugaccacaacguguacagaaaugaggcucuaaacaauagguuucagaucaaaggaguagaacugaagucugguuacaaagacuggauacucuggaucucauucgccauuaguugcuuucugcuuuguguggcacuguugggcuucaucaugugggccugccagaaggggaacauucgguguaauaucugcauauga

SEQ ID NO: 135661 - RNA, 1701 nt, Artificial Sequence
  derived and/or modified sequence opt3 from hemagglutinin__InfluenzaA__ALN39700
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacucaagcuggccaccgggaugcggaacgugccagagaaacagacucguggaauuuuuggcgcuauagccggcuucaucgaaaaugggugggagggaaugguggacgguugguacggcuuucgccaccaaaacucugaggggagaggacaggcagcugaucuuaagagcacacaggccgcgauugaccaaaucaauggcaaacugaacagguugaucgguaagaccaaugaaaaauuccaucagauugagaaggaauuuucagaggucgaagggcggauacaggaucucgagaaguauguugaggacacgaaaaucgaucuguggaguuacaacgccgaauuacugguggcacucgagaaucagcacaccauugaccuuacagauuccgaaaugaacaagcuguuugagaaaacuaagaaacaauugcgagaaaacgcugaggacaugggcaauggaugcuucaagaucuaucauaagugugauaacgccugcauuggcagcauccgcaaugggaccuacgaccacaacguauacagagacgaggcucuaaauaacagguuucagauaaaaggaguggaacugaagucugguuauaaagauuggauccucuggauuucauucgccaucaguugcuuucugcuuugugucgcacuguugggcuucauuaugugggccugccagaaggggaauaucaaauguaacauaugcauuuga

SEQ ID NO: 135662 - RNA, 1701 nt, Artificial Sequence; identical to SEQ ID NO: 135063
  derived and/or modified sequence opt3 from hemagglutinin__InfluenzaA__ALN39701

SEQ ID NO: 135663 - RNA, 1701 nt, Artificial Sequence
  derived and/or modified sequence opt3 from hemagglutinin__InfluenzaA__ALN39702
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuauacuuacccagcauuaaaugugaccaugcccaacaacgagcaguuugacaagcuguauauuuggggaguccaccauccuggcacagauaaagaccagaucuuccuuuacgcccguucuuccggcagaauaacugugucaaccaagaggagccagcaagcuguaauuccaaauaucgggagucggccccgcauuagagauaucccuucuaggaucuccauuuacuggacaauaguuaaaccaggagacaucuugcugauuaacagcaccgguaaucuaaucgccccgcggggcuauuuuaagauacgcucggggaaaucuuccauuaugcgaucagacgcgcccaucggaaaguguaagagugaaugcaucacgccuaacggcagcauuccaaaugauaaacccuuccagaacgugaauagaaucacuuacggugcauguccuagguaugucaagcacuccacacucaaacuggccaccgggaugcggaacgugccagagaagcagacucguggaauuuuuggcgcuauagccggcuucaucgaaaaugggugggagggaaugguggacgguugguacggcuuucgccaccagaacucugaggggagaggacaagcagcugaucuuaaaagcacacaggccgcgauugaccagaucaauggcaagcugaacagguugaucgguaaaaccaaugaaaaguuccaucaaauugagaaggaauuuucagaggucgaagggcggauacaggaucucgagaaauauguugaggacacgaagaucgaucuguggaguuacaacgccgaauuacugguggcacucgagaaucagcacaccauugaccuuacagauuccgaaaugaacaaacuguuugagaagacuaaaaagcaguugcgagaaaacgcugaggacaugggcaauggaugcuucaagaucuaucauaaaugugauaacgccugcauuggcagcauccgcaaugggaccuacgaccacaacguauacagagacgaggcucuaaauaacagguuucaaauaaagggaguggaacugaaaucugguuauaaggauuggauccucuggauuucauucgccaucaguugcuuucugcuuugugucgcacuguugggcuucauuaugugggccugccagaaagggaauauccgguguagcauaugcauuuga

SEQ ID NO: 135664 - RNA, 1701 nt, Artificial Sequence
  derived and/or modified sequence opt3 from hemagglutinin__InfluenzaA__ALN39703
augaagaccaucauugcccugagcuacauacucugccuuguguucgcucagaaaauccccggcaacgacgauuccacagcaacucuguguuuggggcaccaugccgucccuaauggaacgauuguuaagaccaucacaaacgacagaauugaggugacuaaugcgaccgaauuaguacaaaacucuucaaucggugagauaugcgauaguccacaccagauccuggacggcgaaaauuguacacuaauugaugcucuccugggggacccgcagugcgauggauuucagaacaaaaagugggaccuuuucguggagaggagcaaagccuauuccaauuguuaccccuaugaugucccugacuacgcaucucugcggucguugguggccucaagcggcacccucgaauuuaacaaugagaguuucaacuggacugguguuacacaaaaugggaccuccucugcuugcauccgccgaagcuccucaaguuucuucagccgucugaacuggcugacgcaucucaauuauacuuacccagcauuaaacgugaccaugcccaauaacgagcaguuugauaagcuguauauuuggggaguccaccauccuggcacagacaaggaucagaucuuccuuuacgcccagucuuccggcagaauaacugugucaaccaaaaggagccaacaggcuguaauuccaaacaucgggagucggccccgcauuagagacaucccuucuaggaucuccauuuacuggacaauaguuaagccaggagacaucuugcugauuaauagcaccgguaaccuaaucgccccgcggggcuauuuuaaaauacgcucggggaagucuuccauuaugcgaucagaugcgcccaucggaaaauguaagagugaaugcaucacgccuaauggcagcauuccaaacgacaagcccuuccagaaugugaacagaaucacuuacggugcauguccuagguaugucaaacacuccacacucaagcuggccaccgggaugcggaaugugccagagaaacagacucguggaauuuuuggcgcuauagccggcuucaucgaaaacgggugggagggaaugguggaugguugguacggcuuucgccaccaaaauucugaggggagaggacaggcagcugaccuuaagagcacacaggccgcgauugaucaaaucaacggcaaacugaauagguugaucgguaagaccaacgaaaaauuccaucagauugagaaggaauuuucagaggucgaagggcggauacaggaccucgagaaguauguugaggauacgaaaaucgaccuguggaguuacaaugccgaauuacugguggcacucgagaaccagcacaccauugaucuuacagacuccgaaaugaauaagcuguuugagaaaacuaagaaacaauugcgagaaaacgcugaggauaugggcaacggaugcuucaagaucuaucauaagugugacaaugccugcauuggcagcauccgcaacgggaccuacgaccacaauguauacagagaugaggcucuaaacaauagguuucagauaaaaggaguggaacugaagucugguuauaaagacuggauccucuggauuucauucgccaucaguugcuuucugcuuugugucgcacuguugggcuucauuaugugggccugccagaaggggaacauccgguguaauauaugcauuuga

SEQ ID NO: 135665 - RNA, 1701 nt, Artificial Sequence; identical to SEQ ID NO: 135063
  derived and/or modified sequence opt3 from hemagglutinin__InfluenzaA__ALN39704

SEQ ID NO: 135666 - RNA, 1701 nt, Artificial Sequence; identical to SEQ ID NO: 134457
  derived and/or modified sequence opt3 from hemagglutinin__InfluenzaA__ALN39705

SEQ ID NO: 135667 - RNA, 1701 nt, Artificial Sequence
  derived and/or modified sequence opt3 from hemagglutinin__InfluenzaA__ALN39706
augaagaccaucauugcccugagcuacauacucugccuuguguucgcucagaaacugcccggcaacgacaauuccacagcaacuuuguguuuagggcaccaugccgucccuaacggaaugaucguuaagacgauuaccaaugauagaaucgaggugacaaacgcgacugaacugguacaaaauucuucaauuggugagaucugcgacaguccacaccagauacuagauggcaaaaacuguacccucaucgacgcucugcuuggggauccgcagugcgacgauuuucagaauaagaggugggaccuguucguggaacggagcaaagccuauuccaacuguuaccccuaugaugucccugacuacgcaucuuugcgcucgcucguggccucaagcggaacacuggaguuuaaugaugaaaguuucaacugggcuggcguuacccaaaaugguacuuccucugcaugcauucgagggagcaacuccucauuuuucagucgucugaauuggcucacacauagcaacuuuaaguauccagccuuaaaugugaccaugcccaacaacgagcaguucgacaagcuguacaucuggggaguccaccauccuggcacggauaaagaccagauuuuucuuuaugcucagucuuccggcagaaucacugugucaaccaagaggagccaacaggccguaauaccaaauauugggagucggccccgcaucagaaacauuccuucuaggaucuccaucuacuggacaauuguuaaaccaggagacauauugcugaucaauagcacugguaaccuaauugcgccgcggggcuacuucaagauccagucggggaaaucuuccauaaugcgcucagaugcacccauuggaaaguguaagagugagugcaucaccccuaauggcagcaucccaaacgacaaacccuuucagaaugugaaccgaauuacauauggugccuguccuagauacgucaagcaauccacccucaaacuggcuacggggaugaggaaugugccagaaaagcagacucggggaaucuucggcgccauugcaggcuuuauagagaacgggugggaaggaaugaaagaugguugguauggcuuccgucaccaaaauucugaggggcgcggacaggcugccgaccuuaagagcacacaggcggccaucgaucagauuaacggcaaacugaauagauugaucgguaagaccaacgagaaguuccaccagaucgaaaaagaguuuucagaaguggaggggaggauucaagaccucgaaaaguacgucgaggauacuaaaauagaccuguggaguuauaaugcagaguuacugguugcucucgaaaaccagcauacaaucgaucuuaccgacuccgagaugaacaagcuguucgagaaaacgaagaagcaguugcgggaaaaugccgaagauaugggcaacggaugcuuuaaaauuuaccacaagugugacaaugcuugcaucggcagcauucgaaacgggaccuaugaccaugauguguaccgcgacgaggcccuaaauaacagauuccagaucaaaggaguagagcugaagucugguuacaaagauuggauacucuggaucucauuugcaauuaguugcuuccugcuuuguguggcccuguugggcuuuaucaugugggcuugccaaaaggggaauauuagguguaacaucugcauauga

SEQ ID NO: 135668 - RNA, 1701 nt, Artificial Sequence; identical to SEQ ID NO: 134457
  derived and/or modified sequence opt3 from hemagglutinin__InfluenzaA__ALN39707

SEQ ID NO: 135669 - RNA, 1701 nt, Artificial Sequence; identical to SEQ ID NO: 135063
  derived and/or modified sequence opt3 from hemagglutinin__InfluenzaA__ALN39708

SEQ ID NO: 135670 - RNA, 1701 nt, Artificial Sequence
  derived and/or modified sequence opt3 from hemagglutinin__InfluenzaA__ALN39709
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucuagcugcaugcgcggauccaauucaaguuucuucagccgacugaacuggcucacccauuuaaauucuaaguauccagcacugaacgugacgaugcccaacaaugagcaguuugacaaacuuuacauuuggggcguccaccauccuggcacugauaaggaccagaucuucuuguaugcccaguccucagggcguauuaccgugagcacaaagagaagucaacaggcuguaacuccaaacaucggaucuaggccccggauacgcgauauuccuuccagaaucagcauuuacuggaccaucguuaaaccaggugacauccugcuaauuaauucgacaggcaaccucauagccccgaggggguacuuuaagauccggucuggaaaauccucaauuaugcgcagugacgcgcccaucggcaaguguaagagcgaaugcauaaccccuaaugguuccauuccaaacgauaaacccuuccagaaugugaaccgaaucacguauggggcauguccuagauacgucaagcagucuacucugaaacuugccacaggaaugaggaaugugccagagcggcaaacccguggcaucuuuggcgcuauugccggguucaucgaaaacggaugggaggguaugguggacggcugguauggguuucgccaccagaauagcgagggaagaggccaggcagcugaucugaagucaacucaagccgcgauugaccagauaaacgguaaauugaauaggcucaucgggaagacaaacgaaaaauuccaccagauugagaaggaauuuagugaggucgaaggccggauccaggaucuggagaaguacguugaggacaccaaaaucgauuuaugguccuauaaugccgaacugcucguggcacuugagaaccaacauacgauugaccugaccgauagcgaaaugaacaaguuguuugagaaaacaaagaaacagcuacgagaaaaugcugaggacaugggaaacggcugcuucaagauauaccacaagugugauaaugccugcaucgggucuauucgcaacggaacuuaugaccaugacguauacagagaugaggcucugaauaacagguuucagaucaaagguguggaacucaagucaggcuacaaagacuggauucuguggaucaguuucgccauaagcugcuuucuucugugugucgcauugcucggguucaucaugugggccugccagaagggaaauauucgguguaacaucugcauuuga

SEQ ID NO: 135671 - RNA, 1701 nt, Artificial Sequence; identical to SEQ ID NO: 135387
  derived and/or modified sequence opt3 from hemagglutinin__InfluenzaA__ALN39710

SEQ ID NO: 135672 - RNA, 1701 nt, Artificial Sequence; identical to SEQ ID NO: 135063
  derived and/or modified sequence opt3 from hemagglutinin__InfluenzaA__ALN39711

SEQ ID NO: 135673 - RNA, 1701 nt, Artificial Sequence; identical to SEQ ID NO: 134457
  derived and/or modified sequence opt3 from hemagglutinin__InfluenzaA__ALN39712

SEQ ID NO: 135674 - RNA, 1701 nt, Artificial Sequence
  derived and/or modified sequence opt3 from hemagglutinin__InfluenzaA__ALN39713
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcggaagcuccucaaguuucuucagccgacugaauuggcugacgcaucucaacuauacuuacccagcauuaaaugugaccaugcccaacaacgagcaguuugacaagcuguauauuuggggcguccaccauccuggcacagauaaggaccagaucuuccuuuacgcccagucuuccgggcguauaacugugucaaccaaaagaagccaacaggcuguaauuccaaauaucggaaguaggccccggauucgcgauaucccuucuagaaucuccauuuacuggacaauaguuaagccaggugacaucuugcugauuaacagcaccggcaaucuaaucgccccgaggggguauuuuaaaauacggucgggaaagucuuccauuaugcgcucagacgcgcccaucggcaaauguaagagugaaugcaucacgccuaacgguagcauuccaaaugauaagcccuuccagaacgugaaucgaaucacuuacggggcauguccuagauaugucaaacacuccacacucaagcuggccaccggaaugaggaacgugccagagaaacagacucggggcauuuuuggcgcuauagccggguucaucgaaaauggaugggaggguaugguggacggcugguacggguuucgucaccaaaacucugagggacgcggccaggcagcugaucuuaagagcacacaggccgcgauugaccaaaucaaugguaaacugaacagauugaucgggaagaccaaugaaaaauuccaucagauugagaaggaauuuucagaggucgaaggcaggauacaggaucucgagaaguauguugaggacacgaaaaucgaucuguggaguuacaacgccgaauuacugguggcacucgagaaucagcacaccauugaccuuacagauuccgaaaugaacaagcuguuugagaaaacuaagaaacaauugcgggaaaacgcugaggacaugggaaauggcugcuucaagaucuaucauaagugugauaacgccugcauugggagcauccgaaauggaaccuacgaccacaacguauaccgcgacgaggcucuaaauaacagauuucagauaaaagguguggaacugaagucuggcuauaaagauuggauccucuggauuucauucgccaucaguugcuuucugcuuugugucgcacuguugggguucauuaugugggccugccagaagggaaauaucagguguaacauaugcauuuga

SEQ ID NO: 135675 - RNA, 1701 nt, Artificial Sequence
  derived and/or modified sequence opt3 from hemagglutinin__InfluenzaA__ALN39714
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauugggcugguguuacucaaaacgggacauccucuagcugcauccgcggauccaauucaaguuucuucagccgacugaacuggcugacccaucucaauucuaaguauccagcauuaaacgugacgaugcccaacaaugagcaguuugacaagcuguacauuuggggcguccaccauccuggcacugauaaagaccagaccuuccuuuaugcccagccauccgggcguaucacagugucaacuaagagaagccaacaggcuguaauacccaacauuggaaguaggccucggauccgcgauauuccaucuagaaucuccaucuacuggaccauuguuaaaccgggugacauauugcugaucaauagcacaggcaaccuaauugcccccaggggguacuuuaagauccggucgggaaaaucuuccauaaugcgcucagacgcgccuauuggcaaguguaagagugaaugcaucaccccaaaugguagcauccccaacgauaaaccuuuccagaaugugaaccgaauuacguauggggcauguccaagauacgucaagcaguccacucucaaacuggccacaggaaugaggaaugugcccgagcggcaaacccguggcaucuuuggcgcuauugccggguucauagaaaacggaugggaggguaugguggacggcugguauggguuucgccaccaaaauucugagggaagaggccaggcagcugaucuuaagagcacucaggccgcgaucgaccagauuaacgguaaacugaauagguugaucgggaagacaaacgaaaaauuccaccagaucgagaaggaauuuucagaggucgaaggccggauucaggaucucgagaaguacguugaggacaccaaaauagaucuguggaguuauaaugccgaauuacugguggcacucgagaaccaacauacgaucgaccuuaccgauuccgaaaugaacaagcuguuugagaaaacaaagaaacaguugcgagaaaaugcugaggacaugggaaacggcugcuucaagauuuaccacaagugugauaaugccugcaucgggagcauucgcaacggaacuuaugaccaugacguauacagagaugaggcucuaaauaacagguuucagaucaaagguguggaacugaagucuggcuacaaagacuggauacucuggaucucauucgccauuaguugcuuucugcuuugugucgcacuguugggguucaucaugugggccugccagaagggaaauauucgguguaacaucugcauauga

SEQ ID NO: 135676 - RNA, 1701 nt, Artificial Sequence; identical to SEQ ID NO: 135115
  derived and/or modified sequence opt3 from hemagglutinin__InfluenzaA__ALN39715

SEQ ID NO: 135677 - RNA, 1701 nt, Artificial Sequence; identical to SEQ ID NO: 134457
  derived and/or modified sequence opt3 from hemagglutinin__InfluenzaA__ALN39716

SEQ ID NO: 135678 - RNA, 1701 nt, Artificial Sequence; identical to SEQ ID NO: 134457
  derived and/or modified sequence opt3 from hemagglutinin__InfluenzaA__ALN39717

SEQ ID NO: 135679 - RNA, 1701 nt, Artificial Sequence; identical to SEQ ID NO: 135495
  derived and/or modified sequence opt3 from hemagglutinin__InfluenzaA__ALN39718

SEQ ID NO: 135680 - RNA, 1701 nt, Artificial Sequence; identical to SEQ ID NO: 134457
  derived and/or modified sequence opt3 from hemagglutinin__InfluenzaA__ALN39734

SEQ ID NO: 135681 - RNA, 1701 nt, Artificial Sequence
  derived and/or modified sequence opt3 from hemagglutinin__InfluenzaA__ALN39735
augaagaccaucauugcccugagcuacauacucugccuuguguucgcucagaaaauccccggcaacgacaauuccacagcaacucuguguuuggggcaccaugccgucccuaacggaacgauuguuaagaccaucacagaugacagaauugaggugacuaaugcgaccgaauuaguacaaaacucuucaaucggugagauaugcgauaguccacaccagauccuggacggcgaaaauuguacacuaauugaugcucuccugggggacccgcagugcgauggauuucagaacaaaaagugggaccuuuucguggagaggagcaaagccuauuccaauuguuaccccuaugaugucccugacuacgcaucucugcggucguugguggccucaagcggcacccucgaauuuaacaaugagaguuucaacuggacugguguuacacaaaaugggaccuccucugcuugcauccgccgaagcuccucaaguuucuucagccgucugaacuggcugacgcaucucaauuauacuuacccagcauuaaacgugaccaugcccaauaacgagcaguuugauaagcuguauauuuggggaguccaccauccuggcacagacaaggaucagaucuuccuuuacgcccagucuuccggcagaauaacugugucaaccaaaaggagccaacaggcuguaauuccaaacaucgggagucggccccgcauuagagacaucccuucuaggaucuccauuuacuggacaauaguuaagccaggagacaucuugcugauuaauagcaccgguaaccuaaucgccccgcggggcuauuuuaaaauacgcucggggaagucuuccauuaugcgaucagaugcgcccaucggaaaauguaagagugaaugcaucacgccuaauggcagcauuccaaacgacaagcccuuccagaaugugaacagaaucacuuacggugcauguccuagguaugucaaacacuccacacucaagcuggccaccgggaugcggaaugugccagagaaacagacucguggaauuuuuggcgcuauagccggcuucaucgaaaacgggugggagggaaugguggaugguugguacggcuuucgccaccaaaauucugaggggagaggacaggcagcugaccuuaagagcacacaggccgcgauugaucaaaucaacggcaaacugaauagguugaucgguaagaccaacgaaaaauuccaucagauugagaaggaauuuucagaggucgaagggcggauacaggaccucgagaaguauguugaggauacgaaaaucgaccuguggaguuacaaugccgaauuacugguggcacucgagaaccagcacaccauugaucuuacagacuccgaaaugaauaagcuguuugagaaaacuaagaaacaauugcgagaaaacgcugaggauaugggcaacggaugcuucaagaucuaucauaagugugacaaugccugcauuggcagcauccgcaacgggaccuacgaccacaauguauacagagaugaggcucuaaacaauagguuucagauaaaaggaguggaacugaagucugguuauaaagacuggauccucuggauuucauucgccaucaguugcuuucugcuuugugucgcacuguugggcuucauuaugugggccugccagaaggggaacauccgguguaauauaugcauuuga

SEQ ID NO: 135682 - RNA, 1701 nt, Artificial Sequence
  derived and/or modified sequence opt3 from hemagglutinin__InfluenzaA__ALN39736
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagccaucuggcagaauaacuguguccaccaaaaggucacaacaggcuguaauucccaauaucgggagccggccucgcauuagagauaucccaaguaggaucucuauuuacuggacaauaguuaagccgggagacaucuugcugauuaacuccaccgguaaucuaaucgcgccccggggcuauuuuaaaauacgcgggggaaagagcucgauuaugcgaucugacgccccuaucggcaaauguaaguccgaaugcaucacgccaaacgguucaauucccaaugauaagccuuuccagaacgugaauagaaucacuuacggggcauguccaagguaugucaaacacaguacacucaagcuggccaccggaaugcggaacgugcccgagaaacagacucguggcauuuuuggcgcuauagccggguucaucgaaaauggaugggaggguaugguggacggcugguacggguuucgccaccaaaacagcgagggaagaggccaggcagcugaucuuaaguccacacaggccgcgauugaccaaaucaaugguaaacugaacagguugaucgggaagaccaaugaaaaauuccaucagauugagaaggaauuuucugaggucgaaggccggauacagaaccucgagaaguauguugaggauacgaaaaucgaccuguggagcuacaaugccgaauuacugguggcacucgagaaccagcacaccauugaucuuacagacucagaaaugaacaagcuguuugagaaaacuaagaaacaauugcgagaaaaugcugaggauaugggaaacggcugcuucaagaucuaucauaagugugacaaugccugcauugggaguauccgcaacggaaccuacgaucacaauguauacagagacgaggcucuaaacaauagguuucagauaaaagguguggaacugaaguccggcuauaaagacuggauccucuggauuagcuucgccaucucuugcuuucugcuuugugucgcacuguugggguucauuaugugggccugccagaagggaaacauccgguguaauauaugcauuuga

SEQ ID NO: 135683 - RNA, 1701 nt, Artificial Sequence; identical to SEQ ID NO: 135063
  derived and/or modified sequence opt3 from hemagglutinin__InfluenzaA__ALN39737

SEQ ID NO: 135684 - RNA, 1701 nt, Artificial Sequence
  derived and/or modified sequence opt3 from hemagglutinin__InfluenzaA__ALN39738
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcuuugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacagaacgggaccuccucugcuugcauccgccgaagcuccucaaguuucuucagccgucugaauuggcucacgcauuuaaacuauacuuacccagcacugaaugugaccaugcccaacaacgagcaauuugacaagcuguauauuuggggaguccaccauccuggcacagauaaggaccagaucuucuuguacgcccagucuuccggcagaauaacugugucaaccaaaaggagccagcaagcuguaauuccaaauaucgggagucggccccgcauuagagauaucccuucuaggaucuccauuuacuggacaauaguuaagccaggagacauccugcuaauuaacagcaccgguaaucucaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugcauguccuagguaugucaaacacuccacacugaaacuugccaccgggaugcggaacgugccagagaagcagacucguggaauuuuuggcgcuauagccggcuucaucgaaaaugggugggagggaaugguggacgguugguacggcuuucgccaccagaacucugaggggagaggacaagcagcugaucuuaagagcacacaggccgcgauugaccagaucaauggcaaauugaacaggcucaucgguaagaccaaugaaaaauuccaucaaauugagaaggaauuuucagaggucgaagggcggauacaggaucuggagaaguauguugaggacacgaaaaucgauuuauggaguuacaacgccgaacugcucguggcacuugagaaucagcacaccauugaccugacagauuccgaaaugaacaaguuguuugagaaaacuaagaaacagcuacgagaaaacgcugaggacaugggcaauggaugcuucaagaucuaucauaagugugauaacgccugcauuggcagcauccgcaaugggaccuacgaccacaacguauacagagacgaggcucugaauaacagguuucaaauaaaaggaguggaacucaagucugguuauaaagauuggauccuguggauuucauucgccaucaguugcuuucuucugugugucgcauugcucggcuucauuaugugggccugccagaaggggaauauccgguguaacauaugcauuuga

SEQ ID NO: 135685 - RNA, 1701 nt, Artificial Sequence
  derived and/or modified sequence opt3 from hemagglutinin__InfluenzaA__ALN39739
augaagaccaucauugcccugggcuacauacucugccuuguguucgcucagaaaauccccgggaacgacaauagcacagcaacucuguguuugggacaccaugccgucccuaacgguacgauuguuaagaccaucacaaaugauagaauugaggugacuaacgcgaccgaauuaguacaaaauuccucuaucggcgagauaugcgacucaccacacaaaauccuggauggggaaaacuguacacuaauugacgcucuccugggagauccgcagugcgacggcuuucagaauaagaaaugggaucuuuucguggagaggaguaaggccuauagcaacuguuaccccuaugacgucccugauuacgcaucccugcggucuuugguggccucgucagguacccucgaauuuaauaacgagagcuucaauuggacugggguuacacagaacggaaccaguuccgcuugcauccgccgaucuagcuccucauuuuucagucgucugaauuggcugacgcaucucgacuauacuuacccagcauuaaacgugaccaugcccaauaacgagcaauuugauaagcuguauauuuggggcguccaccauccuggcacagacaaagaucagaucuuccuuuacgcccagagcucugggagaauaacuguguccaccaagaggucacagcaagcuguaauuccaaacaucggaagccggccccgcauuagagacaucccuaguaggaucucuauuuacuggacaauaguuaaaccaggugacaucuugcugauuaauuccaccggcaaccuaaucgccccgcggggguauuuuaagauacgcagcggaaaaucgucuauuaugcgauccgaugcgcccaucggcaaguguaagucagaaugcaucacgccuaaugguaguauuccaaacgacaaacccuuccagaaugugaacagaaucacuuacggggcauguccuagguaugucaagcacagcacacucaaacuggccaccggaaugcggaaugugccagagaagcagacucguggcauuuuuggcgcuauagccggguucaucgaaaacggaugggaggguaugguggauggcugguacggguuucgccaccaaaauuccgagggaagaggccaggcagcugaccuuaaaucuacacaggccgcgauugaucagaucaacgguaagcugaauagguugaucgggaaaaccaacgaaaaguuccaucaaauugagaaggaguucagcgaagucgaaggccggauacaggaccucgagaaauauguugaggauacgaagaucgaccuguggucauacaaugccgaauuacugguggcacucgagaaccagcacaccauugaucuuacagacagugaaaugaauaaacuguuugagaagacuaaaaagcaguugcgagaaaacgcugaggauaugggaaacggcugcuucaagaucuaucauaaaugugacaaugccugcauuggguccauccgcaacggaaccuacgaccacaauguauacagagaugaggcucuaaacaauagguuucaaauaaaggguguggaacugaaaagcggcuauaaggacuggauccucuggauuucuuucgccaucucaugcuuucugcuuugugucgcacuguugggguucauuaugugggccugccagaaaggaaacauccgguguaauauaugcauuuga

SEQ ID NO: 135686 - RNA, 1701 nt, Artificial Sequence
  derived and/or modified sequence opt3 from hemagglutinin__InfluenzaA__ALN39740
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuauacuuacccagcauuaaaugugaccguccccaacaacgagcaguuugacaagcuguauauuuggggagugcaccauccuggcacagauaaagaccagaucuuccuuuacgcccguucuuccggcagaauaacuguaucaaccaagaggagccagcaagcuguuauuccaaauaucggguaccggccccgcauuagagauaucccuaguaggaucucuauuuauuggacaauagugaaaccaggagacaucuugcugauuaacuccaccgguaaucuaaucgccccgcggggcuacuuuaagauacgcagcgggaaaucgucuauuaugcgauccgacgcgcccaucggaaaguguaagucagaaugcaucacgccuaacggcaguauuccaaaugauaaacccuuccagaacgucaauagaaucacuuauggugcauguccuagguacgugaagcacagcacacucaaacuggccaccgggaugcggaacgugccagagaagcagacucguggaauuuuuggcgcuauagccggcuucaucgaaaaugggugggagggaauggucgacgguugguauggcuuucgccaccagaacuccgaggggagaggacaagcagcugaucuuaaaucuacacaggccgcgauugaccagaucaauggcaagcugaacagguugaucgguaaaaccaaugaaaaguuccaucaaauugagaaggaauuuagcgagguugaagggcggauacaggaucucgagaaauacguggaggacacgaagaucgaucuguggucauauaacgccgaauuacugguagcacucgagaaucagcacaccauugaccuuacagauagugaaaugaacaaacuguuugagaagacuaaaaagcaguugcgagaaaacgcugaggacaugggcaauggaugcuucaagaucuaccauaaaugugauaacgccugcauuggcuccauccgcaaugggaccuacgaccacaacguguauagagacgaggcucuaaauaacagguuucaaauaaagggagucgaacugaaaagcgguuacaaggauuggauccucuggauuucuuucgccaucucaugcuuucugcuuuguguggcacuguugggcuucauuaugugggccugccagaaagggaauauccgguguaacauaugcauuuga

SEQ ID NO: 135687 - RNA, 1701 nt, Artificial Sequence; identical to SEQ ID NO: 134457
  derived and/or modified sequence opt3 from hemagglutinin__InfluenzaA__ALN39741

SEQ ID NO: 135688 - RNA, 1701 nt, Artificial Sequence
  derived and/or modified sequence opt3 from hemagglutinin__InfluenzaA__ALN39742
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauacuuacccagcauuaaaugugaccaugcccaacaacgagcaguuugacaagcuguauauuuggggaguccaccauccuggcacagauaaggaccagaucuuccuuuacgcccagucuuccggcagaauaacugugucaaccaaaaggagccaacaggcuguaauuccaaauaucgggagucggccccgcauuagagauaucccuucuaggaucuccauuuacuggacaauaguuaagccaggagacaucuugcugauuaacagcaccgguaaucuaaucgccccgcggggcuauuuuaaaauacgcucggggaagucuuccauuaugcgaucagacgcgcccaucggaaaauguaagagugaaugcaucacgccuaacggcagcauuccaaaugauaagcccuuccagaacgugaauagaaucacuuacggugacuguccuagguaugucaaacacuccacacucaagcuggcaaccgggaugcggaacgugccagagaaacagacucguggaauuuuuggcgccauagcuggcuucaucgaaaaugggugggagggaaugguggaugguugguacggcuuucgccaccaaaacucugaggggagaggacaggccgcagaccuuaagagcacacaggcugccauugaucaaaucaauggcaaacugaacagguugaucgguaagaccaaugaaaaauuccaucagauugagaaggaauuuucagaggucgaagggcggauacaggaccucgagaaguauguugaggauacgaaaaucgaccuguggaguuacaacgcggaauuacugguggcccucgagaaucagcacaccauugaucuuacagacuccgaaaugaacaagcuguuugagaaaacuaagaaacaauugcgagaaaacgcagaggauaugggcaauggaugcuucaagaucuaucauaagugugacaacgcuugcauuggcagcauccgcaaugggaccuacgaccacaacguauacagagaugaggcccuaaauaacagguuucagauaaaaggaguggaacugaagucugguuauaaagacuggauccucuggauuucauucgcuaucaguugcuuucugcuuugugucgcccuguugggcuucauuaugugggcaugccagaaggggaauauccgguguaacauaugcauuuga

SEQ ID NO: 135689 - RNA, 1701 nt, Artificial Sequence
  derived and/or modified sequence opt3 from hemagglutinin__InfluenzaA__ALN39743
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuauauuuacccagcauuaaaugugacuaugcccaacaacgagcaguuugacaagcuguauaucuggggaguccaccauccuggcaccgauaaagaccagauauuccuuuacgcccagucuuccggccguauuacagugucaacuaagagaagccaacaggcuguaaucccaaauauugggaguaggccccggauccgcgauaucccuucuagaauuuccauauacuggaccaucguuaaaccaggagacauuuugcugaucaacagcacagguaaucuaauagccccgaggggcuauuuuaagauucggucggggaaaucuuccaucaugcgcucagacgcgcccaucggaaaguguaagagugaaugcauuaccccuaacggcagcaucccaaaugauaaacccuuccagaacgugaaucgaauuacguacggugcauguccuagauaugucaagcacuccacucucaaacuggccacagggaugaggaacgugccagagaagcagacccggggaauauuuggcgcuaucgccggcuucauugaaaaugggugggagggaaugguggacgguugguacggcuuucgucaccaaaacucugaggggcgcggacaggcagcugaucuuaaaagcacucaggccgcgaucgaccaaaucaauggcaagcugaacagauugauugguaaaacaaaugaaaaguuccaucagauagagaaggaauuuucagaggucgaagggaggauccaggaucucgagaaauauguugaggacaccaagauugaucuguggaguuacaacgccgaauuacugguggcacucgagaaucagcacacgaucgaccuuaccgauuccgaaaugaacaaacuguuugagaagacuaaaaagcaauugcgggaaaacgcugaggacaugggcaauggaugcuucaagauuuaucauaaaugugauaacgccugcaucggcagcauacgaaaugggacauacgaccacaacguauaccgcgacgaggcucuaaauaacagauuucagaucaagggaguggaacugaaaucugguuauaaggauuggauucucuggaucucauucgccauuaguugcuuucugcuuugugucgcacuguugggcuucaucaugugggccugccagaaagggaauauaagguguaacauuugcaucuga

SEQ ID NO: 135690 - RNA, 1701 nt, Artificial Sequence
  derived and/or modified sequence opt3 from hemagglutinin__InfluenzaA__ALN39744
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuauacuuacccagcauuaaaugugaccaugcccaacaacgagcaguuugacaagcuguauauuuggggaguccaccauccuggcacagauaaagaccagaucuuccuuuacgcccagucuuccggccguauaacugugucaaccaagagaagccaacaggcuguaauuccaaauaucgggaguaggccccggauucgcgauaucccuucuagaaucuccauuuacuggacaauaguuaaaccaggagacaucuugcugauuaacagcaccgguaaucuaaucgccccgaggggcuauuuuaagauacggucggggaaaucuuccauuaugcgcucagacgcgcccaucggaaaguguaagagugaaugcaucacgccuaacggcagcauuccaaaugauaaacccuuccagaacgugaaucgaaucacuuacggugcauguccuagauaugucaagcacuccacacucaaacuggccaccgggaugaggaacgugccagagaagcagacucggggaauuuuuggcgcuauagccggcuucaucgaaaaugggugggagggaaugguggacgguugguacggcuuucgucaccaaaacucugaggggcgcggacaggcagcugaucuuaaaagcacacaggccgcgauugaccaaaucaauggcaagcugaacagauugaucgguaaaaccaaugaaaaguuccaucagauugagaaggaauuuucagaggucgaagggaggauacaggaucucgagaaauauguugaggacacgaagaucgaucuguggaguuacaacgccgaauuacugguggcacucgagaaucagcacaccauugaccuuacagauuccgaaaugaacaaacuguuugagaagacuaaaaagcaauugcgggaaaacgcugaggacaugggcaauggaugcuucaagaucuaucauaaaugugauaacgccugcauuggcagcauccgaaaugggaccuacgaccacaacguauaccgcgacgaggcucuaaauaacagauuucagauaaagggaguggaacugaaaucugguuauaaggauuggauccucuggauuucauucgccaucaguugcuuucugcuuugugucgcacuguugggcuucauuaugugggccugccagaaagggaauaucagguguaacauaugcauuuga

SEQ ID NO: 135691 - RNA, 1701 nt, Artificial Sequence
  derived and/or modified sequence opt3 from hemagglutinin__InfluenzaA__ALN39745
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcaagagcuccucaaguuucuucagccgacugaauuggcugacgcaucucaacuauaaguacccagcauuaaaugugacuaugcccaacaacgagcaguuugacaaacuguauauuuggggaguccaccauccuggcaccgauaaggaccagaucuuccuuuacgcccagucuuccggccguauaacagugucaacuaaaagaagccaacaggcuguaauuccaaauaucgggaguaggccccggauucgcgauaucccuucuagaaucuccauuuacuggaccauaguuaagccaggagacaucuugcugauuaacagcacagguaaucuaaucgccccgaggggcuauuuuaaaauacggucggggaagucuuccauuaugcgcucagacgcgcccaucggaaaguguaaaagugaaugcaucaccccuaacggcagcauuccaaaugauaagcccuuccagaacgugaaucgaaucacguacggugcauguccuagauaugucaaacacuccacucucaagcuggccacagggaugaggaacgugccagagaaacagacccggggaauuuuuggcgcuauagccggcuucaucgaaaaugggugggagggaaugguggacgguugguacggcuuucgucaccaaaacucugaggggcgcggacaggcagcugaucuuaagagcacucaggccgcgauugaccaaaucaauggcaaacugaacagauugaucgguaagacaaaugaaaaguuccaucagauugagaaagaauuuucagaggucgaagggaggauacaggaucucgagaaguauguugaggacaccaaaaucgaucuguggaguuacaacgccgaauuacugguggcacucgagaaucagcacacgauugaccuuaccgauuccgaaaugaacaagcuguuugagaaaacaaagaagcaauugcgggaaaacgcugaggacaugggcaauggaugcuucaaaaucuaucauaagugugauaacgccugcauuggcagcauccgaaaugggacuuacgaccacaacguauaccgcgacgaggcucuaaauaacagauuucagauaaaaggaguggaacugaagucugguuauaaagauuggauccucuggauuucauucgccaucaguugcuuucugcuuugugucgcacuguugggcuucauuaugugggccugccagaaggggaauaucagguguaacauaugcauuuga

SEQ ID NO: 135692 - RNA, 1701 nt, Artificial Sequence; identical to SEQ ID NO: 135690
  derived and/or modified sequence opt3 from hemagglutinin__InfluenzaA__ALN39746

SEQ ID NO: 135693 - RNA, 1701 nt, Artificial Sequence; identical to SEQ ID NO: 135385
  derived and/or modified sequence opt3 from hemagglutinin__InfluenzaA__ALN39747

SEQ ID NO: 135694 - RNA, 1701 nt, Artificial Sequence
  derived and/or modified sequence opt3 from hemagglutinin__InfluenzaA__ALN39748
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuaugcauacccagccuuaaaugugacuaugcccaacaacgagcaguuugacaagcuguauauuuggggaguccaccauccuggcaccgauaaggaccagaucuuccuuuacgcucagucuuccggcagaauaacagugucaacuaaaaggagccaacaggccguaauuccaaauaucgggagucggccccgcauuagagauaucccuucuaggaucuccauuuacuggaccauaguuaagccaggagacaucuugcugauuaacagcacagguaaucuaaucgcgccgcggggcuauuuuaaaauacucucggggaagucuuccauuaugcgcucagacgcacccaucggaaaauguaagagugaaugcaucaccccuaacggcagcauuccaaaugauaagcccuuccagaacgugaaucgaaucacguacggugccuguccuagauaugucaaacacuccacucugaagcuggcuacagggaugaggaacgugccagagaaacagacccggggaauuuuuggcgccauagcaggcuucaucgaaaaugggugggagggaaugguggacgguugguacggcuuucgucaccaaaacucugaggggcgcggacaggcugccgaucuuaagagcacucaggcggccauugaccaaaucaauggcaaauugaacagacucaucgguaagacaaaugaaaaauuccaucagauugagaaggaauuuucagaggucgaagggaggauacaggaucuggagaaguauguugaggacaccaaaaucgauuuauggaguuacaacgcagaacugcucguggcucuugagaaucagcacacgauugaccugaccgauuccgaaaugaacaaguuguuugagaaaacaaagaaacaacuacgggaaaacgccgaggacaugggcaauggaugcuucaagaucuaucauaagugugauaacgcuugcauuggcagcauccgaaaugggacuuacgaccacaacguauaccgcgacgaggcccugaauaacagauuucagauaaaaggaguggaacucaagucugguuauaaagauuggauccuguggauuucauucgcaaucaguugcuuucuucugugugucgccuugcucggcuucauuaugugggcuugccagaaggggaauaucagguguaacauaugcauuuga

SEQ ID NO: 135695 - RNA, 1701 nt, Artificial Sequence
  derived and/or modified sequence opt3 from hemagglutinin__InfluenzaA__ALN39749
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcaacaguccacaccagauacuagacggcgaaaauuguacacucaucgaugcucugcuuggggacccgcagugcgauggauuucagaacaaaaagugggaccuguucguggagaggagcaaagccuauuccaauuguuaccccuaugaugucccugacuacgcaucuuugcggucgcucguggccucaagcggcacccuggaauuuaacaaugagaguuucaacugggcugguguuacucaaaaugggacauccucuagcugcauucgcggauccaacucaaguuucuucagccgacugaauuggcucacccauuuaaacucuaaguauccagcacugaacgugacgaugcccaauaacgagcaguuugauaagcuguacaucuggggcguccaccauccuggcacugacaaagaucagauuuucuuguaugcccagccauccgggcguaucaccgugucaacaaagagaagccaacaggcuguaauacccaauauuggaaguaggccucggauccgcgacauuccaucuagaaucuccaucuacuggacuauuguuaaaccgggugauauacugcuaaucaacagcaccggcaaucucauugcccccaggggguacuuuaagauccggucgggaaaaucuuccauaaugcgcucagacgcgccuauuggcaaguguaagagugaaugcaucacaccaaacgguagcauccccaaugacaaaccuuuccagaacgugaaucgaauuaccuauggggcauguccaagauacgucaagcaguccacgcugaaacuugccacuggaaugaggaacgugcccgagcggcaaacacguggcaucuuuggcgcuauugccggguucauagaaaauggaugggaggguaugguggauggcugguauggguuucgccaccagaacucugagggaagaggccaggcagcugaccuuaagagcacccaagccgcgaucgaucagauuaaugguaaauugaacaggcucaucgggaagacuaaugaaaaauuccaccagaucgagaaggaauuuucagaggucgaaggccggauucaggaccuggagaaguacguugaggauacaaaaauagacuuauggaguuauaacgccgaacugcucguggcacuugagaaccaacauaccaucgaucugacggacuccgaaaugaauaaguuguuugagaaaaccaagaaacagcuacgagaaaacgcugaggauaugggaaauggcugcuucaagauuuaccacaagugugacaacgccugcaucgggagcauucgcaauggaacauaugaucaugacguauacagagacgaggcucugaacaauagguuucagaucaaagguguggaacucaagucuggcuacaaagauuggauacuguggaucucauucgccauuaguugcuuucuucugugugucgcauugcucggguucaucaugugggccugccagaagggaaacauucgguguaauaucugcauauga

SEQ ID NO: 135696 - RNA, 1701 nt, Artificial Sequence; identical to SEQ ID NO: 134457
  derived and/or modified sequence opt3 from hemagglutinin__InfluenzaA__ALN39750

SEQ ID NO: 135697 - RNA, 1701 nt, Artificial Sequence; identical to SEQ ID NO: 134457
  derived and/or modified sequence opt3 from hemagglutinin__InfluenzaA__ALN39789

SEQ ID NO: 135698 - RNA, 1701 nt, Artificial Sequence; identical to SEQ ID NO: 134987
  derived and/or modified sequence opt3 from hemagglutinin__InfluenzaA__ALO75895

SEQ ID NO: 135699 - RNA, 1701 nt, Artificial Sequence
  derived and/or modified sequence opt3 from hemagglutinin__InfluenzaA__ALO75907
auggagaagaucgugcugcuccuugccauugucagccugguuaaaggcgaccagauaugcaucggguaccacgcuaacaauuccaccgaacaaguggauacaauuauggagaagaacguaacugugacgcaugcacaggacaucuuggaaaagacccacaauggaaaguuaugugaucugaacggugucaaaccccuaauucucaaggacugcucuguggccggcugguuccuggggaauagaaugugugaugaguuuaucaggguuccugaauggucauauauaguggagcgggcgaacccagcuaaugaccuuugcuacccgggaaaccugaaugauuaugaggaauugaagcaucuccugagucgcaucaaccacuucgagaaaacacugauuauccccaagagcuccuggccuaaucauacuucuucgggcgucucagccgcauguccauaccaggguaugcccagcuuuuuccgaaacgugguauggcucaccaaaaagaaugacgccuauccuacaauuaaaaugaguuacaacaauaccuaucgugaagauuuacugauccuuugggggauacaccacuccaacaacgcugcagagcagacuaauuuguacaagaacccaacaaccuacguuucugugggaacgagcacucugaaucaaagacuagagcccaagauugccaccaggucccaggucaacggccagcggggccgcauggacuuuuucuggacaauccucaaaccuaaugaugcuauucauuuugaaucaaacgggaauuucaucgccccagaguaugcguacaagaucgugaaaaagggagacaguacuauuaugaaaagcgaaauggaguauggucacugcaacaccaagugucagacaccgauaggcgcaaucaauucuuccaugcccuuucauaacauucacccucugaccaucggggaaugcccaaaauacgugaagucaaauaaacuuguccuggccacgggauugagaaacagcccccucagggagcggcgccgaaaaagaggccuguucggugcuauagccggguuuauugagggaggcuggcaaggcaugguugaugggugguauggauaccaccauaguaaugaacaggguucuggcuaugcagcugacagggaguccacucagaaggccaucgacggggugacaaacaaaguaaauagcaucauugauaagaugaacacccaguucgaagcggugggacgggaguuuaacaauuuagaacgucgcaucgagaaccugaauaaaaagauggaggacggcuuccucgaugucuggacuuacaacgccgaacuucugguguugauggagaaugaaagaacacuagacuuccacgauucgaacguuaagaaucuguacgacaaagugaggcuccaacugcgggauaacgcaaaggagcuugguaauggguguuuugaguucuaucauaaaugcgacaacgaauguauggagucuguccgaaauggcaccuacgauuauccucuguacuccgaagaggcucgcuugaagagagaagagauuucaggagugaaacucgagaguauaggcacguaucagauccugagcaacuacuccaccguagccucuagcuuagcucuggccauuaucguugcagggcuaucacucuggaugugcaguaauggaucccugcagugcaggaucuguauuuga

SEQ ID NO: 135700 - RNA, 1701 nt, Artificial Sequence
  derived and/or modified sequence opt3 from hemagglutinin__InfluenzaA__ALO75919
auggagaagaucgugcugcuccuugccauugucagccugguuaaaggcgaccagauaugcaucggguaccacgcuaacaauuccaccgaacaaguggauacaauuauggagaagaacguaacugugacgcaugcacaggacaucuuggaaaagacccacaauggaaaguuaugugaucugaacggugucaaaccccuaauucucaaggacugcucuguggccggcuggcugcaugggaauagaaugugugaugaguucaucaggguuccugaauggucauauauaguggagcgggcgaacccagcuaaugaccuuugcuacccgggaaaccugaaugauuaugaggaauugaagcaccuccugagucgcaucaaccauuuugagaaaacacugauuauccccaagagcuccuggccuaaucacacuucuucgggcgucucagccgcauguccauaccaggguaugcccagcuucuuucgaaacgugguauggcucaccaaaaagaaugacgccuauccuacaauuaaaaugaguuacaacaauaccuaucgugaagauuuacugauccuuugggggauacaccauuccaacaacgcugcagagcagacuaauuuguacaagaacccaacaaccuacguuucugugggaacgagcacucugaaucaaagacuagagcccaagauugccaccaggucccaggucaacggccagcggggccgcauggacuucuuuuggacaauccucaaaccuaaugaugcuauucacuucgaaucaaacgggaauuuuaucgccccagaguaugcguacaagaucgugaaaaagggagacaguacuauuaugaaaagcgaaauggaguauggucauugcaacaccaagugucagacaccgauaggcgcaaucaauucuuccaugcccuuccacaacauucacccucugaccaucggggaaugcccaaaauacgugaagucaaauaaacuuguccuggccacgggauugagaaacagcccccucagggagcggcgccgaaaaagaggccuguuuggugcuauagccggguucauugagggaggcuggcaaggcaugguugaugggugguauggauaccaucacaguaaugaacaggguucuggcuaugcagcugacagggaguccacucagaaggccaucgacggggugacaaacaaaguaaauagcaucauugauaagaugaacacccaguuugaagcggugggacgggaguucaacaauuuagaacgucgcaucgagaaccugaauaaaaagauggaggacggcuuucucgaugucuggacuuacaacgccgaacuucugguguugauggagaaugaaagaacacuagacuuccaugauucgaacguuaagaaucuguacgacaaagugaggcuccaacugcgggauaacgcaaaggagcuugguaauggguguuucgaauuuuaucacaaaugcgacaacgaguguauggagucuguccgaaauggcaccuacgauuauccucuguacuccgaagaggcuucauugaagcgcgaagagauuaguggagugaaacucgagagcauaggcacguaucagauccuguccauuuacucuaccguagccagcucauuagcucuggccaucaucguugcagggcuaagucucuggaugugcuccaacggaagccugcagugcagaauuuguauauga

SEQ ID NO: 135701 - RNA, 1683 nt, Artificial Sequence
  derived and/or modified sequence opt3 from hemagglutinin__InfluenzaA__ALT20080
auggagaccgugagccugaucacaauucuccuugucgccacuguuuccaacgcugacaagauaugcaucggcuaccagucuacuaauucaaccgaaacaguggauacucugaccgagaacaauguacccgugacacacgcaaaagaauuguuacauaccgagcacaacgggaugcugugugccacgagucuaggacaaccucucauucuggacacaugcaccaucgaaggucuuauuuauggcaauccaagcugugaucuguccuuggaggggagagaguggucuuacaucgucgaaaggccgucggcggugaacggacucugcuaucccggcaauguugagaaccuggaggaacugcggucacucuucagcagugcucgcuccuaccagcgaauacagaucuuuccugacacgauuuggaaugugucuuaugaugguacuagcaccgccuguuccgggucauucuaccguaguaugagaugguuaacaaggaagaacggagacuauccaauccaggaugcacaauacacuaauaaccagggcaaaaauauucuguuuauguggggcaucaaccaucccccuaccgacacaacccagcgggaucuuuacacgcgcacugacacaaccacuagcgucgccacagaggaaauaaauagaauuuucaagccauugaucgggcccaggccucuggugaacggacuaaugggucggauugauuauuacuggucuguacucaaaccaggccagacccugcgcaucaaguccgacgggaaccuuaucgcuccgugguuuggacacauucugucaggcgagagccauggucgaauauugaagacgaaucucaaaagagggaguugcaccguucaaugucagacagaaaagggaggccugaacacuaccuuacccuuccagaaugugucuaaauaugcauuuggcaacugcuccaaguacaucgggauuaaaagccugaagcucgccgucggacuuaggaaugugccuucgcggucuucccguggucuguucggcgcuaucgccggguuuauagagggaggcuggucagguuugguggcggggugguauggcuuccagcacaguaacgaucaaggagucggcauggcagccgaccgcgacagcacacagaaggcuauugauaaaaucacuuccaagguuaauaacaucguggacaaaaugaauaagcaguacgaaauuaucgaucacgaguuuucugagguagaaaccagacuaaacaugauuaauaacaaaauagacgaucaaauccaggacauuugggccuauaaugcagagcugcucgugcugcuugaaaaccagaagacacuggaugagcaugacgcuaaugucaacaacuuguacaauaaagugaagagggcccucgggagcaacgcgguugaagauggaaaggguuguuucgagcuguaccacaaaugcgacgaucaguguauggagaccauccggaauggcacuuauaaccgacgcaaguaccaagaagagucaaaauuagaaagacagaagaucgagggggugaaacuggaaagugagggaacguauaagauucuaacaauauacuccaccgucgccagcucucucgugaucgcaaugggcuuugcugccuuccuguucugggcuaugucaaaugguaguuguaggugcaacauuugcaucuga

SEQ ID NO: 135702 - RNA, 1701 nt, Artificial Sequence
  derived and/or modified sequence opt3 from hemagglutinin__InfluenzaA__ALT66860
augaaggccauccuggugguccuccuuuacaccuucacaacugcuaacgcagacacgcugugcauuggcuaucacgccaauaacagcaccgauacaguugacacuguguuggagaagaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuaacucggacaauggaacaugcuauccaggcgauuuuaucaacuacgaagaacucagggagcagcugucaagcgugaguuccuucgaacgguuugagauuuucccgaagaccucuagcuggcccaaucacgacuccaacaagggugucacggcagccuguccucaugcuggggcaaaaucauuuuauaagaaucugaucuggcucgugaaaaagggaaacaguuacccaaaauuaaaucaaagcuauauaaacgauaagggcaaggaaguacugguucuuuggggcauccaccaccccucuacuaccgccgaccagcaguccuuguaccagaacgcugaugccuacguguucgucgggacaucacgcuauagcaaaaaguuuaaaccugagauugcgacucgaccaaaggugcgugaccaagagggaagaaugaauuacuauuggacccugguggaacccggugauaaaaucacauucgaggcaaccggcaaccuagucguuccuagguacgccuuuacgauggaacggaaugcugggaguggaauuaucauaucugacacuccagugcaugauugcaacacaaccugucagacuccggagggcgccauuaauacaucccuccccuuccagaacauccacccuauuaccaucgguaagugcccaaaauauguaaagagcacgaagcugcgccuugcaaccgggcugagaaaugugcccucgauccagucuaggggauuguuuggcgcuauugccggcuucauagaagggggauggacagguauggucgacggcugguacggguaucaucaccaaaacgagcagggauccggcuacgcggccgaccucaaaucaacucagaaugcaaucgauaagauuaccaacaaagugaauaguguuaucgagaagaugaacacacaguuuacugcuguggguaaagaguucaaucaccuggagaagcggauagaaaacuuaaauaagaaagucgacgauggguuccuggacauuuggaccuacaacgccgagcuccuugugcuguuggaaaacgagcgcacacuagauuaucaugacagcaauguaaagaaccuguacgagaaaguucgaaaucaacucaagaacaaugcuaaagaaaucggcaacggauguuuugaguucuaucacaagugcgauaauaccuguauggaauccgugaagaacggcacuuacgacuauccuaaauacucugaggaagccaagcugaauagagagaaaaucgauggggucaaacuugagagcacgaggauuuaucagauccuggcaauuuacucaacaguggccaguuccuugguccucgugguuagccugggagcuauaucuuuuuggaugugcucaaacgguaguuuacagugccggaucuguauuuga

SEQ ID NO: 135703 - RNA, 1701 nt, Artificial Sequence
  derived and/or modified sequence opt3 from hemagglutinin__InfluenzaA__AMA65391
augaaggccauccuggugguccuccuuuacaccuucacaacugcuaacgcagacacgcugugcauuggcuaucacgccaauaacagcaccgauacaguugacacuguguuggagaagaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuaacucggacaauggaacaugcuauccaggcgauuuuaucaacuacgaagaacucagggagcagcugucaagcgugaguuccuucgaacgguuugagauuuucccgaagaccucuagcuggcccaaucacgacuccaacaagggugucacggcagccuguccucaugcuggggcaaaaucauuuuauaagaaucugaucuggcucgugaaaaagggaaacaguuacccaaaauuaaaucaaagcuauauaaacgauaagggcaaggaaguacugguucuuuggggcauccaccaccccucuacuaccgccgaccagcaguccuuguaccagaacgcugaugccuacguguucgucgggacaucacgcuauagcaaaaaguuuaaaccugagauugcgacucgaccaaaggugcguggacaagaggguagaaugaauuacuauuggacccugguggaacccggcgacaaaaucacauucgaggcaaccgggaaccuagucguuccuagguacgccuuuacgauggaacggaaugcuggaaguggcauuaucauaucugauacuccagugcaugacugcaacacaaccugucagacuccggagggugccauuaauacaucccuccccuuccagaacauccacccuauuaccaucgggaagugcccaaaauauguaaagagcacgaagcugcgccuugcaaccggacugagaaaugugcccucgauccagucuaggggcuuguuuggcgcuauugccggguucauagaaggagguuggacaggcauggucgaugggugguacggauaucaucaccaaaacgagcagggcuccgguuacgcggccgaccucaaaucaacucagaaugcaaucgacaagauuaccaacaaagugaauaguguuaucgagaagaugaacacacaguuuacugcuguggggaaagaguucaaucaccuggagaagcggauagaaaacuuaaauaagaaagucgaugacggcuuccuggauauuuggaccuacaacgccgagcuccuugugcuguuggaaaacgagcgcacacuagacuaucaugauagcaauguaaagaaccuguacgagaaaguucgaaaucaacucaagaacaaugcuaaagaaaucggaaacggcuguuuugaguucuaucacaagugcgacaauaccuguauggaauccgugaagaacgggacuuacgauuauccuaaauacucugaggaagccaagcugaauagagagaaaaucgacggagucaaacuugagagcacgaggauuuaucagauccuggcaauuuacucaacaguggccaguuccuugguccucgugguuuuucugggugcuaucagcuucuggaugugcucuaacggcucauuacagugccggauauguauuuga

SEQ ID NO: 135704 - RNA, 1701 nt, Artificial Sequence
  derived and/or modified sequence opt3 from hemagglutinin__InfluenzaA__AMA65393
augaaggccauccuggugguccuccuuuacaccuucacaacugcuaacgcagacacgcugugcauuggcuaucacgccaauaacagcaccgauacaguugacacuguguuggagaagaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuaacucggacaauggaacaugcuauccaggcgauuuuaucaacuacgaagaacucagggagcagcugucaagcgugaguuccuucgaacgguuugagauuuucccgaagaccucuagcuggcccaaucacgacuccaacaagggugucacggcagccuguccucaugcuggggcaaaaucauuuuauaagaaucugaucuggcucgugaaaaagggaaacaguuacccaaaauuaaaucaaagcuauauaaacgauaagggcaaggaaguacugguucuuuggggcauccaccaccccucuacuaccgccgaccagcaguccuuguaccagaacgcugaugccuacguguucgucgggacaucacgcuauagcaaaaaguuuaaaccugagauugcgacucgaccaaaggugcgugaccaagagggaagaaugaauuacuauuggacccugguggaacccggugauaaaaucacauucgaggcaaccggcaaccuagucguuccuagguacgccuuuacgauggaacggaaugcugggaguggaauuaucauaucugacacuccagugcaugauugcaacacaaccugucagacuccggagggcgccauuaauacaucccuccccuuccagaacauccacccuauuaccaucgguaagugcccaaaauauguaaagagcacgaagcugcgccuugcaaccgggcugagaaaugugcccucgauccagucuaggggauuguuuggcgcuauugccggcuucauagaagggggauggacagguauggucgacggcugguacggguaucaucaccaaaacgagcagggauccggcuacgcggccgaccucaaaucaacucagaaugcaaucgauaagauuaccaacaaagugaauaguguuaucgagaagaugaacacacaguuuacugcuguggguaaagaguucaaucaccuggagaagcggauagaaaacuuaaauaagaaagucgacgauggguuccuggacauuuggaccuacaacgccgagcuccuugugcuguuggaaaacgagcgcacacuagauuaucaugacagcaauguaaagaaccuguacgagaaaguucgaaaucaacucaagaacaaugcuaaagaaaucggcaacggauguuuugaguucuaucacaagugcgauaauaccuguauggaauccgugaagaacggcacuuacgacuauccuaaauacucugaggaagccaagcugaauagagagaaaaucgauggggucaaacuugagagcacgaggauuuaucagauccuggcaauuuacucaccaguggccaguuccuugguccucgugguuuuucugggagcuaucagcuucuggaugugcucuaacgguucauuacagugccggauauguauuuga

SEQ ID NO: 135705 - RNA, 1701 nt, Artificial Sequence
  derived and/or modified sequence opt3 from hemagglutinin__InfluenzaA__BAA02768
augaaggccaaacugcucgugcuucugugcgcuuucaccgcaacagacgccgauacuaucuguauuggcuaccacgcgaacaauagcacggacaccgucgauacaguuuuggagaagaacgugacuguaacccauuccgugaauuuacuggaagacucucacaacgggaaacuaugcagacucaagggaauagcuccccugcagcuugguaauuguucaaucgccggcuggauucuggggaacccugagugcgaaaguuuguuuagcaaagaguccuggucuuauaucgcagaaacaccaaauucggagaacggaaccuguuacccgggcuauuucgccgauuacgaggaacucagggagcaacugucaagcgucaguuccuuugaacgguucgagauuuuucccaaggagucuagcuggccuaaucauacugugacaaaggguguuaccgcuuccugcucacacaacgggaaaaguagcuucuaucgcaaucugcucugguuaacgggaaagaacggccuguacccaaaucuuucuaaauccuaugugaacaauaaggaaaaagaggucuuggugcuguggggcguacaucaccccucaaacaucggggaccagcgagcaauauaccacacugaaaacgccuacguuagcguggucaguucucauuauucccguagauuuaccccugagaucgcuaagaggccaaaggugcggggacaggaaggucgcauuaauuacuauuggacacuacucgagcccggcgauacuaucauuuucgaggccaacgggaaucugaucgcgccuugguacgcauuugcccuuagcagaggauucggcucggguauaauuaccucuaacgcuuccauggacgaaugugaugccaaaugccagacaccacaaggggcaaucaauucaagucugccguuucagaacgugcaccccgucaccauuggagaguguccuaaguauguuaggagcacgaaauugcggauggugacuggccuccgcaauaucccauccauccagucucgaggccuguucggggcuauugccggauuuauagaagguggcuggacagggaugaucgacggaugguacggcuaucaucaccagaacgagcaagguagcggguacgcggccgaucagaagucaacccagaaugcaauuaacggcaucacuaauaaaguaaacagugugauagaaaagaugaauacacaguucaccgcugucggaaaagaguucaacaaguuagagagaaggauggaauaccugaauaagaaaguggacgauggcuuucucgacauuuggacguauaacgccgagcuucugguuuugcuagaaaacgagcggacccuggacuuccacgauuccaaugugaagaaccucuacgaaaaagucaagagccaacugaaaaauaacgcuaaggagaucggguauggaugcuuugaguucuaccauaaguguaauaacgaaugcauggagucugugaaaaaugguacauaugacuaccccaaguauucagaagagaguaaacuuaaccgugagaagaucgauggcguaaaacuggaaagcauggggguuuaccagauuuuggccaucuacuccacuguggcaucuucgcucguccuguuagugagccugggagccauuuccuuuuggaugugcucaaauggcagucuacagugucgcauaugcaucuga

SEQ ID NO: 135706 - RNA, 1701 nt, Artificial Sequence
  derived and/or modified sequence opt3 from hemagglutinin__InfluenzaA__BAA02769
augaaggccaaacugcucgugcuucugugcgcuuucaccgcaacagacgccgauacuaucuguauuggcuaccacgcgaacaauagcacggacaccgucgauacaguuuuggagaagaacgugacuguaacccauuccgugaauuuacuggaagacucucacaacgggaaacuaugcagacucaagggaauagcuccccugcagcuugguaauuguucaaucgccggcuggauucuggggaacccugagugcgaaaguuuguuuagcaaagaguccuggucuuauaucgcagaaacaccaaauucggagaacggaaccuguuacccgggcuauuucgccgauuacgaggaacucagggagcaacugucaagcgucaguuccuuugaacgguucgagauuuuucccaaggagucuagcuggccuaaucauacugugacaaaggguguuaccgcuuccugcucacacaacgggaaaaguagcuucuaucgcaaucugcucugguuaacgggaaagaacggccuguacccaaaucuuucuaaauccuaugugaacaauaaggaaaaagaggucuuggugcuguggggcguacaucaccccucaaacauccgagaccagcgugcaauauaccacacugaaaacgccuacguuagcguggucaguucucauuauuccagaagguuuaccccugagaucgcuaagcggccaaaggugcgcgaucaggaagggagaauuaauuacuauuggacacuacucgagcccggagacacuaucauuuucgaggccaacgguaaucugaucgcgccuugguacgcauuugcccuuagcaggggcuucgggucgggaauaauuaccucuaacgcuuccauggaugaaugugacgccaaaugccagacaccacaaggcgcaaucaauucaagucugccguuucagaacgugcaccccgucaccauuggugaguguccuaaguauguucggagcacgaaauugcgcauggugaaggggcuccgaaauaucccauccauccagucuagaggacuguucggcgcuauugccggcuuuauagaagggggauggacugguaugaucgauggcugguacggguaucaucaccagaacgagcaaggaagcggcuacgcggccgaccagaaaucaacacagaaugcaauuaacgguaucaccaauaagguaaacagugugauagaaaagaugaauacucaguucacagcugucgggaaggaguucaacaaguuagagaggcggauggaauaccugaauaaaaagguggaugacggcuuucucgacauuuggaccuauaacgccgagcuucugguuuugcuagaaaacgagcguacgcuggauuuccacgacuccaaugugaaaaaccucuacgaaaaggucaaaagccaacugaagaauaacgcuaaggagaucggauauggcugcuuugaguucuaccauaaauguaauaacgaaugcauggagucugugaagaaugggaccuaugauuaccccaaauauucagaagagaguaaacuuaaccgcgagaaaaucgacggaguaaagcuggaaagcauggguguuuaccagauuuuggccaucuacuccacaguggcaucuucgcucguccuguuagugagccugggcgccauuuccuuuuggaugugcucaaaugggagucuacaguguagaauaugcaucuga

SEQ ID NO: 135707 - RNA, 1689 nt, Artificial Sequence
  derived and/or modified sequence opt3 from hemagglutinin__InfluenzaA__BAC43764
auggccaucauuuaccugauacuccuuuucaccgcugugagaggcgaccagaucugcauuggguaucacgcaaacaauagcacagagaaggucgauacuauccuggaaaggaacguuacggugacccaugccaaaaauauuuuggagaagacacacaacggaaaauuauguaagcugaaugguauacccccucuagaacucggcgacugcuccauagcgggguggcugcuuggaaacccagagugugaucggcuguugaucguaccggaauggucuuacauuauggagaaagagaauccccgcgacggccucugcuauccugguucauuuaacgauuacgaagaacugaagcaucugcucaguagcgugaagcacuucgaaaaagucaagaucuuaccaaaagaccgauggacucaacauaccacaaccgggggaucccgugcuugugccgugucuggcaaucccucguuuuucagaaacaugguuuggcugacuaagaaaggcucaaauuauccuguggcaaaggggagcuacaacaauacaaguggagagcagaugcuuauuaucugggguguccaccacccaauagaugagaccgaacagauuacguuguaucagaacgugggcacuuacguauccguugggaccucuacacugaauaagaggagcacucccgagaucgccacccggccuaaagugaacggacuaggcucccgcauggaauuuucauggacacuccuggacaugugggauaccauuaacuucgagaguacggguaaucuuaucgcuccagaauacggguuuaagaucagcaaaagaggaucuuccggcauuaugaagacugagggcacacuggagaacugcgaaaccaaaugucaaacuccguugggggcaauaaauacaacccuccccuuccauaacguccacccucugacgaucggagagugcccaaaguaugugaaaucagaaaaguuagugcuggccaccggucucaggaaugucccccagauugagagccggggccuuuuuggggcuaucgccggauucauagaaggcgguuggcaggggaugguugacggcugguacggauaucaucacaguaacgaucagggcucuggguacgcggcagacaaggaguccacacaaaaagccuuugauggaauuacuaauaaggugaacagcguaaucgagaaaaugaauacccaguucgaagcuguggguaaggaguuuucgaaccuggaacgccgauuggagaaucuaaacaaaaagauggaagacggcuuccuggacgucuggacauauaaugccgagcuccuggugcuuauggagaacgaaagaacucuggauuuccacgacucuaauguuaagaacuuguacgauaaagugaggaugcagcuccgggacaacgucaaggagcuggggaauggauguuuugaguucuaucauaaaugcgaugacgaguguaugaacuccgugaagaauggcaccuacgauuacccuaaauaugaggaagagucaaaguuaaaccguaaugaaaucaaggguguaaaacugaguagcauggggguuuaccagauucuagcaaucuaugcuacaguggccggcucccucucucuggcgauuaugauggccggaaucagcuuuuggaugugcucaaacggcagucuucaauuccgcaucugcauuuga

SEQ ID NO: 135708 - RNA, 1707 nt, Artificial Sequence
  derived and/or modified sequence opt3 from hemagglutinin__InfluenzaA__BAE07201
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggagaaaacccacaaugggaaguugugugauuuagacggagucaaaccccugauucuaagagauugcucaguggccgguuggcuccugggcaacccuaugugugacgaauuuaucaauguuccagaauggaguuauauaguggagaaggcgaacccggcuaaugaucuuugcuaccccggggacuucaacgauuaugaggaacugaagcauuugcucagcaggaucaaucacuuugagaaaauucagaucauuccuaagaacuccuggucuucgcaugaagccucacugggagucagcagugcauguccauaccagggcaaauccucuuucuuucggaaugugguauggcugaucaagaaaaacaaugccuaucccacaauaaagcgcagcuacaacaauacuaaccaagaggaccucuuaguucugugggguauucaccacccuaacgaugcugcagagcagacccgacuuuaucagaauccaacaaccuacaucuccguggggacuucaacauugaaccagcgucugguccccaagauugccaccagaaguaaagugaauggacaaaacggcaggauggaguucuuuuggacgauccuaaagccuaaugacgcuaucaacuucgaaagcaauggcaacuuuauugccccagaauacgcguauaaaauagugaagaaaggggauucugcaaucaugaaguccgagcucgaauacggaaauugcaacacuaaaugucagaccccgaugggugccauuaauucaagcaugcccuuccauaacauccacccucugacaauaggcgagugcccaaaguaugucaagaguaaucggcuuguucuggcuacuggguugcgcaacucuccccagagagagaggcggcgcaaaaagcgaggacucuuuggcgccauugcagguuucaucgaagggggauggcagggcaugguggacggcugguacggguaucaucacuccaaugagcaaggaagcgguuacgcugccgacaaagaaucgacccagaaggcgaucgauggcguaacaaacaaagugaacucuauuaucgacaagaugaauacccaguuugaggccgucgggagagaguucaacaaucuggaaaggcggauugagaacuuaaauaagaaaauggaagauggauuccuggacguguggacguauaacgcagagcuccuuguucugauggaaaaugagcguacuuuggauuuucacgacuccaacgugaagaaucuauacgauaaaguccgccugcaacucagagacaacgcuaaggaacugggcaaugguuguuucgaguuuuaccauaaaugcgauaacgaguguauggaaucagugaggaaugggacauaugacuacccucaguauagugaggaagcccggcuuaagcgagaggagauaagcggcguaaagcuggaauccaucggaaccuaccagauuuugucuaucuauagcacuguugcuucaagucucgcccuggcaaucaugguggccggcuuaucccuguggaugugcagcaacgggucucuacagugccgcauuuguauauga

SEQ ID NO: 135709 - RNA, 1701 nt, Artificial Sequence
  derived and/or modified sequence opt3 from hemagglutinin__InfluenzaA__BAH95823
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaagcauguaaaaucaacaaagcugcgccuugccaccgggcugagaaacgugcccaguauucagagcaggggauuguuuggcgcgauagccggcuucaucgaagggggauggacugguauggucgacggcugguauggguaccaccaccagaaugaacaaggauccggcuaugcagcugaucucaaaucuacacagaacgccauugacgagaucaccaauaaggugaacagcguuauagagaaaaugaauacgcaguuuaccgcuguggguaaggaguucaaccaucuggaaaagcggauugaaaauuuaaacaaaaaggucgaugacggguuccuggauaucuggacauacaaugccgagcuccuugugcuguuggaaaacgagcgcacucuagacuaccacgauucaaauguaaagaaccuguaugagaagguucgaagucagcucaaaaacaaugcaaaggaaaucggcaacggauguuuugaguucuaccauaagugcgacaauaccuguauggaauccgugaaaaacggcacauaugauuacccuaaguauagcgaggaagccaaacugaauagagaggagauugacggggucaaacuugaaucuacuaggaucuaccaaauucuggcuauauauucaaccguggcgaguagcuugguccucgugguuucccugggagcaaucucuuuuuggaugugcucgaacgguagcuuacagugccggauuuguaucuga

SEQ ID NO: 135710 - RNA, 1701 nt, Artificial Sequence; identical to SEQ ID NO: 124672
  derived and/or modified sequence opt3 from hemagglutinin__InfluenzaA__BAH95824

SEQ ID NO: 135711 - RNA, 1707 nt, Artificial Sequence
  derived and/or modified sequence opt3 from hemagglutinin__InfluenzaA__BAJ07997
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggagaaaacccacaaugggaaguugugugauuuagacggagucaaaccccugauucuaagagauugcucaguggccgguuggcuccugggcaacccuaugugugacgaauuuaucaauguuccagaauggaguuauauaguggagaaggcgaacccggcuaaugaucuuugcuaccccggggacuucaacgauuaugaggaacugaagcauuugcucagcaggaucaaucacuuugagaaaauucagaucauuccuaagaacuccuggucuucgcaugaagccucacugggagucagcagugcauguccauaccagggcaaauccucuuucuuucggaaugugguauggcugaucaagaaaaacaaugccuaucccacaauaaagcgcagcuacaacaauacuaaccaagaggaccucuuaguucugugggguauucaccacccuaacgaugcugcagagcagacccgacuuuaucagaauccaacaaccuacaucuccguggggacuucaacauugaaccagcgucugguccccaagauugccaccagaaguaaagugaauggacaaagcggcaggauggaguucuuuuggacgauccuaaagccuaacgacgcuaucaauuucgaaucuaacggcaauuuuauugccccagaauacgcguauaaaauagugaagaaaggggauuccgcaaucaugaagucagagcucgaauacggaaacugcaauacuaaaugucagaccccgaugggugccauuaacagcaguaugcccuuccauaauauccacccucugacaauaggcgagugcccaaaguaugucaagucuaaccggcuuguucuggcuacuggguugcgcaauagcccccagagagagaggcggcgcaaaaagcgaggacucuuuggcgccauugcagguuucaucgaagggggauggcagggcaugguggacggcugguacggguaucaucacuccaacgagcaaggaucggguuacgcugccgacaaagaaucuacccagaaggcgaucgauggcguaacaaauaaagugaacuccauuaucgacaagaugaacacccaguuugaggccgucgggagagaguucaauaaccuggaaaggcggauugagaauuuaaacaagaaaauggaagauggauuccuggacguguggacguauaaugcagagcuccuuguucugauggaaaacgagcguacuuuggauuuucacgacucaaaugugaagaaccuauacgauaaaguccgccugcaacucagagacaaugcuaaggaacugggcaacgguuguuucgaguuuuaccauaaaugcgauaaugaguguauggaaagugugaggaacgggacauaugacuacccucaguauagcgaggaagcccggcuuaagcgagaggagauauccggcguaaagcuggaaucuaucggaaccuaccagauuuugagcaucuauucaacuguugcuaguucccucgcccuggcaaucaugguggccggcuuaagccuguggaugugcucuaaugggucacuacagugccgcauuuguauauga

SEQ ID NO: 135712 - RNA, 1701 nt, Artificial Sequence
  derived and/or modified sequence opt3 from hemagglutinin__InfluenzaA__BAJ39949
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacacuuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaaggucgaugacggguuccuggauaucuggaccuacaaugcuaaacuccuugugcuguugaagaacgagcgcacacuagacuaucaugauagcaauguaaagaaccuguacgaaaagguucgaucacagcucaagaacaaugccaaagagaucggcaacggauguuuugaguucuaucacaagugcgacaauacuuguauggaaagugugaaaaacggcaccuacgauuauccuaaguacuccgaggaagcaaaacugaauagagaggaaauugacggggucaaacuugagagcacaaggaucuaucaaauucuggccauauacucuaccguggcuucaaguuugguccucgugguuagccugggagcgaucuccuuuuggaugugcucuaacgguucguuacagugccggauuuguaucuga

SEQ ID NO: 135713 - RNA, 1701 nt, Artificial Sequence
  derived and/or modified sequence opt3 from hemagglutinin__InfluenzaA__BAJ39950
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauugccgagaccucuucgucagacaacggaacuugcuauccaggcgauuuuaucgacuacgaggagcucagggagcagcugagcaguguuuccucuuucgaacgguuugagauuuucccgaagacaagcuccuggcccaaucacgauucaaacaagggugugaccgcugcauguccucaugccggggcuaaaaguuuuuauaagaaucugaucuggcucgucaaaaagggaaacagcuacccaaaauuaucuaaguccuauauaaaugacaagggcaaagaagugcugguacuuuggggcauccaccaccccucaacgagcgccgaucaacagaguuuguaccagaacgcggacgcauacguuuucguggggacuucucgcuauuccaagaaauuuaagccugagauugccauccgaccaaaaguccgugaucaggagggaagaaugaauuacuauuggacccugguggaacccggugacaagauuacauucgaggcuacuggcaaccuaguggucccuagguacgccuuugcaauggaacggaacgcugggagcggaaucauaauuucggauaccccaguucaugacugcaauacaaccugucaaacgccgaaaggcgccaucaacacuucucuccccuuccagaauauucacccuaucacaaucgguaagugcccaaaguaugugaaauccaccaagcugcgccuugcgacugggcugagaaacguacccucaauucagaguaggggauuguuuggcgccauagcaggcuucaucgaagggggauggacagguaugguggacggcugguacggguaucaucaccagaaugaacaaggaagcggcuacgcugccgaucucaaauccacccagaacgcuauugacgagaucacgaauaaggucaacucugugauagagaaaaugaauacccaguuuacagccguugguaaggaguucaaccaccuggaaaagcggauugaaaauuuaaacaaaaagguggaugacggguuccuggauaucuggacuuacaaugcagagcuccuuguccuguuggaaaacgagcgcacccuagacuaucaugauagcaaugugaaaaaccuguacgagaagguacgaucacagcucaaaaacaaugccaaggaaaucggcaacggauguuuugaguucuaucacaagugcgacaauacauguauggaaaguguuaaaaacggcacuuacgauuauccuaaguacuccgaggaagcuaaacugaauagagaggagauugacggggugaaacuugaaagcaccaggaucuaucaaauucuggcgauauacucuacagucgcaucaaguuuggugcucgucgugagccugggagccaucuccuuuuggaugugcucuaacgguucguuacagugccggauuuguaucuga

SEQ ID NO: 135714 - RNA, 1701 nt, Artificial Sequence
  derived and/or modified sequence opt3 from hemagglutinin__InfluenzaA__BAJ39951
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacacuuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucauuucagaguaggggauuguucggcgccauugcgggcuuuauagaagggggauggaccgguauggucgacggcugguacggguaucaucaccagaaugaacaaggaagcggcuacgccgcagaucucaaauccacgcagaacgcuaucgacgagauuaccaauaaggugaacucuguuaucgagaaaaugaauacacaguucacugccguggguaaggaguucaaccaccuggaaaagcggauagaaaauuuaaacaaaaaggucgaugacggguuucuggauauuuggaccuacaaugcugagcuccuugugcuguuggaaaacgagcgcacacuagacuaucaugauagcaauguaaagaaccuguacgagaagguucgaucacagcucaaaaacaaugccaaggaaaucggcaacggauguuucgaguuuuaucacaagugcgacaauacuuguauggaaagugugaaaaacggcaccuacgauuauccuaaguacuccgaggaagcaaaacugaauagagaggagaucgacggggucaaacuugaaagcacaaggauuuaucaaauccuggccauuuacucuaccguggcuucaaguuugguccucgugguuagccugggagcgauauccuucuggaugugcucuaacgguucguuacagugccggaucuguauuuga

SEQ ID NO: 135715 - RNA, 1701 nt, Artificial Sequence; identical to SEQ ID NO: 131288
  derived and/or modified sequence opt3 from hemagglutinin__InfluenzaA__BAJ39952

SEQ ID NO: 135716 - RNA, 1701 nt, Artificial Sequence
  derived and/or modified sequence opt3 from hemagglutinin__InfluenzaA__BAJ39953
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacacuuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggagaagcggauugaaaauuuaaacaaaaaggucgaugacggguuccuggauaucuggaccuacaaugcuaaacuccuugugcuguuggagaacgaacgcacacuagacuaucaugauagcaauguaaagaaccuguacgagaaaguucgaucacagcucaagaacaaugccaaggagaucggcaacggauguuuugaguucuaucacaaaugcgacaauacuuguauggagagugugaagaacggcaccuacgauuauccuaaauacuccgaagaggcaaagcugaauagagaagagauugacggggucaaacuugagagcacaaggaucuaucaaauucuggccauauacucuaccguggcuucaaguuugguccucgugguuagccugggagcgaucuccuuuuggaugugcucuaacgguucguuacagugccggauuuguaucuga

SEQ ID NO: 135717 - RNA, 1701 nt, Artificial Sequence; identical to SEQ ID NO: 131288
  derived and/or modified sequence opt3 from hemagglutinin__InfluenzaA__BAJ39954

SEQ ID NO: 135718 - RNA, 1701 nt, Artificial Sequence
  derived and/or modified sequence opt3 from hemagglutinin__InfluenzaA__BAJ39955
augaaggccauccuggugguccuccuuuacaccuucgcuacagcaaacgccgacacucugagcauuggcuaucacgcgaauaacuccacggauaccguugacacaguguuggagaaaaauguaacugugacccauucugucaacuuacuggaagauaagcacaaugggaaacuaugcaagcucagaggaguggcuccccugcaucuugguaaauguaacauagccggcuggauccuggggaauccugagugcgaaucauugaguacagcaagcuccuggucuuacauuguugagaccucgucaagcgacaacggaacuuguuauccaggcgauuuuaucgacuacgaggagcucagggagcagcugaguuccgugucuagcuucgaacgguuugagauuuucccgaagacauccucauggcccaaucacgauaguaacaagggugucaccgccgcuugcccucaugcaggggccaagagcuuuuauaagaaucugaucuggcucgugaaaaagggaaacucuuacccaaaauuauccaagucauauauaaaugacaagggcaaagaaguacugguucuuuggggcauccaccaccccagcauuagugcugaucaacagucuuuguaccagaacgccgacacguacguguucgucgggacuucccgcuauagcaagaaauuuaagccugagaucgcgauucgaccaaaagugcgugaucaggagggaagaaugaauuacuauuggacccugguggaacccggugacaagaucacauucgaggcaacuggcaaccuagucguuccuagguacgccuuugcuauggaacggaacgccgggucgggaauaauuaucucugauaccccagugcaugacuguaauacaaccugccaaacgccgaaaggcgcaauuaacacuucccuccccuuccagaauauccacccuaucacaauugguaaguguccaaaguauguaaaaucaaccaagcugcgccuugcuacugggcugagaaacgugcccaguauacagagcaggggauuguuuggcgccaucgcgggcuucauugaagggggauggacagguauggucgacggcugguacggguaucaucaccagaaugaacaaggauccggcuacgccgcagaucucaaaucuacccagaacgcuaucgacgagauaacgaauaaggugaacagcguuauugagaaaaugaauacccaguuuacagccguggguaaggaguucaaccaccuggaaaagcggaucgaaaauuuaaacaaaaaggucgaugacggguuccuggauaucuggacuuacaaugcugagcuccuugugcuguuggaaaacgagcgcacccuagacuaucaugauucaaauguuaaaaaccuguacgagaagguacgaagucagcucaaaaacaaugccaaggaaauuggcaacggaugcuuugaguucuaucacaagugugacaauacaugcauggaauccgugaaaaacggcacuuacgauuauccuaaguacagcgaggaagcaaaacugaauagagaggagaucgacggggucaaacuugaaucuaccaggauuuaucaaauacuggccaucuacucaacaguggcuaguagcuugguccucgugguuucccugggagcgauuucuuuuuggauguguucgaacgguagcuuacagugcaaaaucugcaucuga

SEQ ID NO: 135719 - RNA, 1701 nt, Artificial Sequence; identical to SEQ ID NO: 135713
  derived and/or modified sequence opt3 from hemagglutinin__InfluenzaA__BAJ39956

SEQ ID NO: 135720 - RNA, 1701 nt, Artificial Sequence; identical to SEQ ID NO: 131288
  derived and/or modified sequence opt3 from hemagglutinin__InfluenzaA__BAJ39957

SEQ ID NO: 135721 - RNA, 1701 nt, Artificial Sequence
  derived and/or modified sequence opt3 from hemagglutinin__InfluenzaA__BAJ39958
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguuaaaucacagcucaagaacaaugcaaaggaaaucggcaacggauguuuugaguucuaucacaaaugcgacaauacauguauggaaagugugaagaacggcacuuacgauuauccuaaauacuccaaggaggccaaacugaaucgagaaaagauugacggggucaaacuugagagcaccagaaucuaucaaauucuggcuauauacucuacaguggcgucaaguuugguccucgugguuagccugggagcaaucuccuuuuggaugugcucuaacgguucguuacagugcaggauuuguaucuga

SEQ ID NO: 135722 - RNA, 1701 nt, Artificial Sequence
  derived and/or modified sequence opt3 from hemagglutinin__InfluenzaA__BAJ39959
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccuuuauucagucaaggggauuguucggcgcgauagccggcuuuaucgaagggggauggacagguauggucgacggcugguacggguaucaucaccagaaugaacaaggaaguggcuacgcagcugaucucaaaagcacccagaacgccauugacgagaucacgaauaaggugaacuccguuauagagaaaaugaauacccaguucacagcuguggguaaggaguucaaccaccuggaaaagcggauugaaaauuuaaacaaaaaggucgaugacggguuucuggauaucuggacuuacaaugccgagcuccuugugcuguuggaaaacgagcgcacccuagacuaucaugauucuaauguaaagaaccuguacgagaagguuaaaagccagcucaagaacaaugcaaaggaaaucggcaacggauguuucgaguuuuaucacaaaugcgacaauacauguauggaaucagugaagaacggcacuuacgauuauccuaaauacaguaaggaggccaaacugaaucgagaagagauugacggggucaaacuugaguccaccagaaucuaucaaauucuggcuauauacagcacaguggcgucuucauugguccucgugguuagucugggagcaaucagcuucuggaugugcuccaacgguucuuuacagugcaggauuuguaucuga

SEQ ID NO: 135723 - RNA, 1701 nt, Artificial Sequence; identical to SEQ ID NO: 124685
  derived and/or modified sequence opt3 from hemagglutinin__InfluenzaA__BAJ39960

SEQ ID NO: 135724 - RNA, 1701 nt, Artificial Sequence; identical to SEQ ID NO: 125314
  derived and/or modified sequence opt3 from hemagglutinin__InfluenzaA__BAJ39961

SEQ ID NO: 135725 - RNA, 1701 nt, Artificial Sequence
  derived and/or modified sequence opt3 from hemagglutinin__InfluenzaA__BAJ39962
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauugccgagaccucuucgucagacaacggaacuugcuauccaggcgauuuuaucgacuacgaggagcucagggagcagcugagcaguguuuccucuuucgaacgguuugagauuuucccgaagacaagcuccuggcccaaucacgauucaaacaagggugugaccgcugcauguccucaugccggggcuaaaaguuuuuauaagaaucugacguggcucgucaaaaagggaaacagcuacccaaaauuaucuaaguccuauaucaaugacaagggcaaagaagugcugguacuuuggggcauacaccaccccucaacuagcgccgaucaacagaguuuguaccagaacgcggacgcauacguuuucguggggaccucucgcuauuccaagaaauuuaagccugagaucgccauucgaccaaaaguccgugaucaggagggaagaaugaauuacuauuggacacugguggaacccggugacaagaucacuuucgaggcuaccggcaaccuaguggucccuagguacgccuuugcaauggaacggaacgcugggagcggaauuaucauaucggauacaccaguucaugacugcaauaccacgugucaaacuccgaaaggcgccauuaacacaucucuccccuuccagaauauccacccuauuaccaucgguaagugcccaaaguaugugaaauccacuaagcugcgccuugcgacagggcugagaaacguacccuuuauccagucaaggggauuguucggcgccauugcaggcuuuauagaagggggauggaccgguaugguggacggcugguacggguaucaucaccagaaugaacaaggaaguggcuacgcugccgaucucaaaagcacgcagaacgcuaucgacgagauuaccaauaaggucaacuccgugaucgagaaaaugaauacacaguucacugccguugguaaggaguucaaccaccuggaaaagcggauagaaaauuuaaacaaaaagguggaugacggguuucuggauauuuggaccuacaaugcagagcuccuuguccuguuggaaaacgagcgcacacuagacuaucaugauucuaaugugaaaaaccuguacgagaagguaaaaagccagcucaagaacaaugccaaggaaaucggcaacggauguuucgaguuuuaucacaaaugcgacaauacuuguauggaaucaguuaagaacggcaccuacgauuauccuaaauacaguaaggaggcuaaacugaaucgagaagagaucgacggggugaaacuugaguccacaagaauuuaucaaauccuggcgauuuacagcaccgucgcaucuucauuggugcucgucgugagucugggagccaucagcuucuggaugugcuccaacgguucuuuacagugcaggauauguauuuga

SEQ ID NO: 135726 - RNA, 1701 nt, Artificial Sequence; identical to SEQ ID NO: 124685
  derived and/or modified sequence opt3 from hemagglutinin__InfluenzaA__BAJ39963

SEQ ID NO: 135727 - RNA, 1701 nt, Artificial Sequence; identical to SEQ ID NO: 131288
  derived and/or modified sequence opt3 from hemagglutinin__InfluenzaA__BAJ39964

SEQ ID NO: 135728 - RNA, 1701 nt, Artificial Sequence; identical to SEQ ID NO: 124685
  derived and/or modified sequence opt3 from hemagglutinin__InfluenzaA__BAJ39965

SEQ ID NO: 135729 - RNA, 1701 nt, Artificial Sequence; identical to SEQ ID NO: 124685
  derived and/or modified sequence opt3 from hemagglutinin__InfluenzaA__BAJ39966

SEQ ID NO: 135730 - RNA, 1701 nt, Artificial Sequence
  derived and/or modified sequence opt3 from hemagglutinin__InfluenzaA__BAJ39967
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaauugcucucuacagcaucaaguuggagcuacauuguugagaccuccucuucggacaacggaacuugcuauccaggcgauuuuaucgacuacgaggagcugagggagcagcugucaagcgugaguuccuucgaacgguuugagauuuucccgaagacaucuagcuggcccaaucacgauuccgacaagggugucaccgccgcuuguccucaugcaggggccaaaucauuuuauaagaaccucaucugguuagugaaaaagggaaauaguuacccaaaacugagcaagucuuauauaaacgauaagggcaaagaaguacuuguuuuguggggcauccaccaccccuccacgucagcugaccaacagagccuguaccagaaugccgaugcguacguguucgucgggacuucccgcuauucuaagaaauuuaagccugagauugcaauccgaccaaaagugcgugaccaggagggaagaaugaacuacuauuggacccuaguggaacccggugauaagauuacauucgaggccacuggcaaucucgucguuccuagguacgcuuuugccauggaacggaacgcaggguccggaaucauaauuagcgacaccccagugcaugacugcaacacaaccugucaaacgccgaaaggcgcuaucaauacuucgcugcccuuccagaacauucacccuaucacaaucgguaagugcccaaaguauguaaaaucuaccaagcugcgccuugccacuggguugagaaaugugcccuccauucagucaaggggacucuuuggcgcgauagccggcuucaucgaagggggauggacagguauggucgauggcugguacggguaucaucaccagaacgaacaaggaaguggcuacgcagcugaccugaaaagcacccagaaugccauugaugagaucacgaacaaggugaauaguguuauagagaaaaugaacacccaguuuacagcuuuagguaaggaguucaaucaccuggaaaagaaaauugaaaaccucaauaagaaaguggacgauggguuccuugacaucuggacuuacaacgccgagcuguugguccuacuggaaaaugagcggacccucgauuaucaugacucuaacgugaagaaucuguacgagaaaguacgcagccagcuuaagaacaacgcaaaggaaaucggcaauggauguuuugaguucuaucacaaaugcgauaacacauguauggaaucaguuaagaauggcacuuacgacuauccuaaauacagugaggaagccaagcugaaccgagaggagauugauggggugaaauuggaauccaccagaaucuaucaaauucucgcuauauacagcacagucgcgucuucacugguguuagucgugagucugggagcaaucagcuuuuggaugugcuccaaugguucucuacagugcaggauuuguaucuga

SEQ ID NO: 135731 - RNA, 1701 nt, Artificial Sequence; identical to SEQ ID NO: 130213
  derived and/or modified sequence opt3 from hemagglutinin__InfluenzaA__BAJ39968

SEQ ID NO: 135732 - RNA, 1701 nt, Artificial Sequence; identical to SEQ ID NO: 131288
  derived and/or modified sequence opt3 from hemagglutinin__InfluenzaA__BAJ39969

SEQ ID NO: 135733 - RNA, 1701 nt, Artificial Sequence; identical to SEQ ID NO: 124685
  derived and/or modified sequence opt3 from hemagglutinin__InfluenzaA__BAJ39970

SEQ ID NO: 135734 - RNA, 1701 nt, Artificial Sequence; identical to SEQ ID NO: 124685
  derived and/or modified sequence opt3 from hemagglutinin__InfluenzaA__BAJ39971

SEQ ID NO: 135735 - RNA, 1701 nt, Artificial Sequence; identical to SEQ ID NO: 125314
  derived and/or modified sequence opt3 from hemagglutinin__InfluenzaA__BAJ39972

SEQ ID NO: 135736 - RNA, 1701 nt, Artificial Sequence
  derived and/or modified sequence opt3 from hemagglutinin__InfluenzaA__BAJ39973
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacacuuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaaggucgaugacggguuccuggauaucuggaccuacaaugcugagcuccuugugcuguuggaaaacgagcgcacacuagacuaucaugauagcaauguuaaaaaccuguacgagaagguaaaaucacagcucaagaacaaugccaaggaaaucggcaacggauguuuugaguucuaucacaaaugcgacaauacuuguauggaaagugugaagaacggcaccuacgauuauccuaaauacuccgaggaagcaaagcugaaucgagaggagauugacggggucaaacuugaaagcacaagaaucuaucaaauucuggccauauacucuaccguggcuucaaguuugguccucgugguuagccugggagcgaucuccuuuuggaugugcucuaacgguucguuacagugcaggauuuguaucuga

SEQ ID NO: 135737 - RNA, 1701 nt, Artificial Sequence; identical to SEQ ID NO: 124685
  derived and/or modified sequence opt3 from hemagglutinin__InfluenzaA__BAJ39974

SEQ ID NO: 135738 - RNA, 1701 nt, Artificial Sequence; identical to SEQ ID NO: 125254
  derived and/or modified sequence opt3 from hemagglutinin__InfluenzaA__BAJ39975

SEQ ID NO: 135739 - RNA, 1701 nt, Artificial Sequence
  derived and/or modified sequence opt3 from hemagglutinin__InfluenzaA__BAJ39976
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugagaaacuauguaagcucagagggguggcuccccugcaucuuggaaaaugcaacauagccgguuggauccugggcaauccugaaugugagucuuugucaacagcaaguagcugguccuacauuguugaaaccucuucgucagacaacgggacuugcuauccaggagauuuuaucgacuacgaggagcucagggaacagcugagcaguguguccucuuucgagcgguuugaaauuuucccgaagacaagcuccuggcccaaucacgauucaaacaagggcgucaccgccgcuuguccucaugccggugcaaaaaguuuuuauaagaaucugaucuggcucgugaaaaaggggaacagcuacccaaaauuaucuaaguccuauauaaaugacaagggaaaagagguacugguucuuuggggcauccaccaccccucaacgagcgcugaucaacagaguuuguaccagaacgccgacgcguacguguucgucggcacuucucgcuauuccaagaaauuuaagccugagauugcaauccgaccaaaagugcgugaucaggaagggagaaugaauuacuauuggacccugguggagcccggagacaagauuacauucgaagccacugguaaccuagucguuccuagguacgcuuuugccauggagcggaacgcaggcagcgggaucauaauuucggauaccccagugcaugacugcaauacaaccugucaaacgccgaaaggagcuaucaacacuucucuccccuuccagaauauucacccuaucacaaucggcaagugcccaaaguauguaaaauccaccaagcugcgccuugccacuggucugagaaacgugcccucaauucagaguaggggguuguuuggagcgauagccggcuucaucgaaggcggguggacaggaauggucgacgguugguacggcuaucaucaccagaaugagcaagggagcggauacgcagcugaucucaaauccacccagaacgccauugacaagaucacgaauaaagugaacucuguuauagagaagaugaauacccaguuuacagcugugggcaaggaguucaaccaccuggaaaaacggauugaaaauuuaaacaagaaagucgaugacgguuuccuggauaucuggacuuacaaugccgagcuccuugugcuguuggaaaacgagcgcacccuagacuaucaugauagcaauguaaagaaccuguacgagaaaguucgaucacagcucaagaacaaugcaaaggaaaucgggaacggcuguuuugaguucuaucacaaaugcgacaauacauguauggaaagugugaagaacggaacuuacgauuauccuaaauacuccgaggaagccaagcugaauagagaggagauugacggcgucaaacuugaaagcaccaggaucuaucaaauucuggcuauauacucuacaguggcgucaaguuugguccucgugguuagccugggggcaaucaacuuuuggaugugcuccaauggaucuuuacagugccggauuuguaucuga

SEQ ID NO: 135740 - RNA, 1701 nt, Artificial Sequence; identical to SEQ ID NO: 124685
  derived and/or modified sequence opt3 from hemagglutinin__InfluenzaA__BAJ39977

SEQ ID NO: 135741 - RNA, 1701 nt, Artificial Sequence
  derived and/or modified sequence opt3 from hemagglutinin__InfluenzaA__BAJ39978
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacuccaucacaaucgguaagugcccuaaguauguaaaaucaaccaagcugcgccuugccacugggcugagaaacgugccaaguauucagagcaggggauuguuuggcgcgauagccggcuucaucgaagggggauggacagguauggucgacggcugguacggguaucaucaccagaaugagcaaggauccggcuacgcagcugaccucaaaucuacccagaacgccauugaugagaucacgaauaaggugaacagcguuauagaaaagaugaauacccaguuuacagcuguggguaaggaguucaaccaccuggaaaagcggauugagaauuuaaacaaaaaggucgacgauggguuccuggacaucuggacuuacaaugccgaacuccuugugcuguuggagaacgagcgcacccuagauuaucaugacucaaauguuaaaaaccuguacgaaaagguaaaaagucagcucaagaacaaugcaaaggagaucggcaacggauguuuugaguucuaucacaaaugcgauaauacauguauggaguccgugaagaacggcacuuacgacuaucccaaauacagcgaagaggccaagcugaaucgagagaaaauugauggggucaaacuugaaucuaccagaaucuaucaaauucuggcuauauacucaacaguggcgaguagcuugguccucgugguuucccugggagcaaucucuuuuuggaugugcucgaacgguagcuuacagugcaggauuuguaucuga

SEQ ID NO: 135742 - RNA, 1701 nt, Artificial Sequence
  derived and/or modified sequence opt3 from hemagglutinin__InfluenzaA__BAJ39979
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaauugcucucuacagcaucaaguuggagcuacauuguugagaccuccucuucggacaacggaacuugcuauccaggcgauuuuaucgacuacgaggagcugagggagcagcugucaagcgugaguuccuucgaacgguuugagauuuucccgaagacaucuagcuggcccaaucacgauuccgacaagggugucaccgccgcuuguccucaugcaggggccaaaucauuuuauaagaaccucaucugguuagugaaaaagggaaauaguuacccaaaacugagcaagucuuauauaaacgauaagggcaaagaaguacuuguuuuguggggcauccaccaccccuccacgucagcugaccaacagagccuguaccagaaugccgaugcguacguguucgucgggacuucccgcuauucuaagaaauuuaagccugagauugcaauccgaccaaaagugcgugaccaggagggaagaauggauuacuauuggacccuaguggaacccggugacaagauuacauucgaggccacuggcaaccucgucguuccuagguacgcuuuugccauggaacggaaugcaggguccggaaucauaauuagcgacaccccagugcauaacugcaacacaaccugucaaacgccgaaaggcgcuaucaauacuucgcugcccuuccagaacauucacccuaucacaaucgguaagugcccaaaguauguaaaaucuaccaaacuucgccuggccacuggguugagaaaugugcccuccauucagucaaggggacucuuuggcgcgauagccggcuucaucgaagggggauggacagguauggucgauggcugguacggguaucaucaccagaacgaacaaggaaguggcuacgcagcugaccugaaaagcacccagaaugccauugauaagaucacgaacaaagugaauaguguuauagagaagaugaacacccaguuuacagcuguggguaaggaguucaaucacuuagaaaaccggauugagaaucugaacaaaaaggucgacgauggguuccucgacaucuggacuuacaaugccgaacuucugguguugcuagagaacgaacgcacccuggauuaucaugacucuaauguaaagaaccucuacgagaagguucgaagccagcugaaaaacaaugcaaaggagaucggcaacggauguuuugaguucuaucacaagugcgauaauacauguauggaaucagugaaaaacggcacuuacgacuauccuaaguacagugaagaggccaaacuuaauagagaagagauugauggggucaagcuggaguccaccaggaucuaucaaauuuuggcuauauacagcacaguggcgucuucacucguccuggugguuaguuuaggagcaaucagcuuuuggaugugcuccaacgguucucugcagugccggauuuguaucuga

SEQ ID NO: 135743 - RNA, 1701 nt, Artificial Sequence; identical to SEQ ID NO: 131288
  derived and/or modified sequence opt3 from hemagglutinin__InfluenzaA__BAJ39980

SEQ ID NO: 135744 - RNA, 1701 nt, Artificial Sequence
  derived and/or modified sequence opt3 from hemagglutinin__InfluenzaA__BAJ39981
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcuccaaguauguaaaaucaaccaagcugcgccuugccacugggcugagaaacgugccaaguauucagagcaggggauuguuuggcgcgauagccggcuucaucgaagggggauggacagguauggucgacggcugguacggguaucaucaccagaaugaacaaggauccggcuacgcagcugaucucaaaucuacccagaacgccauugacgagaucacgaauaaggugaacagcguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauucaaauguaaagaaccuguacgagaagguuaaaagucagcucaagaacaaugcaaaggaaaucggcaacggauguuuugaguucuaucacaaaugcgacaauacauguauggaauccgugaagaacggcacuuacgauuaucccaaauacagcaaggaggccaaacugaaucgagaaaagauugacggggucaaacuugagucuaccagaaucuaucaaauucuggcuauauacucaacaguggcgaguagcuugguccucgugguuucccugggagcaaucucuuuuuggaugugcucgaacgguagcuuacagugcaggauuuguaucuga

SEQ ID NO: 135745 - RNA, 1701 nt, Artificial Sequence
  derived and/or modified sequence opt3 from hemagglutinin__InfluenzaA__BAJ39982
augaaggccauccuggugguccuccuuuacaccuucgcuacagcaaacgccgcgacucugugcauuggcuaucacgcuaauaacagcacggacaccguugauacauuguuagagaaaaaugugacuguaacccauuccgugaaccugcuagaagacaagcacaaugggaaacucuguaagcugagaggagucgcaccccuucaucuggguaaaugcaacauagccggcuggaucuuggggaauccugagugugaaucucucucaacagccaguagcugguccuacauuguggagaccucuucgucagauaacggaacuugcuauccaggcgacuuuaucgauuacgaggagcugagggagcagcugagcaguguuuccucuuucgaacgguuugagauuuucccgaagacaagcuccuggcccaaucacgacucaaacaagggugugaccgcugcauguccucaugccggggcuaaaaguuuuuauaagaaucucaucugguuagucaaaaagggaaacagcuacccaaaacugucuaaguccuauauaaaugauaagggcaaagaagugcuuguauuguggggcauccaccaccccucaacgagcgccgaccaacagagucuguaccagaacgcggaugcauacguuuucguggggacuucucgcuauuccaagaaauuuaagccugagauugccauccgaccaaaaguccgugaccaggagggaagaaugaauuacuauuggacccuaguggaacccggugauaagauuacauucgaggcuacuggcaaccucguggucccuagguacgccuuugcaauggaacggaacgcugggagcggaaucauaauuucggacaccccaguucaugauugcaauacaaccugucaaacgccgaaaggcgccaucaacacuucucugcccuuccagaauauucacccuaucacaaucgguaagugcccaaaguaugugaaauccaccaaacuucgccuggcgacuggguugagaaacguacccucaauucagaguaggggacucuuuggcgccauagcaggcuucaucgaagggggauggacagguaugguggacggcugguacggguaucaucaccagaaugaacaaggaagcggcuacgcugccgaccugaaguccacccagaacgcuauugaugagaucacgaauaaggucaacucugugauagagaaaaugaauacccaguuuacagccguugguaaggaguucaaccacuuagaaaagcggauugaaaaucugaacaaaaagguggacgauggguuccucgacaucuggacuuacaaugcagagcuucuggucuugcuagaaaacgagcgcacccuggauuaucaugacagcaaugugaaaaaccucuacgagaagguacgaucacagcugaaaaacaaugccaaggaaaucggcaacggauguuuugaguucuaucacaagugcgauaauacauguauggaaaguguuaaaaacggcacuuacgacuauccuaaguacuccgaggaagcuaaacuuaauagagaggagauugauggggugaagcuggaaagcaccaggaucuaucaaauuuuggcgauauacucuacagucgcaucaagucucgugcuggucgugagcuuaggagccaucuccuuuuggaugugcucuaacgguucgcugcagugccggauuuguaucuga

SEQ ID NO: 135746 - RNA, 1701 nt, Artificial Sequence; identical to SEQ ID NO: 135713
  derived and/or modified sequence opt3 from hemagglutinin__InfluenzaA__BAJ39983

SEQ ID NO: 135747 - RNA, 1701 nt, Artificial Sequence
  derived and/or modified sequence opt3 from hemagglutinin__InfluenzaA__BAJ39984
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaauugcucucuacagcaucaaguuggagcuacauuguugagaccuccucuucggacaacggaacuugcuauccaggcgauuuuaucgacuacgaggagcugagggagcagcugucaagcgugaguuccuucgaacgguuugagauuuucccgaagacaucuagcuggcccaaucacgauuccaacaagggugucaccgccgcuuguccucaugcaggggccaaaucauuuuauaagaaucucaucugguuagugaaaaagggaaacaguuacccaaaacugagcaagucuuauauaaaugacaagggcaaagaaguacuuguuuuguggggcauccaccaccccuccacgucagcugaucaacagagccuguaccagaacgccgacgcguacguguucgucgggacuucccgcuauucuaagaaauuuaagccugagauugcaauccgaccaaaagugcgugaucaggagggaagaaugaauuacuauuggacccuaguggaacccggugacaagauuacauucgaggccacuggcaaccucgucguuccuagguacgcuuuugccauggaacggaacgcaggguccggaaucauaauuagcgauaccccagugcauaauugcaacacaaccugucaaacgccgaaaggcgcuaucaauacuucgcugcccuuccagaacauucacccuaucacaaucgguaagugcccaaaguauguaaaaucuaccaagcugcgccuugccacuggguugagaaaugugcccuccauucagucaaggggacucuuuggcgcgauagccggcuucaucgaagggggauggacagguauggucgacggcugguacggguaucaucaccagaacgaacaaggaaguggcuacgcagcugaccugaaaagcacccagaaugccauugauaagaucacgaacaaagugaauaguguuauagagaagaugaacacccaguuuacagcuguggguaaggaguucaaucacuuagaaaaacggauugagaaccugaauaagaaagucgacgauggguuccucgacaucuggacuuacaacgccgaacuucugguguugcuagagaaugaacgcacccuggauuaucaugacucuaacguaaagaaccucuacgagaaaguucgaagccagcugaagaauaacgcaaaggagaucggcaauggauguuuugaguucuaucacaaaugcgauaacacauguauggaaucagugaagaauggcacuuacgacuauccuaaauacagugaagaggccaaacuuaacagagaagagauugauggggucaagcuggaguccaccaggaucuaucaaauuuuggcuauauacagcacaguggcgucuucacucguccuggugguuaguuuaggagcaaucagcuuuuggaugugcuccaaugguucucugcagugccggauuuguaucuga

SEQ ID NO: 135748 - RNA, 1701 nt, Artificial Sequence; identical to SEQ ID NO: 124685
  derived and/or modified sequence opt3 from hemagglutinin__InfluenzaA__BAJ39985

SEQ ID NO: 135749 - RNA, 1701 nt, Artificial Sequence
  derived and/or modified sequence opt3 from hemagglutinin__InfluenzaA__BAJ39987
augaagaccauccuggugguccuccuuuacacauucgccacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacaccuacguguucgucgggacaucucgcuauuccaagaaauuuaagccugagauugccauccgaccaaaagugcgugaucaggagggaagaaugaauuacuauuggacucugguggaacccggugacaagauuaccuucgaggcgacaggcaaccuagucguuccuagguacgcauuugccauggaacggaacgcugggagcggaaucauaauuucggauaccccagugcaugacugcaauacgacuugucaaacaccgaaaggcgccaucaacaccucucuccccuuccagaauauucacccuaucacuaucgguaagugcccaaaguauguaaaauccacaaagcugcgccuugcaaccgggcugagaaacgugcccucaauucagaguaggggauuguuuggcgcuauagccggcuucaucgaagggggauggacggguauggucgacggcugguacggguaucaucaccagaaugaacaaggaagcggcuacgcggccgaucucaaauccacccagaacgcaauugacgagaucacaaauaaggugaacucuguuauagagaaaaugaauacucaguuuaccgcuguggguaaggaguucaaccaccuggaaaagcggauugaaaauuuaaacaaaaaggucgaugacggguuccuggauaucuggacauacaaugccgagcuccuugugcuguuggaaaacgagcgcacucuagacuaucaugauagcaauguuaaaaaccuguacgagaagguacgaucacagcucaaaaacaaugcuaaggaaaucggcaacggauguuuugaguucuaucacaagugcgacaauaccuguauggaaagugugaaaaacggcacauacgauuauccuaaguacuccaaagaggccaagcugaauagagaagagauugacggggucaaacuugagagcaccaggaucuaucaaauucuggcaauauacucuacuguggccucaaguuugguccucgugguuagccugggagcuaucuccuuuuggaugugcucuaacgguucguuacagugccggauuuguaucuga

SEQ ID NO: 135750 - RNA, 1701 nt, Artificial Sequence
  derived and/or modified sequence opt3 from hemagglutinin__InfluenzaA__BAJ39988
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguauuuaccagaacgccgacgcguacguguucgucgggacuucucgcuauuccaagaaauuuaagccugagaucgcaauucgaccaaaagugcgugaucaggagggaagaaugaauuacuauuggaccuugguggaacccggugacaagaucacauucgaggccacuggcaaccuggucguuccuagguacgcuuuugccauggaacggaacgcagggagcggaauaauuaucucggauaccccagugcaugacugcaauacaaccugucaaacgccgaaaggcgcuauuaacacuucucuacccuuccagaauauccacccuaucacaauugguaagugcuccaaguauguaaaaucaaccaagcuccgccuggccacugggcuuagaaacgugccaaguauacagagcaggggacuguuuggcgcgaucgccggcuucauugaagggggauggacagguauggucgacggcugguacggguaucaucaccagaaugaacaaggauccggcuacgcagcugauuugaaaucuacccagaacgccaucgacgagauaacgaauaaggugaacagcguuauugagaaaaugaauacccaguuuacagcuguggguaaggaguucaaccaccucgaaaagcggaucgaaaaucugaacaaaaaggucgaugacggguucuuagauaucuggacuuacaaugccgagcugcucgugcuucuggaaaacgagcgcaccuuggacuaucaugauucaaauguuaaaaaccuauacgagaagguacgaagucagcugaaaaacaaugcaaaggaaauuggcaacggauguuuugaguucuaucacaagugcgacaauacauguauggaauccgugaaaaacggcacuuacgauuaucccaaguacagcgaggaagccaaacucaauagagaggagaucgacggggucaagcuggaaucuaccaggauuuaucaaauacuugcuaucuacucaacaguggcgaguagccuggucuuggugguuucccucggagcaauuucuuuuuggaugugcucgaacgguagccugcagugccggaucuguaucuga

SEQ ID NO: 135751 - RNA, 1701 nt, Artificial Sequence; identical to SEQ ID NO: 125999
  derived and/or modified sequence opt3 from hemagglutinin__InfluenzaA__BAJ39989

SEQ ID NO: 135752 - RNA, 1701 nt, Artificial Sequence; identical to SEQ ID NO: 124685
  derived and/or modified sequence opt3 from hemagglutinin__InfluenzaA__BAJ39990

SEQ ID NO: 135753 - RNA, 1701 nt, Artificial Sequence; identical to SEQ ID NO: 124685
  derived and/or modified sequence opt3 from hemagglutinin__InfluenzaA__BAJ39993

SEQ ID NO: 135754 - RNA, 1701 nt, Artificial Sequence
  derived and/or modified sequence opt3 from hemagglutinin__InfluenzaA__BAJ39994
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacacuuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaccacuaucgguaagugcccaaaguauguaaaauccacaaagcugcgccuugcuaccgggcugagaaacgugcccucaauccagaguaggggauuguuuggcgccauugcgggcuucauagaagggggauggacggguauggucgacggcugguacggguaucaucaccagaaugaacaaggaagcggcuacgccgcagaucucaaauccacccagaacgcuaucgacgagauuacaaauaaggugaacucuguuaucgagaaaaugaauacucaguuuaccgccguggguaaggaguucaaccaccuggaaaagcggauagaaaauuuaaacaaaaaggucgaugacggguuccuggauauuuggacauacaaugcugagcuccuugugcuguuggaaaacgagcgcacucuagacuaucaugauagcaauguaaagaaccuguacgagaagguuaaaucacagcucaagaacaaugccaaggaaaucggcaacggauguuuugaguucuaucacaaaugcgacaauaccugucuggaaagugugaagaacggcacauacgauuauccuaaauacuccgaggaagcaaaacuuaaucgagagaaaaucgacggggucaagcuggagagcaccagaauuuaucaaaucuuggccauuuacucuacuguggcuucaagucucguccuggugguuagcuuaggagcgauauccuuuuggaugugcucuaacgguucgcugcagugcaggaucuguauuuga

SEQ ID NO: 135755 - RNA, 1701 nt, Artificial Sequence; identical to SEQ ID NO: 124685
  derived and/or modified sequence opt3 from hemagglutinin__InfluenzaA__BAJ39996

SEQ ID NO: 135756 - RNA, 1701 nt, Artificial Sequence
  derived and/or modified sequence opt3 from hemagglutinin__InfluenzaA__BAJ39997
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacacuuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaccacuaucgguaagugcccaaaguauguaaaauccacaaagcugcgccuugcuaccgggcugagaaacgugcccucaauccagaguaggggauuguuuggcgccauugcgggcuucauagaagggggauggacggguauggucgacggcugguacggguaucaucaccagaaugaacaaggaagcggcuacgccgcagaucucaaauccacccagaacgcuaucgacgagauuacaaauaaggugaacucuguuaucgagaaaaugaauacucaguuuaccgccguggguaaggaguucaaccaccuggaaaagcggauagaaaauuuaaacaaaaaggucgaugacggguuccuggauauuuggacauacaaugcugagcuccuugugcuguuggaaaacgagcgcacucuagacuaucaugauagcaauguaaagaaccuguacgagaagguucgaucacagcucaaaaacaaugccaaggaaaucggcaacggauguuuugaguucuaucacaagugcgacaauaccuguauggaaagugugaaaaacggcacauacgauuauccuaaguacuccgaggaagcaaaacugaauagagaggagaucgacggggucaaacuugaaagcaccaggauuuaucaaauccuggccauuuacucuacuguggcuucaaguuugguccucgugguuagccugggagcgauauccuuuuggaugugcucuaacgguucguuacagugccggaucuguauuuga

SEQ ID NO: 135757 - RNA, 1701 nt, Artificial Sequence; identical to SEQ ID NO: 124685
  derived and/or modified sequence opt3 from hemagglutinin__InfluenzaA__BAJ39998

SEQ ID NO: 135758 - RNA, 1701 nt, Artificial Sequence
  derived and/or modified sequence opt3 from hemagglutinin__InfluenzaA__BAJ39999
augaaggccauccuggugguccuccuuuacaccuucgcuacagcaaacgccgacacucugugcauuggcuaucacgcgaauaacagcacggauaccguugacacaguguuggagagaaauguaacugugacccauuccgucaacuuacuggaagauaaacacaaugggaagcuauguaaacucaggggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaggagcuccgggagcagcugagcaguguguccucuuucgaacgcuuugagauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggaaguacugguucuuuggggcauccaccaccccucaacgagcgcugaucaacagaguuuguaccagaacgccgacacuuacguguucgucgggaccucucgauauuccaaaaaguuuaaaccugagauugcgauccguccaaaggugagagaucaggagggaaggaugaauuacuauuggacacugguggaacccggugacaaaauuacuuucgaggcaaccggcaaccuagucguuccucgguacgccuuugcuauggaacgcaacgccgggagcggaaucauaauuucggauacaccagugcaugacugcaauaccacgugucaaacuccgaagggcgcaaucaacacaucucuccccuuccagaauauucacccuaucaccaucgguaaaugcccaaaguauguaaaguccacuaaacugagacuugcuacagggcugaggaacgugcccucaauucagagucggggauuguuuggcgccauagcgggcuucaucgaagggggauggaccgguauggucgacggcugguacggguaucaucaccagaaugaacaaggaagcggcuacgccgcagaucucaaguccacgcagaacgcuauugacgagaucaccaauaaagugaacucuguuauagagaagaugaauacacaguuuacugccguggguaaagaguucaaccaccuggaaaagcgcauugaaaauuuaaacaagaaagucgaugacggguuccuggauaucuggaccuacaaugcugagcuccuugugcuguuggaaaacgagcgaacacuagacuaucaugauagcaauguaaagaaccuguacgagaaaguuagaucacagcucaagaacaaugccaaagaaaucggcaacggauguuuugaguucuaucacaagugcgacaauacuuguauggaaagugugaagaacggcaccuacgauuauccuaaauacuccgaggaagcaaagcugaauagggaggagauugacggggucaaacuugaaagcacacggaucuaucaaauucuggccauauacucuaccguggcuucaaguuugguccucgugguuagccugggagcgaucuccuuuuggaugugcucuaacgguucguuacagugccguauuuguaucuga

SEQ ID NO: 135759 - RNA, 1701 nt, Artificial Sequence
  derived and/or modified sequence opt3 from hemagglutinin__InfluenzaA__BAJ40000
augaagaccauccuggugguccuccuuuacacauucgccacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacaccuacguguucgucgggacaucucgcuauuccaagaaauuuaagccugagauugccauccgaccaaaagugcgugaucaggagggaagaaugaauuacuauuggacucugguggaacccggugacaagauuaccuucgaggcgacaggcaaccuagucguuccuagguacgcauuugccauggaacggaacgcugggagcggaaucauaauuucggauaccccagugcaugacugcaauacgacuugucaaacaccgaaaggcgccaucaacaccucucuccccuuccagaauauucacccuaucacuaucgguaagugcccaaaguauguaaaauccacaaagcugcgccuugcaaccgggcugagaaacgugcccucaauucagaguaggggauuguuuggcgcuauagccggcuucaucgaagggggauggacggguauggucgacggcugguacggguaucaucaccagaaugaacaaggaagcggcuacgcggccgaucucaaauccacccagaacgcaauugacgagaucacaaauaaggugaacucuguuauagagaaaaugaauacucaguuuaccgcuguggguaaggaguucaaccaccuggaaaagcggauugaaaauuuaaacaaaaaggucgaugacggguuccuggauaucuggacauacaaugccgagcuccuugugcuguuggaaaacgagcgcacucuagacuaucaugauagcaauguaaagaaccuguacgagaagguucgaucacagcucaaaaacaaugcuaaggaaaucggcaacggauguuuugaguucuaucacaagugcgacaauaccuguauggaaagugugaaaaacggcacauacgauuauccuaaguacuccgaggaagccaaacugaauagagaggagauugacggggucaaacuugaaagcaccaggaucuaucaaauucuggcaauauacucuacuguggccucaaguuugguccucgugguuagccugggagcuaucuccuuuuggaugugcucuaacgguucguuacagugccggauuuguaucuga

SEQ ID NO: 135760 - RNA, 1701 nt, Artificial Sequence; identical to SEQ ID NO: 129695
  derived and/or modified sequence opt3 from hemagglutinin__InfluenzaA__BAJ40001

SEQ ID NO: 135761 - RNA, 1701 nt, Artificial Sequence; identical to SEQ ID NO: 124685
  derived and/or modified sequence opt3 from hemagglutinin__InfluenzaA__BAJ40002

SEQ ID NO: 135762 - RNA, 1701 nt, Artificial Sequence; identical to SEQ ID NO: 129695
  derived and/or modified sequence opt3 from hemagglutinin__InfluenzaA__BAJ40003

SEQ ID NO: 135763 - RNA, 1701 nt, Artificial Sequence
  derived and/or modified sequence opt3 from hemagglutinin__InfluenzaA__BAJ40004
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugaaaccgccgcuuguccucaugcaggggccaaaaguuuuuauaagaaucugaucuggcucgucaaaaagggaaacagcuacccaaaauuaucuaaguccuauauaaaugacaagggcaaagaggugcugguacuuuggggcauccaccaccccucaacgagcgcugaucaacagaguuuguaccagaacgccgacgcguacguuuucguggggacuucucgcuauuccaagaaauuuaagccugagauugcaauccgaccaaaaguccgugaucaggaaggaagaaugaauuacuauuggacccugguggagcccggugacaagauuacauucgaagccacuggcaaccuaguggucccuagguacgcuuuugccauggagcggaacgcagggagcggaaucauaauuucggauaccccaguucaugacugcaauacaaccugucaaacgccgaaaggcgcuaucaacacuucucuccccuuccagaauauucacccuaucacaaucgguaagugcccaaaguaugugaaauccaccaagcugcgccuugccacugggcugagaaacguacccucaauucagaguaggggauuguuuggcgcgauagccggcuucaucgaagggggauggacagguaugguggacggcugguacggguaucaucaccagaaugagcaaggaagcggcuacgcagcugaucucaaauccacccagaacgccauugacaagaucacgaauaaagucaacucugugauagagaagaugaauacccaguuuacagcuguugguaaggaguucaaccaccuggagaaacggauugaaaauuuaaacaagaaaguggaugacggguuccuggauaucuggacuuacaaugccgagcuccuuguccuguuggaaaacgagcgcacccuagacuaucaugauagcaaugugaagaaccuguacgagaaaguaaagucacagcucaagaacaaugcaaaagaaaucggcaacggauguuuugaguucuaucacaagugcgacaauacauguauggaaaguguuaaaaacggcacuuacgauuauccuaaguacuccgaggaagccaaacugaaucgagagaagauugacggggugaaacuugagagcaccagaaucuaucaaauucuggcuauauacucuacagucgcgucaaguuuggugcucgucgugagccugggagcaaucuccuuuuggaugugcucuaacgguucguuacagugcaggauuuguaucuga

SEQ ID NO: 135764 - RNA, 1701 nt, Artificial Sequence
  derived and/or modified sequence opt3 from hemagglutinin__InfluenzaA__BAJ40006
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggccgcgaaguacugguucuuuggggcauccaccaccccucaacgagcgcugaucaacagaguuuguaccagaacgccgacacuuacguguucgucgggaccucucgauauuccaaaaaguuuaaaccugagauugcgauccguccaaaggugagagaucaggagggaaggaugaauuacuauuggacacugguggaacccggugacaaaauuacuuucgaggcaaccggcaaccuagucguuccucgguacgccuuugcuauggaacgcaacgccgggagcggaaucauaauuucggauacaccagugcaugacugcaauaccacgugucaaacuccgaagggcgcaaucaacacaucucuccccuuccagaauauucacccuaucaccaucgguaaaugcccaaaguauguaaaguccacuaaacugagacuugcuacagggcugaggaacgugcccucaauucagagucggggauuguuuggcgccauagcgggcuucaucgaagggggauggaccgguauggucgacggcugguacggguaucaucaccagaaugaacaaggaagcggcuacgccgcagaucucaaguccacgcagaacgcuauugacgagaucaccaauaaagugaacucuguuauagagaagaugaauacacaguuuacugccguggguaaagaguucaaccaccuggaaaagcgcauugaaaauuuaaacaagaaagucgaugacggguuccuggauaucuggaccuacaaugcugagcuccuugugcuguuggaaaacgagcgaacacuagacuaucaugauagcaauguaaagaaccuguacgagaaaguuagaucacagcucaagaacaaugccaaagaaaucggcaacggauguuuugaguucuaucacaagugcgacaauacuuguauggaaagugugaagaacggcaccuacgauuauccuaaauacuccgaggaagcaaagcugaauagggaggagauugacggggucaaacuugaaagcacacggaucuaucaaauucuggccauauacucuaccguggcuucaaguuugguccucgugguuagccugggagcgaucuccuuuuggaugugcucuaacgguucguuacagugccguauuuguaucuga

SEQ ID NO: 135765 - RNA, 1701 nt, Artificial Sequence; identical to SEQ ID NO: 124685
  derived and/or modified sequence opt3 from hemagglutinin__InfluenzaA__BAJ40007

SEQ ID NO: 135766 - RNA, 1701 nt, Artificial Sequence
  derived and/or modified sequence opt3 from hemagglutinin__InfluenzaA__BAJ40008
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaucgccgagcuccuugugcuguuggaaaaugagcgcacccuagacuaucaugauagcaacguaaagaaucuguacgagaagguucgaucacagcucaaaaacaacgcaaaggaaauuggcaauggauguuuugaguucuaucacaagugcgacaacacauguauggaaagugugaaaaauggcacuuacgauuauccuaaguacuccgaggaagccaaacugaacagagaggagaucgacggggucaaacuugaaagcaccaggauuuaucaaauacuggcuaucuacucuacaguggcgucaaguuugguccucgugguuagccugggagcaauuuccuuuuggaugugcucuaaugguucguuacagugccggaucuguaucuga

SEQ ID NO: 135767 - RNA, 1701 nt, Artificial Sequence
  derived and/or modified sequence opt3 from hemagglutinin__InfluenzaA__BAJ40009
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucagacaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaauggauuacuauuggacccugguggaacccggugacaagauuacauucgaggccacuggcaaccuagucguuccuagguacgcuuuugccauggaacggaaugcagggagcggaaucauaauuucggacaccccagugcauaacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgauggcugguacggguaucaucaccagaacgaacaaggaagcggcuacgcagcugaccucaaauccacccagaaugccauugauaagaucacgaacaaaguaaauucuguuauagagaagaugaacacccaguuuacagcuguggguaaggaguucaaucaccuggaaaaccggauugagaauuuaaacaaaaaggucgacgauggguuccuggacaucuggacuuacaaugccgaacuccuugugcuguuggagaacgaacgcacccuagauuaucaugacagcaaugugaaaaaccuguacgagaagguucgaucacagcucaaaaacaaugcaaaggagaucggcaacggauguuuugaguucuaucacaagugcgauaauacauguauggaaagugugaaaaacggcacuuacgacuauccuaaguacuccgaagaggccaaacugaauagagaagagauugauggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 135768 - RNA, 1701 nt, Artificial Sequence
  derived and/or modified sequence opt3 from hemagglutinin__InfluenzaA__BAJ40010
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaauugcucucuacagcaucaaguuggagcuacauuguugagaccuccucuucggacaacggaacuugcuauccaggcgauuuuaucgacuacgaggagcugagggagcagcugucaagcgugaguuccuucgaacgguuugagauuuucccgaagacaucuagcuggcccaaucacgauuccgacaagggugucaccgccgcuuguccucaugcaggggccaaaucauuuuauaagaaccucaucugguuagugaaaaagggaaauaguuacccaaaacugagcaagucuuauauaaacgauaagggcaaagaaguacuuguuuuguggggcauccaccaccccuccacgucagcugaccaacagagccuguaccagaaugccgaugcguacguguucgucgggacuucccgcuauucuaagaaauuuaagccugagauugcaauccgaccaaaagugcgugaccaggagggaagaauggauuacuauuggacccuaguggaacccggugacaagauuacauucgaggccacuggcaaccucgucguuccuagguacgcuuuugccauggaacggaaugcaggguccggaaucauaauuagcgacaccccagugcauaacugcaacacaaccugucaaacgccgaaaggcgcuaucaauacuucgcugcccuuccagaacauucacccuaucacaaucgguaagugcccaaaguauguaaaaucuaccaagcugcgccuugccacuggguugagaaaugugcccuccauucagucaaggggacucuuuggcgcgauagccggcuucaucgaagggggauggacagguauggucgauggcugguacggguaucaucaccagaacgaacaaggaaguggcuacgcagcugaccugaaaagcacccagaaugccauugauaagaucacgaacaaagugaauaguguuauagagaagaugaacacccaguuuacagcuguggguaaggaguucaaucacuuagaaaaacggauugagaaccugaauaagaaagucgacgauggguuccucgacaucuggacuuacaacgccgaacuucugguguugcuagagaaugaacgcacccuggauuaucaugacucuaacguaaagaaucucuacgagaaaguucgaagccagcugaagaacaacgcaaaggagaucggcaauggauguuuugaguucuaucacaaaugcgauaacacauguauggaaucagugaagaauggcacuuacgacuauccuaaauacagugaagaggccaaacuuaacagagaagagauugauggggucaagcuggaguccaccaggaucuaucaaauuuuggcuauauacagcacaguggcgucuucacucguccuggugguuaguuuaggagcaaucagcuuuuggaugugcuccaaugguucucugcagugccggauuuguaucuga

SEQ ID NO: 135769 - RNA, 1701 nt, Artificial Sequence; identical to SEQ ID NO: 135758
  derived and/or modified sequence opt3 from hemagglutinin__InfluenzaA__BAJ40011

SEQ ID NO: 135770 - RNA, 1701 nt, Artificial Sequence
  derived and/or modified sequence opt3 from hemagglutinin__InfluenzaA__BAJ40012
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacgggaucaaacuugaaagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 135771 - RNA, 1701 nt, Artificial Sequence; identical to SEQ ID NO: 135758
  derived and/or modified sequence opt3 from hemagglutinin__InfluenzaA__BAJ40013

SEQ ID NO: 135772 - RNA, 1701 nt, Artificial Sequence; identical to SEQ ID NO: 135758
  derived and/or modified sequence opt3 from hemagglutinin__InfluenzaA__BAJ40014

SEQ ID NO: 135773 - RNA, 1701 nt, Artificial Sequence
  derived and/or modified sequence opt3 from hemagglutinin__InfluenzaA__BAJ40015
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaauacaagcuccuggcccaaccacgauucaaauaagggugucaccgccgcuuguccucaugcaggggccaagaguuuuuauaaaaaccugaucuggcucgugaagaaaggaaauagcuacccaaaguuaucuaaauccuauauaaacgacaagggcaaggaaguacugguucuuuggggcauccaccaccccucaacgagcgcugaucaacagaguuuguaccagaaugccgacacuuacguguucgucgggaccucucgcuauuccaaaaaguuuaaaccugagauugcgauccgaccaaaggugcgugaucaggagggaagaaugaacuacuauuggacacugguggaacccggugacaaaauuacuuucgaggcaaccggcaaccuagucguuccuagguacgccuuugcuauggaacggaaugccgggagcggaaucauaauuucggauacaccagugcaugacugcaacaccacgugucaaacuccgaagggcgcaaucaauacaucucuccccuuccagaacauucacccuaucaccaucgguaaaugcccaaaguauguaaaguccacuaaacugcgccuugcuacagggcugagaaaugugcccucaauucagaguaggggauuguuuggcgccauagcgggcuucaucgaagggggauggaccgguauggucgacggcugguacggguaucaucaccagaacgaacaaggaagcggcuacgccgcagaucucaaguccacgcagaaugcuauugacgagaucaccaacaaaguuaauucugugauagagaagaugaacacacaguuuacugccguggguaaagaguucaaucaccuggaaaagcggauugaaaacuuaaauaagaaagucgaugacggguuccuggauaucuggaccuacaacgcugagcuccuugugcuguuggaaaaugagcgcacacuagacuaucaugauagcaacguaaagaaccuguacgagaaaguucgaucacagcucaagaauaacgccaaagaaaucggcaauggauguuuugaguucuaucacaagugcgacaacacuuguauggaaagugugaagaauggcaccuacgauuauccuaaauacuccgaggaagcaaagcugaacagagaggagauugacggggucaaacuugaaagcacaaggaucuaucaaauucuggccauauacucuaccguggcuucaaguuugguccucgugguuagccugggagcgaucuccuuuuggaugugcucuaaugguucguuacagugccggauuuguaucuga

SEQ ID NO: 135774 - RNA, 1701 nt, Artificial Sequence; identical to SEQ ID NO: 135758
  derived and/or modified sequence opt3 from hemagglutinin__InfluenzaA__BAJ40016

SEQ ID NO: 135775 - RNA, 1701 nt, Artificial Sequence
  derived and/or modified sequence opt3 from hemagglutinin__InfluenzaA__BAJ40017
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaacucggacaauggaacuugcuauccaggcgauuuuaucgacuacgaggagcucagggagcagcugucaagcgugaguuccuucgaacgguuugagauuuucccgaagacaucuagcuggcccaaccacgauuccaauaagggugucaccgccgcuuguccucaugcaggggccaaaucauuuuauaagaaccugaucuggcucgugaaaaagggaaauaguuacccaaaauuaagcaagucuuauauaaacgacaagggcaaagaaguacugguucuuuggggcauccaccaccccuccacgucagcugaucaacagagcuuguaccagaaugccgacgcguacguguucgucgggaccagucgcuauucuaagaaauuuaagccugagauugcaauccgaccaaaagugcgugaucaggagggaagaaugaacuacuauuggacucugguggaacccggugacaagauuacauucgaggccacuggcaaccuagucguuccuagguacgcuuuugccauggaacggaaugcaggguccggaaucauaauuagcgauaccccagugcaugacugcaacacaaccugucaaacgccgaaaggcgcuaucaauacuucgcuccccuuccagaacauucacccuaucacaaucgguaagugcccaaaguauguaaaaucuaccaagcugcgccuugccacugggcugagaaaugugcccuccauucagucaaggggauuguuuggcgcgauagccggcuucaucgaagggggauggacagguauggucgacggcugguacggguaucaucaccagaacgaacaaggaaguggcuacgcagcugaucucaaaagcacccagaaggccauugacgagaucacgaauaaagugaacuccguuauagagaagaugaauacccaguuuacagcuguggguaaggaguucaaccaccuggaaaaacggauugaaaauuuaaacaagaaagucgaugacggguuccuggauaucuggacuuacaaugccgagcuccuugugcuguuggaaaacgagcgcacccuagacuaucaugauucuaauguaaagaaccuguacgagaaaguucgaagccagcucaagaacaaugcaaaggaaaucggcaacggauguuuugaguucuaucacaaaugcgacaauacauguauggaaucagugaagaacggcacuuacgauuauccuaaauacagugaggaagccaagcugaauagagaggagauugacggggucaaacuugaauccaccaggaucuaucaaauucuggcuauauacagcacaguggcgucuucauugguccucgugguuagucugggagcaaucagcuuuuggaugugcuccaacgguucuuuacagugccggauuuguaucuga

SEQ ID NO: 135776 - RNA, 1701 nt, Artificial Sequence; identical to SEQ ID NO: 125849
  derived and/or modified sequence opt3 from hemagglutinin__InfluenzaA__BAJ40018

SEQ ID NO: 135777 - RNA, 1701 nt, Artificial Sequence; identical to SEQ ID NO: 135764
  derived and/or modified sequence opt3 from hemagglutinin__InfluenzaA__BAJ40019

SEQ ID NO: 135778 - RNA, 1701 nt, Artificial Sequence; identical to SEQ ID NO: 135764
  derived and/or modified sequence opt3 from hemagglutinin__InfluenzaA__BAJ40020

SEQ ID NO: 135779 - RNA, 1701 nt, Artificial Sequence
  derived and/or modified sequence opt3 from hemagglutinin__InfluenzaA__BAJ40021
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugaaaccgccgcuuguccucaugcaggggccaaaaguuuuuauaagaaucugaucuggcucgucaaaaagggaaacagcuacccaaaauuaucuaaguccuauauaaaugacaagggcaaagaggugcugguacuuuggggcauccaccaccccucaacgagcgcugaucaacagaguuuguaccagaacgccgacgcguacguuuucguggggacuucucgcuauuccaagaaauuuaagccugagauugcaauccgaccaaaaguccgugaucaggaaggaagaaugaauuacuauuggacccugguggagcccggugacaagauuacauucgaagccacuggcaaccuaguggucccuagguacgcuuuugccauggagcggaacgcagggagcggaaucauaauuucggauaccccaguucaugacugcaauacaaccugucaaacgccgaaaggcgcuaucaacacuucucuccccuuccagaauauucacccuaucacaaucgguaagugcccaaaguaugugaaauccaccaagcugcgccuugccacugggcugagaaacguacccucaauucagaguaggggauuguuuggcgcgauagccggcuucaucgaagggggauggacagguaugguggacggcugguacggguaucaucaccagaaugagcaaggaagcggcuacgcagcugaucucaaauccacccagaacgccauugacaagaucacgaauaaagucaacucugugauagagaagaugaauacccaguuuacagcuguugguaaggaguucaaccaccuggagaaacggauugaaaauuuaaacaagaaaguggaugacggguuccuggauaucuggacuuacaaugccgagcuccuuguccuguuggaaaacgagcgcacccuagacuaucaugauagcaaugugaagaaccuguacgagaaaguacgaucacagcucaagaacaaugcaaaggaaaucggcaacggauguuuugaguucuaucacaaaugcgacaauacauguauggaaaguguuaagaacggcacuuacgauuauccuaaauacuccgaggaagccaagcugaauagagaggagauugacggggugaaacuugaaagcaccaggaucuaucaaauucuggcuauauacucuacagucgcgucaaguuuggugcucgucgugagccugggagcaaucuccuuuuggaugugcucuaacgguucguuacagugccggauuuguaucuga

SEQ ID NO: 135780 - RNA, 1701 nt, Artificial Sequence; identical to SEQ ID NO: 125849
  derived and/or modified sequence opt3 from hemagglutinin__InfluenzaA__BAJ40023

SEQ ID NO: 135781 - RNA, 1701 nt, Artificial Sequence
  derived and/or modified sequence opt3 from hemagglutinin__InfluenzaA__BAJ40024
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacacuuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaaggucgaugacggguuccuggauaucuggaccuacaaugcugagcuccuugugcuguuggaaaacgagcgcacacuagacuaucaugauagcaauguuaaaaaccuguacgagaagguacgaucacagcucaaaaacaaugccaaggaaaucggcaacggauguuuugaguucuaucacaagugcgacaauacuuguauggaaagugugaaaaacggcaccuacgauuauccuaaguacuccgaggaagcaaaacugaauagagagaagauugacggggucaaacuugagagcacaaggaucuaucaaauucuggccauauacucuaccguggcuucaaguuugguccucgugguuagccugggagcgaucuccuuuuggaugugcucuaacgguucguuacagugccggauuuguaucuga

SEQ ID NO: 135782 - RNA, 1701 nt, Artificial Sequence; identical to SEQ ID NO: 135758
  derived and/or modified sequence opt3 from hemagglutinin__InfluenzaA__BAJ40025

SEQ ID NO: 135783 - RNA, 1701 nt, Artificial Sequence; identical to SEQ ID NO: 125849
  derived and/or modified sequence opt3 from hemagglutinin__InfluenzaA__BAJ40026

SEQ ID NO: 135784 - RNA, 1701 nt, Artificial Sequence
  derived and/or modified sequence opt3 from hemagglutinin__InfluenzaA__BAJ40027
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugaaaccgccgcuuguccucaugcaggggccaaaaguuuuuauaagaaucugaucuggcucgucaaaaagggaaacagcuacccaaaauuaucuaaguccuauauaaaugacaagggcaaagaggugcugguacuuuggggcauccaccaccccucaacgagcgcugaucaacagaguuuguaccagaacgccgacgcguacguuuucguggggacuucucgcuauuccaagaaauuuaagccugagauugcaauccgaccaaaaguccgugaucaggaaggaagaaugaauuacuauuggacccugguggagcccggugacaagauuacauucgaagccacuggcaaccuaguggucccuagguacgcuuuugccauggagcggaacgcagggagcggaaucauaauuucggauaccccaguucaugacugcaauacaaccugucaaacgccgaaaggcgcuaucaacacuucucuccccuuccagaauauucacccuaucacaaucgguaagugcccaaaguaugugaaauccaccaagcugcgccuugccacugggcugagaaacguacccucaauucagaguaggggauuguuuggcgcgauagccggcuucaucgaagggggauggacagguaugguggacggcugguacggguaucaucaccagaaugagcaaggaagcggcuacgcagcugaucucaaauccacccagaacgccauugacaagaucacgaauaaagucaacucugugauagagaagaugaauacccaguuuacagcuguugguaaggaguucaaccaccuggagaaacggauugaaaauuuaaacaagaaaguggaugacggguuccuggauaucuggacuuacaaugccgagcuccuuguccuguuggaaaacgagcgcacccuagacuaucaugauagcaaugugaagaaccuguacgagaaaguaaagucacagcucaagaacaaugcaaaagaaaucggcaacggauguuuugaguucuaucacaagugcgacaauacauguauggaaaguguuaaaaacggcacuuacgauuauccuaaguacuccgaggaagccaaacugaaucgagaggagauugacggggugaaacuugaaagcaccagaaucuaucaaauucuggcuauauacucuacagucgcgucaaguuuggugcucgucgugagccugggagcaaucuccuuuuggaugugcucuaacgguucguuacagugcaggauuuguaucuga

SEQ ID NO: 135785 - RNA, 1701 nt, Artificial Sequence
  derived and/or modified sequence opt3 from hemagglutinin__InfluenzaA__BAJ40028
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccgcauucaucgagggcggguggacaggaauggucgacgguugguacggcuaucaucaccagaaugaacaagggagcggauacgcugccgaucucaaauccacccagaacgcuauugacaagaucacgaauaaagugaacucuguuauagagaagaugaauacccaguuuacagccgugggcaaggaguucaaccaccuggaaaaacggauugagaauuuaaacaagaaagucgaugacgguuuccuggauaucuggacuuacaaugcagaacuccuugugcuguuggagaacgaacgcacccuagacuaucaugauagcaauguaaagaaccuguacgagaaaguucgaucacagcucaagaacaaugccaaggagaucgggaacggcuguuuugaguucuaucacaaaugcgacaauacauguauggagagugugaagaacggaacuuacgauuauccuaaauacuccgaagaggcuaagcugaauagagaagagauugacggcgucaaacuugagagcaccaggaucuaucaaauucuggcgauauacucuacaguggcaucaaguuugguccucgugguuagccugggggccaucuccuuuuggaugugcucuaacggaucguuacagugccggauuuguaucuga

SEQ ID NO: 135786 - RNA, 1701 nt, Artificial Sequence; identical to SEQ ID NO: 135758
  derived and/or modified sequence opt3 from hemagglutinin__InfluenzaA__BAJ40029

SEQ ID NO: 135787 - RNA, 1701 nt, Artificial Sequence
  derived and/or modified sequence opt3 from hemagglutinin__InfluenzaA__BAJ40030
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucaaggagcagcugagcaguguguccucuuucgaaagguuugagauuuucccgaagacaagcuccuggcccaaucacgauucaaacaaaggugucaccgccgcuuguccucaugcaggggccaagaguuuuuauaaaaaucugaucuggcucgugaagaaaggaaacagcuacccaaaguuaucuaaguccuauauaaaugacaaaggccgggaaguacugguucuuuggggcauccaccaccccucaacgagcgcugaucaacagaguuuguaccagaacgccgacacuuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaaggucgaugacggguuccuggauaucuggaccuacaaugcugagcuccuugugcuguuggaaaacgagcgcacacuagacuaucaugauagcaauguaaagaaccuguacgagaagguucgaucacagcucaaaaacaaugccaaggaaaucggcaacggauguuuugaguucuaucacaagugcgacaauacuuguauggaaagugugaaaaacggcaccuacgauuauccuaaguacuccgaggaagcaaaacugaauagagaggagauugacggggucaaacuugaaagcacaaggaucuaucaaauucuggccauauacucuaccguggcuucaaguuugguccucgugguuagccugggagcgaucuccuuuuggaugugcucuaacgguucguuacagugccggauuuguaucuga

SEQ ID NO: 135788 - RNA, 1701 nt, Artificial Sequence; identical to SEQ ID NO: 124685
  derived and/or modified sequence opt3 from hemagglutinin__InfluenzaA__BAJ40031

SEQ ID NO: 135789 - RNA, 1701 nt, Artificial Sequence; identical to SEQ ID NO: 135758
  derived and/or modified sequence opt3 from hemagglutinin__InfluenzaA__BAJ40032

SEQ ID NO: 135790 - RNA, 1701 nt, Artificial Sequence; identical to SEQ ID NO: 135787
  derived and/or modified sequence opt3 from hemagglutinin__InfluenzaA__BAJ40033

SEQ ID NO: 135791 - RNA, 1701 nt, Artificial Sequence
  derived and/or modified sequence opt3 from hemagglutinin__InfluenzaA__BAJ40034
augaaggccauccuggugguccuccuuuacaccuucgcuacagcaaacgccgacacucugugcauuggcuaucacgcgaauaacagcacggauaccguugacacaguguuggagagaaauguaacugugacccauuccgucaacuuacuggaagauaagcacaaugggaagcuauguaaacucaggggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaggagcuccgggagcagcugagcaguguguccucuuucgaacgcuuugagauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggaaguacugguucuuuggggcauccaccaccccucaacgagcgcugaucaacagaguuuguaccagaacgccgacacuuacguguucgucgggaccucucgauauuccaaaaaguuuaaaccugagauugcgauccguccaaaggugagagaucaggagggaaggaugaauuacuauuggacacugguggaacccggugacaaaauuacuuucgaggcaaccggcaaccuagucguuccucgguacgccuuugcuauggaacgcaacgccgggagcggaaucauaauuucggauacaccagugcaugacugcaauaccacgugucaaacuccgaagggcgcaaucaacacaucucuccccuuccagaauauucacccuaucaccaucgguaaaugcccaaaguauguaaaguccacuaaacugagacuugcuacagggcugaggaacgugcccucaauucagagucggggauuguuuggcgccauagcgggcuucaucgaagggggauggaccgguauggucgacggcugguacggguaucaucaccagaaugaacaaggaagcggcuacgccgcagaucucaaguccacgcagaacgcuauugacgagaucaccaauaaagugaacucuguuauagagaagaugaauacacaguuuacugccguggguaaagaguucaaccaccuggaaaagcgcauugaaaauuuaaacaagaaagucgaugacggguuccuggauaucuggaccuacaaugcugagcuccuugugcuguuggaaaacgagcgaacacuagacuaucaugauagcaauguaaagaaccuguacgagaaaguuagaucacagcucaagaacaaugccaaagaaaucggcaacggauguuuugaguucuaucacaagugcgacaauacuuguauggaaagugugaagaacggcaccuacgauuauccuaaauacuccgaggaagcaaagcugaauagggagaaaauugacggggucaaacuugagagcacacggaucuaucaaauucuggccauauacucuaccguggcuucaaguuugguccucgugguuagccugggagcgaucuccuuuuggaugugcucuaacgguucguuacagugccguauuuguaucuga

SEQ ID NO: 135792 - RNA, 1701 nt, Artificial Sequence
  derived and/or modified sequence opt3 from hemagglutinin__InfluenzaA__BAJ40035
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacacuuacguguucgucgggaccucucgcuauuccaagaaauuuaagccugagauugcgauccgaccaaaagugcgugaucaggagggaagaaugaauuacuauuggacacugguggaacccggugacaagauuaaauucgaggcaacuggcaaccuagucguuccuagguacgccuuugcuauggaacggaacgccgggagcggaaucauaauuucggauaccccagugcaugacugcaauacaaccugucaaacgccgaagggcgcaaucaacacuucucuccccuuccagaauauucacccuaucacaaucgguaagugcccaaaauauguaaaguccaccaaacugcgccuugcuacugggcugagaaacgugcccucaauucagaguaggggauuguuuggcgccauagcgggcuucaucgaagggggauggacagguauggucgacggcugguacggguaucaucaccagaaugaacaaggaagcggcuacgccgcagaucucaaguccacccagaacgcuauugacgagaucacgaauaaagugaacucuguuauagagaagaugaauacccaguuuacagccguggguaaggaguucaaccaccuggaaaaacggauugaaaauuuaaacaagaaagucgaugacggguuccuggauaucuggacuuacaaugcugagcuccuugugcuguuggaaaacgagcgcacccuagacuaucaugauagcaauguaaagaaccuguacgagaaaguucgaaaccagcucaagaauaacgccaaggaaaucggcaauggauguuuugaguucuaucacaaaugcgacaacacauguauggaaucagugaagaauggcacuuacgauuauccuaaauacagugaggaagcaaagcugaacagagaggagauugacggggucaaacuugaauccaccaggaucuaucaaauucuggccauauacagcacaguggcuucuucauugguccucgugguuagucugggagcgaucagcuuuuggaugugcuccaaugguucuuuacagugccggauuuguaucuga

SEQ ID NO: 135793 - RNA, 1701 nt, Artificial Sequence
  derived and/or modified sequence opt3 from hemagglutinin__InfluenzaA__BAJ40036
augaaggccauccuggugguccucauuuacaccuucgcuacagcaaacgccgacacucuuugcauaggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggacuucucgcuauuccaagaaauuuaagccugagaucgcaauucgaccaaaagugcgugaucaggagggaagaaugaauuacuauuggaccaucguggaacccggugacaagauaacauucgaggccacuggcaacuuggucguuccuagguacgcuuuugccauggaacggaacgcagggagcggaauuaucauuucggauaccccagugcaugacugcaauacaaccugucaaacgccgaaaggcgcuaucaacacuucucugcccuuccagaauauccacccuauuacaauagguaagugcccaaaguauguaaaauccaccaagcuacgccucgccacugggcugagaaacgugcccucaauccagaguaggggacuuuuuggcgcgauugccggcuucaucgaagggggauggacagguauggucgacggcugguacggguaucaucaccagaaugaacaaggaagcggcuacgcagcugaucugaaauccacccagaacgccauagacgagauuacgaauaaggugaacucuguuaucgagaaaaugaauacccaguuuacagcuguggguaaggaguucaaccacuuggagaagcggaucgaaaaucucaacaaaaaggucgaugacggguuccuggauauuuggacuuacaaugccgaguuacuggugcuccuugaaaacgagcgcacccuggacuaucaugauagcaauguuaaaaacuuguacgagaagguaaaaucacagcuaaagaacaaugcaaaggaaaucggcaacggauguuuugaguucuaucacaaaugcgacaauacauguauggaaagugugaagaacggcacuuacgauuauccuaaauacuccgaggaagccaagcugaaucgagaggagauugacggggucaaacucgaaagcaccagaauauaucaaauccuggcuauuuacucuacaguggcgucaagucuuguccuggugguuagcuugggagcaaucuccuuuuggaugugcucuaacgguucgcuccagugcaggaucuguauuuga

SEQ ID NO: 135794 - RNA, 1701 nt, Artificial Sequence; identical to SEQ ID NO: 131288
  derived and/or modified sequence opt3 from hemagglutinin__InfluenzaA__BAJ40037

SEQ ID NO: 135795 - RNA, 1701 nt, Artificial Sequence
  derived and/or modified sequence opt3 from hemagglutinin__InfluenzaA__BAJ40038
augaaggccauccugcucgugcuucuguacaccuucgcuacagcaaacgccgacacuuugugcauuggcuaucacgcgaauaacagcacggauaccgucgacacaguuuuagagaagaaugugacuguaacccauuccgugaaccugcuagaagauaagcacaaugggaaacucuguaagcugagaggagucgcuccccuucaucuggguaaaugcaacauagccggcuggaucuuggggaauccugagugugaaucucucucaacagcaaguagcugguccuacauuguggagaccucuucgucagacaacggaacuugcuauccaggcgauuuuaucgacuacgaggagcugagggagcagcugagcaguguuuccucuuucgaacgguuugagauuuucccgaagacaagcuccuggcccaaucacgauucaaacaagggugugaccgccgcuuguccucaugcaggggccaaaaguuuuuauaagaaucucaucugguuagucaaaaagggaaacagcuacccaaaacugucuaaguccuauauaaaugacaagggcaaagaagugcuuguauuguggggcauccaccaccccucaacgagcgcugaucaacagagucuguaccagaacgccgacacuuacguuuucguggggaccucucgcuauuccaagaaauuuaagccugagauugcgauccgaccaaaaguccgugaucaggagggaagaaugaauuacuauuggacaauuguggaacccggugacaagaucacuuucgaggcaaccggcaaccuaguggucccuagguacgccuuugcuauggaacggaacgccgggagcggaauaauuaucucggauacaccaguucaugacugcaauaccacgugucaaacuccgaaaggcgcaauuaacacaucucuccccuuccagaauauccacccuaucaccauugguaagugcccaaaguaugugaaauccacuaagcugcgccuugcuacagggcugagaaacguacccucaauacagaguaggggauuguuuggcgccaucgcgggcuucauugaagggggauggaccgguaugguggacggcugguacggguaucaucaccagaaugaacaaggaagcggcuacgccgcagaucucaaauccacgcagaacgcuaucgacgagauaaccaauaaggucaacucugugauugagaaaaugaauacacaguuuacugccguugguaaggaguucaaccaccuggaaaagcggaucgaaaauuuaaacaaaaagguggaugacggguuccuggauaucuggaccuacaaugcugagcuccuuguccuguuggaaaacgagcgcacacuagacuaucaugauagcaaugugaaaaaccuguacgagaagguacgaucacagcucaaaaacaaugccaaggaaauuggcaacggauguuuugaguucuaucacaagugcgacaauacuuguauggaaaguguuaaaaacggcaccuacgauuauccuaaguacuccgaggaagcaaaacugaauagagaggagaucgacggggugaaacuugaaagcacaaggauuuaucaaauacuggccaucuacucuaccgucgcuucaaguuuggugcucgucgugagccugggagcgauuuccuuuuggaugugcucuaacgguucguuacagugccggaucuguaucuga

SEQ ID NO: 135796 - RNA, 1701 nt, Artificial Sequence; identical to SEQ ID NO: 124685
  derived and/or modified sequence opt3 from hemagglutinin__InfluenzaA__BAJ40039

SEQ ID NO: 135797 - RNA, 1701 nt, Artificial Sequence
  derived and/or modified sequence opt3 from hemagglutinin__InfluenzaA__BAJ40040
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggccgcgaaguacugguucuuuggggcauccaccaccccucaacgagcgcugaucaacagaguuuguaccagaacgccgacacuuacguguucgucgggaccucucgauauuccaaaaaguuuaaaccugagauugcgauccguccaaaggugagagaucaggagggaaggaugaauuacuauuggacacugguggaacccggugacaaaauuacuuucgaggcaaccggcaaccuagucguuccucgguacgccuuugcuauggaacgcaacgccggguauggaaucauaauuagcgauacaccagugcaugacugcaauaccacgugucaaacuccgaagggcgcaaucaacacaucgcuccccuuccagaauauucacccuaucaccaucgguaaaugcccaaaguacguaaagucuacuaaacugagacuugcuacagggcugaggaacgugcccuccauucagucacggggauuguuuggcgccauagcgggcuucaucgaagggggauggaccgguauggucgacggcugguauggguaccaucaccagaaugaacaaggaaguggcuacgccgcagaucucaagagcacgcagaacgcuauugacgagaucaccaauaaagugaacuccguuauagagaagaugaauacacaguuuacugccguggguaaagaguucaaccaccuggaaaagcgcauugaaaauuuaaacaagaaagucgaugacggguuccuggauaucuggaccuauaaugcugagcuccuugugcuguuggaaaacgagcgaacacuagacuaccaugauucuaauguaaagaaccuguaugagaaaguuagaagccagcucaagaacaaugccaaagaaaucggcaacggauguuuugaguucuaccacaagugcgacaauacuuguauggaaucagugaagaacggcaccuaugauuacccuaaauauagugaggaagcaaagcugaauagggaggagauugacggggucaaacuugaauccacacggaucuaccaaauucuggccauauacagcaccguggcuucuucauugguccucgugguuagucugggagcgaucagcuuuuggaugugcuccaacgguucuuuacagugccguauuuguaucuga

SEQ ID NO: 135798 - RNA, 1701 nt, Artificial Sequence; identical to SEQ ID NO: 131288
  derived and/or modified sequence opt3 from hemagglutinin__InfluenzaA__BAJ40041

SEQ ID NO: 135799 - RNA, 1701 nt, Artificial Sequence
  derived and/or modified sequence opt3 from hemagglutinin__InfluenzaA__BAJ40042
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucaaggagccgcugagcaguguguccucuuucgaaagguuugagauuuuccccaagacaagcuccuggccuaaucacgauucaaacaaaggugucaccgccgcuuguccacaugcaggggccaagaguuuuuauaaaaaucugaucuggcucgugaagaaaggaaacagcuaccccaaguuaucuaaguccuauauaaaugacaaaggccgggaaguacugguucuuuggggcauccaccacccuucaacgagcgcugaucgccagaguuuguaccaaaacgccgacacuuacguguucgucgggaccucucgauauuccaagaaauuuaagccagagauugcgauccgucccaaagugagagaucaggagggaaggaugaauuacuauuggacacugguggaaccuggugacaagauuacuuucgaggcaaccggcaaccuagucguuccacgguacgccuuugcuauggaacgcaacgccgggagcggaaucauaauuucggauacaccggugcaugacugcaauaccacgugucagacucccaaaggcgcaaucaacacaucucucccuuuccagaauauucacccaaucaccaucgguaagugccccaaguauguaaaauccacuaagcugagacuugcuacagggcugaggaacgugccuucaauucaaagucggggauuguuuggcgccauagcgggcuucaucgaagggggauggaccgguauggucgacggcugguacggguaucaucaccagaaugaacagggaagcggcuacgccgcagaucucaaauccacgcagaacgcuauugacgagaucaccaauaaggugaacucuguuauagagaaaaugaauacacaauuuacugccguggguaaggaguucaaccaccuggaaaagcgcauugaaaauuuaaacaaaaaggucgaugacggguuccuggauaucuggaccuacaaugcugagcuccuugugcuguuggaaaacgagcgaacacuagacuaucaugauagcaauguaaagaaccuguacgagaagguuagaucacagcucaaaaacaaugccaaggaaaucggcaacggauguuuugaguucuaucacaagugcgacaauacuuguauggaaagugugaaaaacggcaccuacgauuauccaaaguacuccgaggaagcaaaacugaauagggaggagauugacggggucaaacuugaaagcacacggaucuaucagauucuggccauauacucuaccguggcuucaaguuugguccucgugguuagccugggagcgaucuccuuuuggaugugcucuaacgguucguuacagugccguauuuguaucuga

SEQ ID NO: 135800 - RNA, 1701 nt, Artificial Sequence; identical to SEQ ID NO: 131288
  derived and/or modified sequence opt3 from hemagglutinin__InfluenzaA__BAJ40043

SEQ ID NO: 135801 - RNA, 1701 nt, Artificial Sequence
  derived and/or modified sequence opt3 from hemagglutinin__InfluenzaA__BAJ40044
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcagaaggagcaacucagcaguguguccucuuucgaaagguuugagauuuucccgaagacaagcuccuggcccaaucacgauucaaacaaaggugucaccgccgcuuguccucaugcaggggccaagaguuuuuauaaaaaucugaucuggcuggugaagaaaggaaacagcuacccaaagcucucuaaguccuauauaaaugacaaaggcaaggaaguauuaguucuguggggcauccaccaccccucaacgagcgcugaucagcagagucuuuaccagaacgccgacgcguacguguucgucgggacuucucgguauuccaaaaaguuuaaaccugagauugcaauccgcccaaaggugcgagaucaagagggacguaugaauuacuauuggaccuugguggaacccggugacaaaauuacauucgaggccacuggcaaccuggucguuccuagauacgcuuuugccauggaaaucaacgcagggagcggaauaauuaucucggauaccccagugcaugacugcaauacaaccugucagacgccgaagggcgcuauuaacacuucucuacccuuccagaauauccacccuaucacaauugguaagugcccaaaauauguaaaguccaccaaacucaggcuggccacugggcuucggaacgugcccucaauacagagucgcggacuguuuggcgcgaucgccggcuucauugaagggggauggacagguauggucgacggcugguacggguaucaucaccaaaaugaacagggaagcggcuacgcagcugauuugaaguccacccagaacgccaucgacaaaauaacgaauaaggugaacucuguuauugagaagaugaauacccaguuuacagcuguggguaaagaguucaaccaccucgaaaagagaaucgagaaucugaacaaaaaggucgaugacggguucuuagauaucuggacuuacaaugccgaacugcucgugcuucuggagaacgaaaggaccuuggacuaucaugauagcaauguuaaaaaccuauacgagaagguacggucacaacugaagaacaaugcaaaagagauuggcaacggauguuuugaguucuaucacaagugcgacaauacauguauggaaagugugaaaaacggcacuuacgauuauccuaaguacuccgaagaggccaaacucaaucgcgaagagaucgacggggucaagcuggagagcacccgaauuuaucagauacuugcuaucuacucuacaguggcgucaagucuggucuuggugguuagccucggagcaauuuccuuuuggaugugcucuaacgguucgcugcagugcagaaucuguaucuga

SEQ ID NO: 135802 - RNA, 1701 nt, Artificial Sequence; identical to SEQ ID NO: 135764
  derived and/or modified sequence opt3 from hemagglutinin__InfluenzaA__BAJ40045

SEQ ID NO: 135803 - RNA, 1701 nt, Artificial Sequence
  derived and/or modified sequence opt3 from hemagglutinin__InfluenzaA__BAJ40046
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaggugcaacauagccggcuggauccuggggaauccugagugugaaucuuugucaacagcaaguagcugguccuacauuguugagaccucuaucucggacaacggaacuugcuauccaggcgauuuuauugacuacgaggagcucaaagagcagcugucaagcgugaguuccuucgaacgguuugagaucuucccgaagacaucuagcuggcccaaucacgauuccaacaagggugucaccgccgcuuguccucaugcaggggccaaaucauuuuauaagaaucugauauggcucgugaaaaagggaaacaguuacccaaaauuaagcaagucuuauaucaaugacaagggcaaagaaguacugguucuuuggggcauucaccaccccuccacgucagcugaucaacagagcuuguaccagaacgccgacgcguacguguucgucgggaccagucgcuauucuaagaaauuuaagccugagaucgcaauucgaccaaaagugcgugaucaggagggaagaaugaauuacuauuggacucugguggaacccggugacaagaucacauucgaggccacuggcaaccuagucguuccuagguacgcuuuugccauggaacggaacgcaggguccggaauaauuaucagcgauaccccagugcaugacugcaauacaaccugucaaacgccgaaaggcgcuauuaacacuucgcuccccuuccagaauauccacccuaucacaauugguaagugcccaaaguauguaaaaucuaccaagcugcgccuugccacugggcugagaaacgugcccuccauacagucaaggggauuguuuggcgcgaucgccggcuucauugaagggggauggacagguauggucgacggcugguacggguaucaucaccagaaugaacaaggaaguggcuacgcagcugaucucaaaagcacccagaacgccaucgacaagauaacgaauaaagugaacuccguuauugagaagaugaauacccaguuuacagcuguggguaaggaguucaaccaccuggaaaagaagaucgagaauuuaaacaaaaaggucgaugacggguuccuggauaucuggacuuacaaugccaaacuccuugugcuguuggaaaacgagcggacccuagacuaucaugauucuaauguaaagaaccuguacgaaaagguucgcagccagcucaaaaacaaugcaaaggagauuggcaacggauguuuugaguucuaucacaaaugcgacaauacauguauggaaucagugaagaacggcacuuacgauuauccuaaauacagugaggaagccaagcugaaucgagaggaaaucgacggggucaaacuugaguccaccagaauuuaucaaauacuggcuaucuacagcacaguggcgucuucauugguccucgugguuagucugggagcaauuagcuuuuggaugugcuccaacgguucuuuacagugcaggaucuguaucuga

SEQ ID NO: 135804 - RNA, 1701 nt, Artificial Sequence; identical to SEQ ID NO: 135787
  derived and/or modified sequence opt3 from hemagglutinin__InfluenzaA__BAJ40047

SEQ ID NO: 135805 - RNA, 1701 nt, Artificial Sequence; identical to SEQ ID NO: 135758
  derived and/or modified sequence opt3 from hemagglutinin__InfluenzaA__BAJ40048

SEQ ID NO: 135806 - RNA, 1701 nt, Artificial Sequence
  derived and/or modified sequence opt3 from hemagglutinin__InfluenzaA__BAJ40050
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucaaggagcagcugagcaguguguccucuuucgaaagguuugagauuuucccgaagacaagcuccuggcccaaucacgauucaaacaaaggugucaccgccgcuuguccucaugcaggggccaagaguuuuuauaaaaaucugaucuggcucgugaagaaaggaaacagcuacccaaaguuaucuaaguccuauauaaaugacaaaggcaaggaaguacugguucuuuggggcauccaccaccccucaacgagcgcugaucaacagaguuuguaccagaacgccgacgcguacguguucgucgggacuucucgguauuccaaaaaguuuaaaccugagauugcaauccgcccaaaggugcgagaucaggagggacguaugaauuacuauuggacccugguggaacccggugacaaaauuacauucgaggccacuggcaaccuagucguuccuagauacgcuuuugccauggaaaggaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcggcuugccacugggcugcgcaacgugcccucaauucagaguagaggauuguuuggcgcgauagccggcuucaucgaagggggauggacagguauggucgacggcugguacggguaucaucaccagaaugaacaaggaagcggcuacgcagcugaucucaaguccacccagaacgccauugacaaaaucacgaauaaggugaacucuguuauagagaagaugaauacccaguuuacagcuguggguaaagaguucaaccaccuggaaaagaggauugagaauuuaaacaaaaaggucgaugacggguuccuggauaucuggacuuacaaugccgaacuccuugugcuguuggagaacgaacggacccuagacuaucaugauagcaauguaaagaaccuguacgagaagguucgcucacagcucaagaacaaugcaaaagagaucggcaacggauguuuugaguucuaucacaagugcgacaauacauguauggaaagugugaaaaacggcacuuacgauuauccuaaguacuccgaagaggccaaacugaaucgagaagagauugacggggucaaacuugagagcaccagaaucuaucaaauucuggcuauauacucuacaguggcgucaaguuugguccucgugguuagccugggagcaaucuccuuuuggaugugcucuaacgguucguuacagugcaggauuuguaucuga

SEQ ID NO: 135807 - RNA, 1701 nt, Artificial Sequence; identical to SEQ ID NO: 125849
  derived and/or modified sequence opt3 from hemagglutinin__InfluenzaA__BAJ40051

SEQ ID NO: 135808 - RNA, 1701 nt, Artificial Sequence
  derived and/or modified sequence opt3 from hemagglutinin__InfluenzaA__BAJ40052
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggccgcgaaguacugguucuuuggggcauccaccaccccucaacgacugcugaucaacagagcuuguaccagaacgccgacaccuacguguucgucgggacaagucgauauucuaaaaaguuuaaaccugagauugcgauccguccaaaggugagagaucaggagggaaggaugaauuacuauuggacucugguggaacccggugacaaaauuaccuucgaggcaacaggcaaccuagucguuccucgguacgccuuugcuauggaacgcaacgccggguccggaaucauaauuagcgauaccccagugcaugacugcaauacgacuugucaaacaccgaagggcgcaaucaacaccucgcuccccuuccagaauauucacccuaucacuaucgguaaaugcccaaaguauguaaagucuacaaaacugagacuugcuaccgggcugaggaacgugcccuccauucagucacggggauuguuuggcgccauagcgggcuucaucgaagggggauggacggguauggucgacggcugguacggguaucaucaccagaaugaacaaggaaguggcuacgccgcagaucucaagagcacccagaacgcuauugacgagaucacaaauaaagugaacuccguuauagagaagaugaauacucaguuuaccgccguggguaaagaguucaaccaccuggaaaagcgcauugaaaauuuaaacaagaaagucgaugacggguuccuggauaucuggacauacaaugcugagcuccuugugcuguuggaaaacgagcgaacucuagacuaucaugauucuaauguaaagaaccuguacgagaaaguuagaagccagcucaagaacaaugccaaagaaaucggcaacggauguuuugaguucuaucacaagugcgacaauaccuguauggaaucagugaagaacggcacauacgauuauccuaaauacagugaggaagcaaagcugaauagggaggagauugacggggucaaacuugaauccacccggaucuaucaaauucuggccauauacagcacuguggcuucuucauugguccucgugguuagucugggagcgaucagcuuuuggaugugcuccaacgguucuuuacagugccguauuuguaucuga

SEQ ID NO: 135809 - RNA, 1701 nt, Artificial Sequence
  derived and/or modified sequence opt3 from hemagglutinin__InfluenzaA__BAJ40053
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacacuuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaaggucgaugacggguuccuggauaucuggaccuacaaugcugagcuccuugugcuguuggaaaacgagcgcacacuagacuaucaugauagcaauguaaagaaccuguacgagaagguucgaaaccagcucaaaaauaacgccaaggaaaucggcaauggauguuuugaguucuaucacaagugcgacaacacuuguauggaaucagugaaaaauggcaccuacgauuauccuaaguacagugaggaagcaaaacugaacagagaggagauugacggggucaaacuugaauccacaaggaucuaucaaauucuggccauauacagcaccguggcuucuucauugguccucgugguuagucugggagcgaucagcuuuuggaugugcuccaaugguucuuuacagugccggauuuguaucuga

SEQ ID NO: 135810 - RNA, 1701 nt, Artificial Sequence; identical to SEQ ID NO: 125849
  derived and/or modified sequence opt3 from hemagglutinin__InfluenzaA__BAJ40054

SEQ ID NO: 135811 - RNA, 1701 nt, Artificial Sequence
  derived and/or modified sequence opt3 from hemagglutinin__InfluenzaA__BAJ40055
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcacugaucaacagaguuuguaccagaacgcugacaccuacguguucgucgggacaucucgcuauuccaagaaauuuaagccugagauugccauccgaccaaaagugcgugaucaggagggaagaaugaauuacuauuggacucugguggaacccggugacaagauuaccuucgaggcgacaggcaaccuagucguuccuagguacgcauuugccauggaacggaacgcugggagcggaaucauaauuucggauaccccagugcaugacugcaauacgaucugucaaacuccgaaaggcgccauuaacacaucucuccccuuccagaauauccacccuaucaccauugguaagugcccaaaguauguaaaauccacuaagcugcgccuugcaacagggcugagaaacgugcccucaguccagaguaggggauuguuuggcgcuauagccggcuucaucgaagggggauggaccgguaugguggacggcugguacggguaucaucaccagaaugaacaaggaagcggcuacgcggccgaucucaaauccacgcagaacgcaauugacgagaucaccaauaagguuaacucugugauagagaaaaugaauacacaguuuacugcugucgguaaggaguucaaccaccuggaaaagcggauugaaaauuuaaacaaaaagguggaugacggguuccuggauaucuggaccuacaaugccgagcuccuuguacuguuggaaaacgagcgcacacuagacuaucaugauagcaauguuaaaaaccuguacgagaaggugcgaucacagcucaaaaacaaugcuaaggaaaucggcaacggauguuuugaguucuaucacaagugcgacaauacuuguauggaaagugucaaaaacggcaccuacgauuauccuaaguacuccgaggaagccaaacugaauagagaggagauugacggggugaaacuugaaagcacaaggaucuaucaaauucuggcaauauacucuaccgucgccucaaguuuggugcucguugugagccugggagcuaucuccuuuuggaugugcucuaacgguucguuacagugccggauuuguaucuga

SEQ ID NO: 135812 - RNA, 1701 nt, Artificial Sequence
  derived and/or modified sequence opt3 from hemagglutinin__InfluenzaA__BAJ40056
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaauugcucucuacagcaucaaguuggagcuacauuguugagaccuccucuucggacaacggaacuugcuauccaggcgauuuuaucgacuacgaggagcugagggagcagcugucaagcgugaguuccuucgaacgguuugagauuuucccgaagacaucuagcuggcccaaucacgauuccaacaagggugucaccgccgcuuguccucaugcaggggccaaaucauuuuauaagaaucucaucuggcaagugaaaaagggaaacaguuacccaaaauuaagcaagucuuauauaaaugacaagggcaaagaaguacugguucuuuggggcauccaccaccccuccacgucagcugaucagcagagcuuguaccagaacgccgacgcguacguguucgucgggacuucccgcuauucuaagaaauuuaagccugagauugcaauccgaccaaaagugcgugaucaagagggaagaaugaauuacuauuggacccugguggaacccggugacaagauuacauucgaggccacuggcaaccuagucguuccuaggcaugcuuuugccauggaacggaacgcaggguccggaaucauaauuagcgauaccccagugcacaauugcaacacaaccugucagacgccgaaaggcgcuaucaauacuucgcuccccuuccagaacauucauccuaucacaaucgguaagugcccaaaguacguaaaaucucccaagcugcgccuugccaccgggcugagaaaugugccuuccauucagucaaggggauuguuuggcgcgauagccggcuucaucgaagggggauggacugguauggucgacggcugguauggguaccaccaccaaaacgaacagggaaguggcuaugcagcugaccucaaaagcacacagaaugccauugauaagaucaccaacaaagugaauaguguuauagagaagaugaacacgcaguuuaccgcuguggguaaggaguucaaucaucuggaaaaacggauugagaacuuaaauaagaaagucgacgauggguuccuggacaucuggacauacaacgccgaacuccuugugcuguuggagaaugaacgcacucuagauuaccacgacucuuauguaaagaaccuguacgagaaaguucgaagccaacucaagaacaaugcaaaggagaucggcaacggauguuuugaguucuaucauaaaugcgauaauaccuguauggaaucagugaagaacggcacauacgacuauccaaaauacagugaagaggccaagcugaauagagaagagauugauggggucaaacuugaguccacuaggaucuaucagauucuggcuauauacagcaccguggcgucuucauugguccucgugguuagucugggagcaaucagcuuuuggaugugcuccaacgguucuuuacagugccggauuuguaucuga

SEQ ID NO: 135813 - RNA, 1701 nt, Artificial Sequence
  derived and/or modified sequence opt3 from hemagglutinin__InfluenzaA__BAJ40057
augaaggccauccuggugguccuccuuuacaccuucgcuacagcaaacgccgacacucugugcauuggcuaucacgcgaauaacagcacggauaccguugacacaguguuggagagaaauguaacugugacccauuccgucaacuuacuggaagauaaacacaaugggaagcuauguaaacucaggggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaagaacuccgggagcagcugagcaguguguccucuuucgaacgcuuugagauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggaaguacugguucuuuggggcauccaccaccccucaacgagcgcugaucaacagaguuuguaccagaacgccgacacuuacguguucgucgggaccucucgauauuccaaaaaguuuaaaccugagauugcgauccguccaaaggugagagaucaggagggaaggaugaauuacuauuggacacugguggaacccggugacaaaauuacuuucgaggcaaccggcaaccuagucguuccucgguacgccuuugcuauggaacgcaacgccgggagcggaaucauaauuucggauacaccagugcaugacugcaauaccacgugucaaacuccgaagggcgcaaucaacacaucucuccccuuccagaauauucacccuaucaccaucgguaaaugcccaaaguauguaaaguccacuaaacugagacuugcuacagggcugaggaacgugcccucaauucagagucggggauuguuuggcgccauagcgggcuucaucgaagggggauggaccgguauggucgacggcugguacggguaucaucaccagaaugaacaaggaagcggcuacgccgcagaucucaaguccacgcagaacgcuauugacgagaucaccaaugaggugaacucuguuauagagaaaaugaauacacaguuuacugccguggguaaggaguucaaccaccuggaaaaacgcauugagaauuuaaacaagaaggucgaugacggguuccuggauaucuggaccuacaaugcugaacuccuugugcuguuggagaacgagcgaacacuagacuaucaugauagcaauguaaagaaccuguacgaaaagguuagaucacagcucaaaaacaaugccaaggagaucggcaacggauguuuugaguucuaucacaaaugcgacaauacuuguauggagagugugaagaacggcaccuacgauuauccuaaguacuccgaagaggcaaaacugaauagggaggaaauugacggggucaaacuugagagcacacggaucuaucaaauucuggccauauacucuaccguggcuucaaguuugguccucgugguuagccugggagcgaucuccuuuuggaugugcucuaacgguucguuacagugccguauuuguaucuga

SEQ ID NO: 135814 - RNA, 1701 nt, Artificial Sequence; identical to SEQ ID NO: 131288
  derived and/or modified sequence opt3 from hemagglutinin__InfluenzaA__BAJ40058

SEQ ID NO: 135815 - RNA, 1701 nt, Artificial Sequence; identical to SEQ ID NO: 135758
  derived and/or modified sequence opt3 from hemagglutinin__InfluenzaA__BAJ40059

SEQ ID NO: 135816 - RNA, 1701 nt, Artificial Sequence; identical to SEQ ID NO: 125849
  derived and/or modified sequence opt3 from hemagglutinin__InfluenzaA__BAJ40060

SEQ ID NO: 135817 - RNA, 1701 nt, Artificial Sequence
  derived and/or modified sequence opt3 from hemagglutinin__InfluenzaA__BAJ40061
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaaggccagcuccuggcccaaucacgauucaaacaagggugucacagcugcauguccucaugccggggcuaaaaguuuuuauaagaaucugaucuggcucgugaaaaagggaaacagcuacccaaaauuaucuaaguccuauauaaaugacaagggcaaagaaguacugguucuuuggggcauccaccaccccucaaccagcgccgaucaacagaguuuguaccagaacgcggacgcauacguguucgucgggacgucucgcuauuccaagaaauuuaagccugagauugccauccgaccaaaagugcgugaucaggagggaagaaugaauuacuauuggacucugguggaacccggugacaagauuaccuucgaggcuacaggcaaccuagucguuccuagguacgccuuugcaauggaacggaacgcugggagcggaaucauaauuucggauacuccagugcaugacugcaauaccacaugucaaaccccgaaaggcgccaucaacacgucucuccccuuccagaauauucacccuaucacuaucgguaagugcccaaaguauguaaaauccacaaagcugcgccuugcgaccgggcugagaaacgugcccucaauucagaguaggggauuguuuggcgccauagcaggcuucaucgaagggggauggacugguauggucgacggcugguacggguaucaucaccagaaugaacaaggaagcggcuacgcugccgaucucaaauccacacagaacgcuauugacaagaucaccaauaaagugaacucuguuauagagaagaugaauacgcaguuuaccgccguggguaaggaguucaaccaccuggaaaaacggauugagaauuuaaacaagaaagucgaugacggguuccuggauaucuggacauacaaugcagaacuccuugugcuguuggagaacgaacgcacucuagacuaucaugauagcaauguaaagaaccuguacgagaaaguucgaucacagcucaagaacaaugccaaggagaucggcaacggauguuuugaguucuaucacaaaugcgacaauaccuguauggaaagugugaagaacggcacauacgauuauccuaaauacuccgaagaggcuaagcugaauagagaagagauugacggggucaaacuugagagcacuaggaucuaucaaauucuggcgauauacucuaccguggcaucaaguuugguccucgugguuagccugggagccaucuccuuuuggaugugcucuaacgguucguuacagugccggauuuguaucuga

SEQ ID NO: 135818 - RNA, 1701 nt, Artificial Sequence
  derived and/or modified sequence opt3 from hemagglutinin__InfluenzaA__BAJ40062
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacacuuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagaaaauugaaaauuuaaacaagaaagucgaugacggguuccuggauaucuggaccuacaaugcugagcuccuugugcuguuggaaaacgagcggacacuagacuaucaugauagcaauguaaagaaccuguacgagaaaguucgcucacagcucaagaacaaugccaaggaaaucggcaacggauguuuugaguucuaucacaaaugcgacaauacuuguauggaaagugugaagaacggcaccuacgauuauccuaaauacuccgaggaagcaaagcugaaucgagaggagauugacggggucaaacuugaaagcacaagaaucuaucaaauucuggccauauacucuaccguggcuucaaguuugguccucgugguuagccugggagcgaucuccuuuuggaugugcucuaacgguucguuacagugcaagauuuguaucuga

SEQ ID NO: 135819 - RNA, 1701 nt, Artificial Sequence; identical to SEQ ID NO: 135817
  derived and/or modified sequence opt3 from hemagglutinin__InfluenzaA__BAJ40063

SEQ ID NO: 135820 - RNA, 1701 nt, Artificial Sequence; identical to SEQ ID NO: 131288
  derived and/or modified sequence opt3 from hemagglutinin__InfluenzaA__BAJ40064

SEQ ID NO: 135821 - RNA, 1707 nt, Artificial Sequence
  derived and/or modified sequence opt3 from hemagglutinin__InfluenzaA__BAK23398
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucagagauugcucaguggccgguuggcugcuuggcaacccuaugugugacgaguuccugaauguuccagaauggaguuauaucguggagaagauaaacccggucaaugauuugugcuaccccgggaacuuuaaugacuaugaggaacucaagcaucugcugagcaggaucaaccacuucgagaaaauucagaucuuuccuaaguccucuuggucggaucaugaagcgucaagcggagugaguuccgcuuguccauaccagggccggucuagcuucuuucgcaauguaguuuggcucgugaaaaaggacaacgccuaucccacaauuaaaaaguccuacaauaacacuaaucaagaggauuuacugauccuuugggguauacaccacccuaacgacgcagccgagcagacccgauuguaucagaacccaacaaccuacauuucagucgggacaaguacucugaaucagcgucuagugcccaagaucgcuaccagaagcaaagugaacggacaaucuggcaggauugaguucuuuuggacgauccucaaguccaaugaugucaucaacuucgaaucaaauggcaacuuuauugcaccugaaaaugccuacaaaauaguuaagaaaggggacagcacuaucaugaagagugagcuggaauauggaaacugcaauaccaaaugucagacaccaauuggugcuaucaacucuuccaugccguuccauaauauacacccccuuacuauuggcgagugcccuaaguacgugaaaagcaaccggcugguauuggccaccgggcuccgcaauucgccaagaggagagaggcggcgcaaaaagcgaggccuguuuggugcgaucgcaggguucaucgaaggaggcuggcagggcaugguggacgggugguauggauaccaucacucuaacgagcaggguuccggcuaugccgcugauaaagaaucaacacaaaaggccauugacggggucaccaauaaagugaacaguaucauugauaagaugaacacgcaguuugaggcaguuggaagagaguucaauaacuuagaaaggcggauagagaaucugaacaagaaaauggaagacggcuuccucgauguguggacuuacaaugcugagcuucuggucuugauggaaaacgagcguacacuagacuuucacgauagcaaugugaagaaccuguaugacaaaguacgccuccagcugagagauaaugccaaggaacuugguaacggguguuucgaguuuuaccauaggugcgacaaugaguguauggaauccguuaaaaacggcaccuacgauuauccccaauacucugaggaagcgcggcugaagcgagaggagaucagcggagugaaguuggaaucaauuggcacuuaucagauccucaguaucuacuccacagucgccagcucucuggcauuagcuauuaugauggccgggcuguuccuauggaugugcucaaauggaagucuccagugccgcauauguaucuga

SEQ ID NO: 135822 - RNA, 1707 nt, Artificial Sequence
  derived and/or modified sequence opt3 from hemagglutinin__InfluenzaA__BAK23400
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucugaacggagucaaaccccuaauucucagagacugcucaguggccgguuggcugcuuggcaauccuaugugugaugaguuccugaacguuccagaauggaguuauaucguggagaagauaaauccggcgaacgacuugugcuaccccggggauuuuaaugacuaugaggaacucaagcaucugcugagcaggaucaaccacuucgagaaaauucagaucauuccuaaguccucuuggucggaucaugaagcuaguagcggagucaguuccgccuguccauaccagggccggucuagcuuuuuccgcaaugugguauggcucaucaaaaaggacaacgcauaucccacaauaaaacgauccuacaauaacacuaaucaagaggauuuacugguucuuugggguauucaccacccuaacgacgccgcugagcagacccguuuguaucauaacccaacaaccuacaucucaguggggacuucaacacugaaucagaggcuaguccccaagauugcaaccagaagcaaggugaacggacagucuggccggauggaauuuuucuggacgauccucaaaccuaaugaugccaucaacuuugaguccaauggcaacuucauugcuccagaaaaugccuacaagauagugaaaaagggggacucaacuaucaugaaaagcgagcuggaauauggaaacugcaauaccaagugucaaacaccgauuggugcgaucaacaguucuaugcccuuucacaauauacauccucuuacuauuggcgagugcccaaaauacgucaaguccagccgccugguuuuggcaaccgggcucagaaacucgccccagggaaagucuaggcggaaaaagcgcggccuguucggugccaucgcuggguuuaucgagggaggcuggcagggcaugguggacgggugguauggauaccaccacuccaaugaacaggguucaggcuaugccgcagauaaagagaguacacaacgagcuauugacgggguaaccaacaaggugaauagcaucauugauaaaaugaacacgcaguucgaagccgucggaagagaguuuaacaauuuagaaaggcggauagagaaccugaauaagaagauggaggacggcuuccucgauguguggacuuacaacgcggaacuucugguuuugauggagaaugaacguacacuagacuuccaugauuccaacgugaaaaaucuguaugacaagguccgccuccagcugagagauaacgccaaagagcuugguaauggguguuuugaguucuaccacaggugcgacaacgaauguauggagucugugcggaauggcaccuacgauuauccucaauacagcgaagaggcacgacugaagcgcgaagagaucucaggaguaaaauuggagaguauuggcaucuaucagauccucuccauuuacagcacuguugcuucuucacuggccuuagcuauaaugguggccgggcuguuucuauggaugugcaguaacggaagccuccagugcagaaucuguauuuga

SEQ ID NO: 135823 - RNA, 1707 nt, Artificial Sequence
  derived and/or modified sequence opt3 from hemagglutinin__InfluenzaA__BAK23401
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggagaaaacccacaaugggaaguuaugugaucuggacggagucaaaccccuaauucucagagauugcucaguggccgguuggcugcuuggcaacccuaugugugacgaguuccugaauguuagugaauggagcuauaucguggagaagauaaacccagcgaaugauuugugcuacccggggaacuuuaauaacuaugaggaacucaagcaucugcuguccaggaucaaucgguucgagaaaauucagaucauucccaagucuucguggccugaccacgaggcuucacucggagucagcagugccuguccauaccagggcggucccuccuuuuaucgcaacgugguaugguuaaucaaaaagaauaacacauacccuauaauuaaaaagucuuaucauaauacuaaccaagaagaucugcuuguuuugugggggauccaccacccaaacgacgaggaagaacagacccgaauuuacaagaaucccacaaccuacaucagcgugggaacuuccacacugaaccagcgucuagucccuaaaaucgcaaccagaucaaaggugaauggccagaguggcaggguggaguucuuuuggacgauucucaaaagcaacgauacuauaaauuucgaaucuaacgggaauuuuaucgccccagaaaacgcuuauaagauugucaaaaagggagacuccaccaucaugaaaucagagcuggaguacgguaauugcaacacaaagugucaaacuccgauaggcgcaauuaauagcaguaugcccuuccauaacauccacccucuuaccaucggggaaugcccaaaguauguuaaaucuaaucggcugguguuggccacaggacuccgcaacagcccccagggcgagagaaggcggaagaaacgcggucuguuuggggcuauugccggauucaucgaaggcggcuggcaggggaugguagauggaugguacgguuaucaucacuccaaugagcagggcucgggguacgcggcagacaaggaaucuacccaaaaagccauugacggagugacgaacaaggucaacuccauaaucgauaagaugaauauucaguuugaggcugugggccgagaguucaacaauuuagaaagaaggaucgagaaccugaauaaaaagauggaagacgguuuucucgauguuuggacuuauaacgccgagcuucugguguugauggaaaaugagcggacacuagacuuccacgauucaaacgucaaaaaucuguacgacaaggugcgucuccagcugcgcgauaacgcaaaagagcuugggaauggcuguuucgaauuuuaccauagaugcgacaacgaguguauggaaaguguaaggaauggaaccuaugauuacccucaauauagcgaggaggcucggcugaagcgagaagagaucuccggcguuaaguuggaaucuauugggacuuaccagauacucagcaucuauucaacaguggccaguucccuggcguuagccauuauggucgcaggacuguuccuauggaugugcagcaacgguucucuccagugccgcaucuguauuuga

SEQ ID NO: 135824 - RNA, 1707 nt, Artificial Sequence
  derived and/or modified sequence opt3 from hemagglutinin__InfluenzaA__BAK23402
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguuccugaauguuccagaauggaguuauaucguggagaagauaaacccggcgaaugauuugugcuaccccgggaacuuuaaugacuaugaggaacucaagcaucugcugagcaggaucaaccacuucgagaaaauucagaucauuccuaaguccucuuggucgaaucaugaagcuaguagcggagucaguuccgccuguccauaccagggccggucuagcuuuuuccgcaacgugguauggcucaucaaaaaggauaaugcauaucccacaauaaaaauuuccuacaacaauacuaaccaagaggacuuacugguucuuugggguauccaccacccuaacgaugccgcugagcagacccgauuguaucagaauccaacaaccuacauuucaguggggacuucaacacugaaccagcgucuaguccccaagaucgcaaccagaagcaaggugaauggacaaucuggcaggauggaauuuuucuggacgauccucaaauccaacgacgccauuaauuuugagucaaacggcaauuucauagcuccugaaaacgccuacaagaucgugaaaaagggggauagcacuauuaugaaaagugagcuggaauauggaaauugcaacaccaagugucagacaccaaucggugcgauaaauucuuccaugccguuucauaacacucacccccuuaccauuggcgagugcccuaaauacgucaagagcaaucggcugguuuuggcaacagggcuccgcaacucgccacauggagagagaaggcggaagaaacgcggccuguucggugccaucgcuggguuuaucgaaggaggcuggcagggcaugguggacgggugguauggauaccaccacucuaaugagcaggguuccggcuaugccgcagacaaggaaucaacccaaaaagcuauugaugggguaacgaacaaggugaacaguaucauugacaaaaugaauacucaguucgaggccgucggacgagaauuuaacaauuuagagagaaggauagagaaccugaauaagaagauggaagauggcuuccucgacguguggacauacaacgcggagcuucugguuuugauggaaaaugagcggacccuagauuuccaugacagcaacgugaaaaaucuguaugauaagguccgucuccagcugcgcgacaacgccaaagaacuugguaauggguguuuugaguucuaccacagaugcgauaacgaguguauggaauccgugaggaauggcacuuacgacuauccccaauacucugaggaagcacggcugaagcgagaggagaucagcggaguaaaauuggaaucaauuggcacauaucagauccucaguaucuacuccaccguugcuagcucucuggccuuagcuauuaugguggccgggcuguuucuauggaugugcucaaacggaagucuccagugccgcauauguaucuga

SEQ ID NO: 135825 - RNA, 1707 nt, Artificial Sequence
  derived and/or modified sequence opt3 from hemagglutinin__InfluenzaA__BAK23403
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguuccugaauguuccagaauggaguuauaucguggagaagauaaacccggcgaaugauuugugcuaccccgggaacuuuaaugacuaugaggaacucaagcaucugcugagcaggaucaaccacuucgagaaaauucagaucauuccuaaguccucuuggucgaaucaugaagcuaguagcggagucaguuccgccuguccauaccagggccggucuagcuuuuuccgcaacgugguauggcucaucaaaaaggauaaugcauaucccacaauaaaaauuuccuacaacaauacuaaccaagaggacuuacugguucuuugggguauccaccacccuaacgaugccgcugagcagacccgauuguaucagaauccaacaaccuacauuucaguggggacuucaacacugaaccagcgucuaguccccaagaucgcaaccagaagcaaggugaauggacaaucuggcaggauggaauuuuucuggacgauccucaaauccaacgacgccauuaauuuugagucaaacggcaauuucauagcuccugaaaacgccuacaagaucgugaaaaagggggauagcacuauuaugaaaagugagcuggaauauggaaauugcaacaccaagugucagacaccaaucggugcgauaaauucuuccaugccguuucauaacauucacccccuuacuaucggcgagugcccuaaauacgucaagagcaaucggcugguuuuggcaaccgggcuccgcaacucgccacagggagagagaaggcggaagaaacgcggccuguucggugccaucgcuggguuuauugaaggaggcuggcagggcaugguggacgggugguauggauaccaucacucuaaugagcaagguuccggcuaugccgcagacaaggaaucaacacagaaagcuaucgaugggguaaccaacaaggugaacaguauuauagacaaaaugaauacgcaguucgaggccgucggacgagaauuuaacaauuuagagagaaggaucgagaaccugaauaagaagauggaagauggcuuccucgacguguggacuuacaacgcggagcuucugguuuugauggaaaaugagcggacacuagauuuccacgacagcaacgugaaaaaucuguaugauaagguccgucuccaacugcgcgacaacgccaaagaacuugguaauggguguuuugaguucuaccauagaugcgauaacgaguguauggaauccgugaggaauggcaccuacgacuauccccaguacucugaggaagcacggcugaagcgagaggagauuagcggaguaaaauuggaaucaaucggcacuuaucagauccucaguauuuacuccacaguugcuagcucucuggccuuagcuauaaugguggccgggcuguuucuauggaugugcucaaacggaagucuccagugccgcaucuguauuuga

SEQ ID NO: 135826 - RNA, 1707 nt, Artificial Sequence
  derived and/or modified sequence opt3 from hemagglutinin__InfluenzaA__BAK23404
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguuccugaauguuccagaauggaguuauaucguggagaagauaaacccggcgaaugauuugugcuaccccgggaacuuuaaugacuaugaggaacucaagcaucugcugagcaggaucaaccacuucgagaaaauucagaucauuccuaaguccucuuggucggaucaugaagcuaguagcggagucaguuccgccuguccauaccagggccggucuagcuuuuuccgcaaugugguauggcucaucaaaaaggacaacgcauaucccacaauaaaacgauccuacaauaacacuaaucaagaggauuuacugguucuuugggguauucaccacccuaacgacgccgcugagcagacccguuuguaucagaacccaacaaccuacaucucaguggggacuucaacacugaaucagaggcuaguccccaagauugcaaccagaagcaaggugaacggacaaucuggccggauggaauuuuucuggacgauccucaaauccaaugaugccaucaacuuugagucaaauggcaacuucauugcuccugaaaaugccuacaagauagugaaaaagggggacagcacuaucaugaaaagugagcuggaauauggaaacugcaauaccaagugucagacaccaauuggugcgaucaacucuuccaugccguuucauaauauacacccccuuacuauuggcgagugcccuaaauacgucaagagcaaccgccugguuuuggcaaccgggcucagaaauucgccacagggagagaggcggcgcaagaaacgaggccuguucggugccaucgcuggguuuaucgaaggaggcuggcagggcaugguggacgggugguauggauaccaucacucuaacgagcaagguuccggcuaugccgcagauaaggaaucaacacagaaagcuauugacgggguaaccaauaaggugaacaguaucauugauaaaaugaacacgcaguucgaggccgucggaagagaauuuaauaacuuagagaggcggauagagaaucugaacaagaagauggaagacggcuuccucgauguguggacuuacaaugcggagcuucugguuuugauggaaaacgagcguacacuagacuuccacgauagcaaugugaaaaaccuguaugacaagguccgccuccaacugagagauaaugccaaagaacuugguaacggguguuuugaguucuaccauaggugcgacaaugaguguauggaauccgugcggaacggcaccuacgauuauccccaguacucugaggaagcacgacugaagcgcgaggagaucagcggaguaaaauuggaaucaauuggcacuuaucagauccucaguaucuacuccacaguugcuagcucucuggccuuagcuauuaugguggccgggcuguuucuauggaugugcucaaauggaagucuccagugcagaauauguaucuga

SEQ ID NO: 135827 - RNA, 1707 nt, Artificial Sequence; identical to SEQ ID NO: 135826
  derived and/or modified sequence opt3 from hemagglutinin__InfluenzaA__BAK23405

SEQ ID NO: 135828 - RNA, 1707 nt, Artificial Sequence
  derived and/or modified sequence opt3 from hemagglutinin__InfluenzaA__BAK23406
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucagagauugcucaguggccgguuggcugcuuggcaacccuaugugugacgaguuccugaauguuccagaauggaguuauaucguggagaagauaaacccggucaaugauuugugcuaccccgggaacuuuaaugacuaugaggaacucaagcaucugcugagcaggaucaaccacuucgagaaaauucagaucuuuccuaaguccucuuggucggaucaugaagcgucaagcggagugaguuccgcuuguccauaccagggccggucuagcuucuuucgcaauguaguuuggcucgugaaaaaggacaacgccuaucccacaauuaaaaaguccuacaauaacacuaaucaagaggauuuacugauccuuugggguauacaccacccuaacgacgcagccgagcagacccgauuguaucagaacccaacaaccuacauuucagucgggacaaguacucugaaucagcgucuagugcccaagaucgcuaccagaagcaaagugaacggacaaucuggcaggauugaguucuuuuggacgauccucaaguccaaugaugucaucaacuucgaaucaaauggcaacuuuauugcaccugaaaaugccuacaaaauaguuaagaaaggggacagcacuaucaugaagagugagcuggaauauggaaacugcaauaccaaaugucagacaccaauuggugcuaucaacucuuccaugccguuccauaauauacacccccuuacuauuggcgagugcccuaaguacgugaaaagcaaccggcugguauuggccaccgggcuccgcaauucgccacagggagagagaaggcggaaaaagcgcggccuguuuggugcgaucgcaggguucaucgaaggaggcuggcagggcaugguggacgggugguauggauaccaucacucuaacgagcaagguuccggcuaugccgcugauaaagaaucaacacagaaggccauugacggggucaccaauaaagugaacaguaucauugauaagaugaacacgcaguuugaggcaguuggacgagaguucaauaacuuagaaagaaggauagagaaucugaacaagaaaauggaagacggcuuccucgauguguggacuuacaaugcugagcuucuggucuugauggaaaacgagcggacacuagacuuucacgauagcaaugugaagaaccuguaugacaaaguacgucuccaacugcgcgauaaugccaaggaacuugguaacggguguuucgaguuuuaccauagaugcgacaaugaguguauggaauccguuaaaaacggcaccuacgauuauccccaguacucugaggaagcgaggcugaagcgggaggagaucagcggagugaaguuggaaucaauuggcacuuaucagauccucaguaucuacuccacagucgccagcucucuggcauuagcuauuaugauggccgggcuguuccuauggaugugcucaaauggaagucuccagugccgaauauguaucuga

SEQ ID NO: 135829 - RNA, 1707 nt, Artificial Sequence
  derived and/or modified sequence opt3 from hemagglutinin__InfluenzaA__BAK23407
auggagaagaucgugcugcuccuugccauugucagccugguuaaauccggccagauaugcaucggguaccacgcuaacaauucuaccgaacaaguggacacaauuauggagaagaacguaacugugacgcaugcacaggauaucuuggaaaagacccacaauggaaaauuaugugaccuggauggugucaaaccccuaauucucagagacugcucaguggccggcuggcugcuugggaacccuaugugugaugaguuccugaauguuagugaauggagcuauaucguggagaagauaaacccagcgaaugacuugugcuacccgggaaacuuuaauaacuaugaggaacucaagcaucugcuguccaggaucaaucgguucgagaaaauucagaucauucccaagucuucguggccugaucacgaggcuucacucggcgucagcgccgcauguccauaccagggugggcccaguuuuuaucgcaacgugguaugguuaaucaaaaagaauaacacauacccuacuauagaaaaauccuaucauaauaccaaccaagaggaccugcuuguuuuguggggcauucaccacccaaacgaugaagccgagcagacacgaaucuacaagaaucccaccacuuacauuucugugggaacaagcacccugaaccagcgucuagucccuaagaucgcuacgagauccaaagugaauggccagucagggaggguggaguucuuuuggacuauccucaagaguaacgacaccauuaauuucgaaagcaacggaaauuuuauagcaccagaaaacgccuauaaaaucgucaagaaaggugauucuacaauuaugaaguccgagcuggaguacggcaauugcaacacucggugucaaaccccgaucggggcuauaaauucaagcaugcccuuccauaacauucacccucuuacaaucggagaaugcccaaaauauguuaagaguaaucgccugguguuggccaccggccucagaaacucuccccagggugagaggcggcgcaagaaacgagggcuguuuggagcgaucgcaggcuucauugaaggcggguggcagggaaugguagacgguugguacggcuaucaucacuccaaugagcaggggagcggauacgccgcugauaaggaaucgacgcaaaaagccaucgacggcgugacuaacaaggucaacucuauuauagacaaaaugaauacacaguuugaggcaguggguagagaguucaacaauuuagaaaggcggaucgagaaccugaauaagaagauggaagauggguuucucgacguuuggaccuauaacgcugagcuucugguguugauggaaaaugagcguacucuagauuuccacgacuccaacgucaaaaaucuguacgauaaggugcgccuccagcugagagacaacgccaaagagcuuggcaauggauguuucgaauuuuaccauaggugcgauaacgaguguauggaaucaguacggaauggcacauaugacuacccucaauauagugaggaggcgcgacugaagcgcgaagagauuagcgggguuaaauuggaauccaucggaaccuaccagauccucucuauuuauagcacgguggccucaagucuggcauuagcuauaauggucgccggucuguuccuauggaugugcuccaacggcagccuccagugcagaaucuguauuuga

SEQ ID NO: 135830 - RNA, 1707 nt, Artificial Sequence
  derived and/or modified sequence opt3 from hemagglutinin__InfluenzaA__BAK23408
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggagaaaacccacaaugggaaguuaugugaucuggacggagucaaaccccuaauucucagagauugcucaguggccgguuggcugcuuggcaacccuaugugugacgaguucccaaauguuagugaauggagcuauaucguggagaagauaaacccggcgaaugaucugugcuaccccgggaacuuuaauaacuaugaggaauugaagcaucuccuguccaggaucaaucgguucgagaaaauucagaucauuccuaagucuucguggccagaccacgaggcuucacugggagucagcagugccugucaguaccaaggcggucccuccuuuuaucgcaacgugguauggcucaucaaaaaggauaaugcauacccuacaauuaaaaagucuuaucauaacacuaauaaggaagacuuacugguucuuugggggauacaccacccaaacaacgaggaagaacagaccaaauuguaccagaaucccacaaccuacaucagcgugggaacuuccacacugaaccagcgucuagucccuaagauugccacccgaucaaaagugaauggccaaaguggcagaguggaguucuuuuggacgauccucaagagcaacgaugcuaucaauuucgaaucuaacgggaauuuuauugcaccagaaaacgccuauaaaauagucaagaaaggagacuccacuaucaugaagucagagcuggaguacgguaauuauaacaccaagugccagacaccgauuggcgcuaucaauagcaguaugcccuuccauaacauacacccucuuacuauuggggaauguccaaaauacguuaagucuaauaggcugguguuggccaccggacuccggaacagcccccagggcgagcgcagaaggaaaaagcggggucuguuuggggcgaucgcaggauucaucgaaggcggcuggcaggggaugguagauggaugguaugguuaccaucacuccaaugagcaaggcucgggguaugccgcugacaaagaaucuacacagaaggccauugacggagugaccaacaaggucaacuccaucauugauaaaaugaauacgcaguuugaggcagugggcaaggaguucaacaauuuagaacgccgaauagagaaccugaauaaaaagauggaagacgguuuucucgauguuuggacuuacaacgcugagcuucugguguugauggaaaaugagagaacacuagacuuccacgauucaaacgucaaaaaucuguacgacaaggugaggcuccaacugcgggauaacgccaaggagcuugggaauggcugcuucgaauuuuaucaucguugugacaacgagugcauggaaaguguacgcaauggaaccuacgauuauccucaguacagcgaggaggcgagacugaaaagggaagagaucuccggcguuaaguuggaaucuauugggacuuaucagauccucagcaucuacucaacaguggccaguucccuggcauuagcuauuauggucgccggacuguuccuauggauguguagcaacgguucucuccagugccggauaugcaucuga

SEQ ID NO: 135831 - RNA, 1707 nt, Artificial Sequence
  derived and/or modified sequence opt3 from hemagglutinin__InfluenzaA__BAK23411
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucagagauugcucaguggccgguuggcugcuuggcaacccuaugugugacgaguuccugaauguuagugaauggagcuauaucguggagaagauaaacccagcgaaugauuugugcuacccggggaacuuuaauaacuaugaggaacucaagcaucugcuguccaggaucaaucgguucgagaaaauucagaucauucccaagucuucguggccugaccacgaggcuucacucggagucagcagugccugucaguaccaaggcgguccauccuuuuaucgcaacgugguaugguuaaucaaaaaggauaaugcauaccccacaauuaaaaagucuuaucauaacacuaauaaggaggaccugcuuguuuugugggggauacaccacccuaacaacgaggaagaacagaccaaacuguaccagaauccaacaaccuacaucagcgugggaacuuccacacuaaaccagcgacucguccccaagauugccacccguucaaaagugaauggccaaaguggcagaguggaguucuuuuggacgauccugaaaagcaacgaugcuaucaauuucgaaucuaacgggaauuuuauugcaccugaaaacgccuauaaaauagucaagaaaggagacuccacuaucaugaagucagagcuugaguacgguaauugcaacaccaagugucagacaccaauuggcgcuaucaauagcaguaugccguuccauaacauacacccccugacuauuggggaaugcccuaaauauguuaagucuaauagguuggugcucgccaccggacugcggaacuccccacagggcgagcgcagaaggaaaaagcgggguuuauuuggggcgaucgcaggauucaucgaaggcggcuggcaggggaugguagauggaugguacgguuaucaucacagcaaugagcaaggcucgggguacgccgcugacaaagaaucuacacagaaggccauugacggagugaccaacaaggucaacuccaucauugauaaaaugaauacgcaguuugaggcagugggcaaggaguucaacaaucuggaacgccgaauagagaaccucaauaaaaagauggaagacgguuuucuugauguuuggacuuauaacgcugagcuguuggugcuaauggaaaaugagagaacacuggacuuccacgauucaaacgucaaaaaucucuacgacaaggugaggcugcaacuucgggauaacgccaaggagcuggggaauggcuguuucgaauuuuaccaucguugcgacaacgaguguauggaaaguguacgcaauggaaccuaugauuacccccaguauagcgaggaggcgagauugaaaagggaagagaucuccggcguuaagcucgaaucuauugggacuuaccagauccugagcaucuauucaacaguggccaguuccuuagcacuggcuauuauggucgccggacuauuccucuggaugugcagcaacgguucucugcagugccggauauguaucuga

SEQ ID NO: 135832 - RNA, 1707 nt, Artificial Sequence
  derived and/or modified sequence opt3 from hemagglutinin__InfluenzaA__BAK23412
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggagaaaacccacaaggggaaauuaugugaucuggacggagucaagccccuaauucucagagauugcucaguggccgguuggcugcuuggcaauccuaugugugacgaguuccugaacguuagugaauggagcuauaucguggagaagauaaauccagcgaacgauuugugcuacccggggaauuuuaacaauuaugaggaacucaaacaucugcuguccaggaucaaccgguucgagaagauucagaucauucccaaaucuucguggccugaccacgaggcuucacucggagucagcagugccugucaguaccaaggcgguccauccuuuuaucgcaaugugguaugguuaaucaagaaagauaacacauaccccacuauaaagaagucuuaucauaauaccaacaaagaagaccugcuuguuuugugggggauucaccacccuaauaacgaggaagaacagacaaagcuguaccagaacccaaccacuuacaucagcgugggaacauccacccuaaaucagcgacucguccccaaaauugcaacgcguucaaaggugaacggccaaaguggcagaguggaguucuuuuggacuauccugaaaagcaaugaugccaucaacuucgaaucuaaugggaacuuuauugcuccugaaaaugcauauaagauagucaaaaagggagacuccaccaucaugaagucagagcuugaguacgguaacugcaauacaaaaugucagacuccaauuggcgccaucaacagcaguaugccguuccauaauauacacccccugaccauuggggaaugcccuaaguauguuaaaucuaacagguuggugcucgcuacaggacugcgcaauuccccacagggcgagcggagaaggaagaaacgggguuuauuuggggccaucgcgggauucaucgaaggcggcuggcaggggaugguagauggaugguacgguuaucaucacagcaacgagcaaggcucgggguacgcagccgacaaggaaucuacccagaaggcuauugacggagugacgaauaaagucaacuccaucauugauaagaugaacacucaguuugaggccgugggcaaagaguucaauaaccuggaacgccgaauagagaaucucaacaagaaaauggaagacgguuuucuugauguuuggacauauaaugcagagcuguuggugcuaauggaaaacgagagaacccuggacuuccacgauucaaaugucaagaaccucuacgacaaggugaggcugcaacuucgggauaaugcuaaagagcuggggaacggcuguuucgaauuuuaccaucguugcgacaaugaguguauggaaaguguacgcaacggaacuuaugauuacccccaguauagcgaggaggccagauugaagagggaagagaucuccggcguuaaacucgaaucuacagggaccuaccagauucugagcaucuauucaacgguggcgaguuccuuagcccuggcaaucauggucgcuggacuauuccucuggaugugcagcaaugguucucugcagugccggauuuguauauga

SEQ ID NO: 135833 - RNA, 1707 nt, Artificial Sequence
  derived and/or modified sequence opt3 from hemagglutinin__InfluenzaA__BAK23413
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucagagauugcucaguggccgguuggcugcuuggcaacccuaugugugacgaguuccugaauguuagugaauggagcuauaucguggagaagauaaacccagcgaaugauuugugcuacccggggaacuuuaauaacuaugaggaacucaagcaucugcuguccaggaucaaucgguucgagaaaauucagaucauucccaagucuucguggccugaccacgaggcuucacucggagucagcagugccugucaguaccaaggcgguccauccuuuuaucgcaacgugguaugguuaaucaaaaaggauaauacauaccccacuauuaaaaagucuuaucauaacaccaauaaggaggaccugcuuguuuugugggggauacaccacccuaacaacgaggaagaacagacaaaacuguaccagaauccaaccacuuacaucagcgugggaacauccacccuaaaccagcgacucguccccaagauugcaacgcguucaaaagugaauggccaaaguggcagaguggaguucuuuuggacuauccugaaaagcaacgaugccaucaauuucgaaucuaacgggaauuuuauugcuccugaaaacgcauauaaaauagucaagaaaggagacuccaccaucaugaagucagagcuugaguacgguaauugcaacacaaagugucagacuccaauuggcgccaucaauagcaguaugccguuccauaacauacacccccugaccauuggggaaugcccuaaauauguuaagucuaauagguuggugcucgcuacaggacugcggaacuccccacagggcgagcgcagaaggaaaaagcgggguuuauuuggggccaucgcgggauucaucgaaggcggcuggcaggggaugguagauggaugguacgguuaucaucacagcaaugagcaaggcucgggguacgcagccgacaaagaaucuacccagaaggcuauugacggagugacgaacaaggucaacuccaucauugauaaaaugaauacucaguuugaggccgugggcaaggaguucaacaaucuggaacgccgaauagagaaccucaauaaaaagauggaagacgguuuucuugauguuuggacauauaacgcagagcuguuggugcuaauggaaaaugagagaacccuggacuuccacgauucaaacgucaaaaaucucuacgacaaggugaggcugcaacuucgggauaacgcuaaggagcuggggaauggcuguuucgaauuuuaccaucguugcgacaacgaguguauggaaaguguacgcaauggaacuuaugauuacccccaguauagcgaggaggccagauugaaaagggaagagaucuccggcguuaagcucgaaucuauugggacauaccagauccugagcaucuauucaaccguggcgaguuccuuagcccuggcaauuauggucgcuggacuauuccucuggaugugcagcaacgguucucugcagugccggauauguaucuga

SEQ ID NO: 135834 - RNA, 1707 nt, Artificial Sequence; identical to SEQ ID NO: 135831
  derived and/or modified sequence opt3 from hemagglutinin__InfluenzaA__BAK23414

SEQ ID NO: 135835 - RNA, 1698 nt, Artificial Sequence
  derived and/or modified sequence opt3 from hemagglutinin__InfluenzaA__BAM65746
auggaggugaagcugcucguccuucugugcaccuucacagccacuuacgcugacacgaucuguauuggcuaucacgcaaacaauagcaccgauacaguugacacuuugcccgaaaagaacgugaccguaacacauuccgugaauuuacuggaggauacccacaacgggaagcuaugccuccugaaaggaauagccccucuucagcuggguaauuguucugucgcgggcuggaucuuggggaacccagaaugcgagcuccugauuucaagagaaaguuggagcuacaucguggagaagccgaaucccgagaacggaauuuguuauccuggccauuuugcugacuacgaggagcugagggaacaacucuccucuguuucgucauucgagcgguuugagaucuucccaaaagaaagcaguuggcccaaucacacugccacagguguguccgcaucuugcagccauaacgggaaguccucauuuuauaagaauuuacuguggcuuaccgucaaaaacggauuguacccuaaucugaguaagagcuaugccaacaauaaagagaaggaagugcuaguacucuggggcguucaccacccaacgaacauaggcgaucagcgcgcucuguaccauacugagaacgcauacgugucugucguguccucacacuauagccgacguuucacccccgaaaucgccaaaagaccuaaggugagggaccaggaggggcggauuaauuacuauuggacacuucuggagccaggagauacuaucauuuuugaagcuaacgguaauuugaucgccccgcgcuacgcguucgcacucaguagaggcuuugggucuggaauaauuaaguccaacgcccccauggacgaguguaaugcuaaaugccagaccccucaaggcgccaucaacagcucgcugccauuccagaauguccaucccguuacaauuggugaauguccuaaguaugugaggucuaccaaauuacggaugguaacggggcugcgcaacacuccauccauccagucacgaggacucuuuggcgcaaucgcuggcuucauugaagggggauggacagguaugguggauggcugguacggguaucaccaccagaaugaacaaggaaguggcuacgccgcggaccaaaagagcacccagaacgccauaaaugguaucacuaacaaagucaauuccgugauugagaagaugaacacacaguuuaccgcaguugauaaagaguucaauaaacuugaaagaaggauggagaacuucaacaagaaaguggacgauggguuuaucgacauauggacguacaaugcugaacuguugauucuacuggagaacgaacggacccucgacuuccaugauucuaaugucaagaaccuguaugagaaaguaaagagccagcuuaaaaauaacgccaaggagaucggcaauggaugcuuugaguucuaccacaaguguaacgacgaaugcauggaaucagugaaaaauggcacauaugauuaccccaaguauagugaggaguccaaacugaaccgugaaaagaucgacgggguuaaauuggagagcaugggaguguaccagauucucgcuaucuauucuacugucgccucaaguauggugcuguuagucagccugggugcaauuuccuuuuggaugugcucuaauggcucgcuacagugucgcauaugcaucuga

SEQ ID NO: 135836 - RNA, 1701 nt, Artificial Sequence; identical to SEQ ID NO: 134582
  derived and/or modified sequence opt3 from hemagglutinin__InfluenzaA__BAO79716

SEQ ID NO: 135837 - RNA, 1683 nt, Artificial Sequence
  derived and/or modified sequence opt3 from Hemagglutinin__InfluenzaA__CAB95856
auggagaccaucagccugauuacaauacuccuuguggucacugccuccaacgcugacaagaucugcauuggccaccagucuaccaauucaaccgaaacaguugauacucugaccgagacaaacgugcccguaacccaugcaaaagaauuguuacacacugagcauaaugggaugcugugugccacaagucuaggacacccucucauccuggacacgugcacgauugaaggucuuguguacggcaacccaagcugugaucuguugcucgggggaagagagugguccuauaucgucgagaggucuucggcggugaauggcacuugcuacccggguaacguugaaaaucuggaggaacugcggacccucuucucaagcgcuaguuccuaucaacgcauacagaucuuucccgacacaacuuggaacgugaccuacacagggaccucucgagccuguagcggauccuucuaucguucaaugagaugguuaacgcagaagaguggcuuuuacccuguccaggaugcacaauauacuaauaacaggggcaaaagcauucuguucgugugggggauccaucacccacccacauacaccgagcagacuaaucuuuacauucggaacgacacaaccacgucuguaaccacagaggauuugaaucgcacuuuuaagccuguuaucggaccaagaccccuggugaacggucuacagggcaggauagacuauuacugguccguccucaaaccugggcagacccugcgggugcgcucaaauggaaaccuuauugccccaugguauggccacgugcugagcggugggagucauggacgaaucuugaagacagaucucaagggcggcaacugcgucguucaaugucagacugaaaaagggggacugaauaguaccuuaccguuccacaacauuuccaaguacgcuuuugguacaugccccaaauaugugagaguaaauagccugaagcucgcagugggccuuaggaacgucccugcccggucgucucgugggcuguucggagcuaucgccggcuuuaucgaggguggguggccaggcuugguggcgggaugguacggcuuccagcauuccaaugaccaggggguuggaauggcagccgaucgcgacucaacccaaaaagcuauugauaagauaacuucuaaggugaacaauaucgucgacaaaaugaacaagcaguaugaaauuaucgaccacgaguuuagcgaaguggagacgagacuaaauaugauaaacaauaaaauugaugaccagauccaagauguaugggccuacaacgcagagcugcucguucugcuugaaaaucagaagacacuggacgagcacgaugcuaacgugaauaacuuguacaacaaagucaagagggcccucgguuccaaugcgauggaagacggcaaaggguguuucgagcuguaucauaagugcgaugaccaguguauggaaaccauccggaacggaacuuacaaucgacgcaaguauagagaggagucuagguuagaacggcagaaaauugagggcgugaagcuggaaagcgaggguaccuacaaaauccuaacaauuuauucaaccgucgccaguucccucgugcuggcaaugggguuugcugccuuccuuuucugggcuaugagcaacggcucuugccgcugcaauauauguaucuga

SEQ ID NO: 135838 - RNA, 1683 nt, Artificial Sequence
  derived and/or modified sequence opt3 from Hemagglutinin__InfluenzaA__CAB95857
auggagaccaucagccugauuacaauacuccuuguggucacugccuccaacgcugacaagaucugcauuggccaccagucuaccaauucaaccgaaacaguugauacucugaccgagacaaacgugcccguaacccaugcaaaagaauuguuacacacugagcauaaugggaugcugugugccacaagucuaggacacccucucauccuggacacgugcacgauugaaggucuuguguacggcaacccaagcugugaucuguugcucgaggggagagagugguccuauaucgucgaaaggucuucggcggugaauggaacuugcuacccgggcaacguugagaaucuggaggaacugcggacccucuucucaagcgcuaguuccuaucaacgcauacagaucuuucccgacacaacuuggaacgugaccuacacagguaccucucgagccuguagcggguccuucuaucguucaaugagaugguuaacgcagaagaguggauuuuacccuguccaggaugcacaauauacuaauaacaggggcaaaagcauucuguucguguggggcauccaucacccacccacauacaccgagcagacuaaucuuuacauucggaacgacacaaccacgucuguaaccacagaagauuugaaucgcacuuuuaagccuguuaucgggccaagaccccuggugaacggacuacaggguaggauagacuauuacugguccguccucaaaccuggccagacccugcgggugcgcucaaaugggaaccuuauugccccaugguauggacacgugcugagcggcgguagucaugggcgaaucuugaagacagaucucaagucuggaaacugcgucguucaaugucagacugagaaaggcggcuuaaauuccacccugccguuccacaacauuagcaaguacgcuuuugggacaugccccaaauaugugagaguaaauucgcugaagcucgcagugggacuuaggaacgucccugcccggucuucccguggucuguucggcgcuaucgccggguuuaucgaaggaggcuggccagguuugguggcggggugguacggcuuccagcauucaaaugaccagggaguuggcauggcagccgaucgcgacaguacccaaaaagcuauugauaagauaacuagcaaggugaacaauaucgucgacaaaaugaacaagcaguaugagauuaucgaccacgaauuuuccgagguggagacgagacuaaauaugauaaacaauaaaauugaugaccagauccaagauguaugggccuacaacgcagaacugcucguucugcuugagaaucagaagacacuggacgaacacgaugcuaacgugaauaacuuguacaacaaagucaagagggcccucgggucuaaugcgauggaggacggaaaagguuguuucgaacuguaucauaagugcgaugaccaguguauggagaccauccggaacggcacuuacaaucgacgcaaguauagagaggaaagcagguuagagcggcagaaaauugaaggggugaagcuggagucagaaggagccuacaaaauccuaaccauuuauaguacagucgcauccagccucgugcuggcuaugggcuuugccgcuuuccuuuucugggccaugucuaacgguucaugccgcugcaauauauguaucuga

SEQ ID NO: 135839 - RNA, 1707 nt, Artificial Sequence
  derived and/or modified sequence opt3 from hemagglutinin__InfluenzaA__CBW54815
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguucccaaauguuagugaauggagcuauaucguggagaagacaaacccggcgaaugaucugugcuaccccgggaacuuugacaauuaugaggaauugaagcaucuccuguccaggauaaaccgguucgagaaaauccagauuaucccuaagucuucguggccagaucacgaggcuucacugggagucagcagugccugucccuaccagggcgguccuuccuuuuaucgcaaugugguauggcucauuaaaaagaacaauacuuacccaaccaucaaagaaucuuaucauaacacaaaucaagaggacuuacugguucuuugggggauacaccaccccaacgaugaagaggaacagacccgaauuuacaagaacccuacuacauacaucagcgugggaaccuccacguugaaucagcgucuggucccaaagauugcaacuagaucaaaagugaacggccagaguggcaggguggaguucuuuuggaccauccuaaagagcaaugacacaaucaacuucgaaucuaaugggaacuuuauugccccggagaaugcuuauaaaauagucaagaaaggagauuccacuaucaugaagucagagcucgaauacgguaacugcagcaccaaaugucaaacacccauuggcgcaaucaauaguucuaugccuuuccauaacauacacccacugaccauuggggagugccccaaguauguuaaguccaaucggcuugugcuggccacgggauugcgcaacagcccucagggcgaagguagaaggaaaaagcgggggcucuuuggagcuaucgccggcuucaucgagggcggguggcagggaaugguagacgguugguacggcuaucaucacucgaaugaacaggggucuggauacgcggcagacaaagaguccacucaaaaggccauugauggcgugacaaacaaagucaauucaaucauugacaagaugaacacccaguuugaggcugugggucgcgaguucaacaaucuggaaaagcgaauagaaaacuuaaauaaaaagauggaggauggguuucuggacguuuggacuuauaacgccgaacuccuugugcugauggagaaugagagaacauuggauuuccacgacaguaacgucaaaaaucuauacgauaaggugaggcugcagcuccgggacaacgcaaaagaacugggcaauggauguuucgaguuuuaccaucguugcgauaacgaauguauggagagcguacgcaauggcaccuaugacuacccacaauauuccgaggaagcuagacuuaagagggaggaaaucucugggguuaagcuggagagcauuggaacguaccagaucuugucaaucuauaguaccguggccuccagccucgcgcuggccauuauggucgcagguuuauuccuguggaugugcucuaacggcucacuacagugccggauauguaucuga

SEQ ID NO: 135840 - RNA, 1707 nt, Artificial Sequence
  derived and/or modified sequence opt3 from hemagglutinin__InfluenzaA__CBW54817
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguucccaaauguuagugaauggagcuauaucguggagaagauaaacccggcgaaugaucugugcuaccccgggaacuuuaauaacuaugaggaauugaagcaucuccuguccaggaucaaucgguucgagaaaauucagaucauuccuaagucuucguggccagaccacgaggcuucacugggagucagcagugccugucccuaccagcgcggcccuuccuuuuaucgaaacgugguauggcucaucaaaaagaaugauacauacccaacuauaaaagaaucuuaucauaacaccaaucaagaggacuuacugguucuuugggguauucaccaccccaacgaugaagaggaacagaagcguaucuacaagaacccuacaaccuacauuagcguggggacuuccacauugaaucagagacuggucccaaaaaucgcaaccaggucaaaggugaacggacagaguggccggguggaguucuuuuggacgauccuaaaaagcaaugacacuauuaacuucgaaucuaauggcaacuuuauagccccggagaaugcuuauaagaucgucaaaaagggggauuccaccauuaugaaaucagagcucgaauacggaaacugcagcacaaagugucaaacucccaucggugcaauaaauaccaguaugccuuuccauaacauucacccacugacaaucggcgagugccccaaguauguuaaaucuaaucgccuugugcuggccaccggguugagaaacuccccucagggagaaggcaggcggaagaaacgcggucucuuuggggcuaucgccggauucauugagggcggcuggcaggggaugguagacggaugguacgguuaucaucacagcaaugaacagggcucgggguacgcggcagacaaggagucuacgcaaaaagccaucgauggagugacuaacaaggucaauuccauuauagacaagaugaacacacaguuugaggcugugggccgagaauuuaacaaucuggagaaaagaaucgaaaacuuaaauaagaaaauggaggaugguuuccuggacguuuggaccuauaacgccgaacuccuugugcugauggagaaugagaggacuuuggauuuccacgacucaaacguccggaaucuauacgauaaggugcgucugcagcuccgcgacaacgcaaaagaacuggggaauggcuguuucgaguuuuaccauagaugcgauaacgaauguauggagaguguaaggaauggaacauaugacuacccacaauauagcgaggaagcucggcuuaagcgagaggaaauuuccggcguuaagcuggagucuaucgggaccuaccagaucuugagcauuuauucaacgguggccaguucccucgcgcuggccauaauggucgcaggauuauuccuguggaugugcagcaacgguucucuacagugccgcaucuguauuuga

SEQ ID NO: 135841 - RNA, 1707 nt, Artificial Sequence
  derived and/or modified sequence opt3 from hemagglutinin__InfluenzaA__CBW54818
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguucccaaauguuagugaauggagcuauaucguggagaagacaaacccggcgaaugaucugugcuaccccgggaacuuuaauaacuaugaggaauugaagcaucuccuguccaggauaaaucgguucgagaaaaucaagauuaucccuaaaucuucguggccagaccacgaggcuucacugggagucagcagugccugucccuaccagggcgguccuuccuuuuaucgcaacgugguauggcucauuaagaaaaauaacacuuacccaaccaucaaggaaucuuaucauaauacaaaccaggaggauuuacugguucuuugggggauacaccaccccaacgacgaagaggaacaaacccgaauuuacaagaauccuacuacauacaucagcgugggaaccuccacguugaaccagcgucuggucccaaaaauugcaacuagaucaaaggugaauggccagaguggcaggguggaguucuuuuggaccauccuaaaaagcaacgauacaaucaauuucgaaucuaacgggaauuuuauugccccggagaacgcuuauaagauagucaaaaagggagacuccacuaucaugaaaucagagcucgaauacgguaauugcagcaccaagugucagacacccguuggcgcaauuaacaguucuaugccuuuccauaauauccacccacugaccauaggggagugccccaaguaugugaaauccaaccggcuuguacuggccacgggauugcgcaauagcccucaaggcgaagguagaaggaagaaacgggggcucuuuggagcuauugccggcuucaucgagggcggguggcagggaaugguggaugguugguacggcuaucaucacucgaacgaacaggggucuggauacgcggcagaccgcgaguccacucagaaggccaucgacggcgucacaaauaaagugaacucaauuaucgauaagaugaacacccaauuugaggcuguuggucgagaguucaauaaccuggaaaagagaauugaaaauuuaaacaaaaagauggaggacggguuucuggauguguggacuuauaaugccgaacuccuuguccugauggagaacgagaggacauuggacuuccacgauaguaaugugaaaaaccuauacgacaagguacggcugcagcuccgugauaaugcaaaagaacugggcaacggauguuucgaguuuuaccaucgcugcgacaaugaauguauggagagcguuagaaacggcaccuaugauuacccacaguauuccgaggaagcuaggcuuaagcgggaggaaauaucuggggugaagcuggagagcaucggaacguaccaaauuuugucaaucuauaguaccgucgccuccagccucgcgcuggccaucauuguggcagguuuacugcuauggaugugcucuaauggcucacuccagugccgaauauguaucuga

SEQ ID NO: 135842 - RNA, 1701 nt, Artificial Sequence
  derived and/or modified sequence opt3 from hemagglutinin__InfluenzaA__CCG47908
augaagaccgugaucgcccugagcuacgucuucugccucggcuuugggcagggacuucccgguaaaggcaacaauacagcuacucuguguuuggggcaccaugcaguuccuaacggaacguuagugaagaccauuacagacgaucaaauagagguaacuaaugccaccgaacuggugcagaacuucuccaugggcaaaaucugcaagaauccacacaggauucuagacggugcgaacuguacacucaucgauucucugcuuggggacccgcauugcgauggauuucaggacgagaaaugggaucuguucauugaaagaucaaaggcuuuuaguaauuguuaucccuacgacgucccugaguauaccagcuugcgguccaucauagccucuucgggcacucucgaguucacaaacgaagauuuuaauuggaccggcgugacgcagaacgggggaucaagcgcaugcaagcgcgguccaaauaacaguuucuuuucccgacugaauuggcuguacaaaucuggcaacacuuaucccaugcucaauguuaccaugccuaacagcgacgauuucgacaaguuauacaucuggggagugcaccauccauccacagaucgugagcaaacuaaccuguauauucaggccucagggaaaaucauugucaguaccaagagaagccagcagacaaucauacccaauauuggcucuaggccuugggugcggggucuuuccucacgcaucagcauuuacuggaccaucguaaaaccaggggacaucuugauuauaaacaguaauggaaaccugaucgcuccgagaggcuacuuuaagauucaaacgggcaagucuuccguuaugaggagcgacgcacccaucgauacuuguaauucggaaugcauaacaccuaacgggucuauuccaaaugacaaacccuuccagaacgugaaucggaucaccuauggagccuguccuaaguacaucaaacagaacacucuaaagcucgcuacagguaugcgcaauauuccagagcgacagaccagaggcaucuuuggggccauugcgggauucauagaaaacggcugggaggguauggucaaugggugguauggcuucaggcaccaaaacuccgagggaaucggccaggcagccgaucugaaaucaacgcaggcugccauuaaucaaaucaacgggaaacuuaaccgggugaucgaaaagaccaaugagaaguuucaccagauugaaaaggaguucagugaaguggagggacguauacaggaccuggagcgcuacgucgaagauacaaaaaucgacuuguggagcuauaacgcagagcuccugguugcuuuagaaaaucagcauacuauugaucugaccgacuccgagaugaacaagcucuuugagaaaacaagaaagcaacuuagggaaaaugccgaggauauggguaacggcugcuucaaaaucuaccacaagugugacaauucuugcauggaaagcauucggaacgggacuuaugaucauaaugaguaccgagacgaagcggugaacaaucgcuuucagaucaagucaguagagcugaaaaguggauacaaggacuggauauuguggaucuccuucgccauuagcugcuuucuacugugugcaguguggcucggcuucaucauuugggcuugccagaaagguaacaucagauguaauauaugcauuuga

SEQ ID NO: 135843 - RNA, 1701 nt, Artificial Sequence
  derived and/or modified sequence opt3 from hemagglutinin_precursor_(high_yield_phenotype)__InfluenzaA_ _AAB39851
augaaggccauccugcucgugcuucugugcaccuucgcugcaacaaacgccgacacuuuguguauuggcuaccacgcgaauaacagcacggauaccgucgacacaguuuuagagaaaaaugugacuguaacccauuccgugaaccugcuagaagauagacacaaugggaagcucugcaaacugggagguauagcuccccuucaucugggcaaguguaacaucgccgggagguugcucggaaauccugagugcgaacugcugcucacagucucuucauggaguuauauuguggagaccagcaaauccgacaacggcacuuguuacccaggugauuuuaucaauuaugaagaguuacgggagcagcugucuucgguuaguagcuucgaacgcuuugagauuuucccgaagacaaguuccuggcccaaccacgaaaccaaucgaggggugacggcagccugcccuuacgcuggagcaaacucuuuuuaucguaaucuuaucugguuggucaagaaagagaacagcuacccaaagcuguccaaaucauaugugaauaacaagggcaaagagguucuaguacucuggggcauacaucaucccccuacuucaaccgaccaacagagccuguaccagaacgccgaugcuuacguguucgucgggucuuccaaguauaauagaaaguuuaaaccagaaaucgccgcgaggcccaaggugcggggacaggcaggucgcaugucauacuauuggacacuuauugagccuggcgacacuaucaccuucgaagccacagggaaccugguggucccaagauacgcuuuugccaugaauaggggaagcggcagugguauuaucauaugggaugcaccgguucacgacuguaacaccaaaugccaaacgcccaagggggcuauuaauacuucuuugccuuuccagaacauccacccagugacaauuggagagugucccaaauauguaaaguccaccaaacuccggauggccacuggccugcgcaaugugccuagcauccagucgcgaggcuuauuuggggcgaucgccggauucauugaagguggcuggacagggaugauagauggaugguacggcuaucaccaucagaacgagcaagguucuggguacgcagcugaccagagauccacccagaaugccaucgauggcauuacgaacaaggucaauucagugaucgagaagaugaacacccaguuuacagcuguuggaaaagaguucaaucaccuggaaaagaggauagaaaaccucaauaaaaagguggacgacggcuuccuugauauuuggacuuacaacgccgagcuguugguccuacuggaaaacgagcggacccucgacuuucacgauaguaaugugaaaaaccuguaugagaagguacguagccaacuucgcaauaacgcaaaggaaaucgggaauggaugcuucgaguuuuaccauaaaugugacgauacaugcauggaauccguuaagaacgguacuuaugacuacccaaaauauucugaggaaagcaagcugaauagagaggagaucgauggcgugaaauuggaaucaaccaggauuuaccagauccucgccauuuauaguacagucgcuuccagccugguguuacuggucucucuaggggcgauaucauucuggaugugcaguaacggaagccuccagugucggaucugcauuuga

SEQ ID NO: 135844 - RNA, 1701 nt, Artificial Sequence
  derived and/or modified sequence opt3 from hemagglutinin_precursor__InfluenzaA__AAA43178
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcauccaccauccaucaacaaaucaagagcagaccaguuuguacgugcaggcaagcgggcguguaacgguuucuacuagaaggucccagcaaacaauuauccccaacauaggaucacggccuugggugcgcggccugagcaguagaauuucuaucuauuggaccauugucaagccaggugacgugcuagugaucaacuccaaugggaaccucaucgccccgaggggauacuuuaaaaugcggacuggcaagagcucgauuaugcgcucugacgcucccauagauacauguaucuccgagugcauuaccccuaauggcucaaucccaaacgacaaacccuuccagaaugucaacaagauaacguacggggccuguccuaaauauguuaagcagaauacccugaaacuugcgacaggaaugcgaaacgugccagaaaagcagacuagaggucuguuuggcgcaauugccggguucaucgagaauggaugggaaggcaugaucgaugguugguacggguuuaggcaccaaaacagugagggcaccggacaggcugccgaccuuaagagcacacaggcagcuauugaucaaaucaauggcaaacucaaccggguaauugagaagacuaaugaaaaauuccaccagauagagaaggaguucuccgaaguggaagggcguauccaggaccuggagaaauaugucgaggauaccaagauugacuuauggucuuacaacgccgaacugcucguggcgcuugagaaucagcauacaaucgaucugaccgacagcgaaaugaacaaguuguuugagaaaacucgcagacaacuaagggaaaacgccgaggagaugggaaaugguugcuucaagaucuaucacaaaugugauaacgcaugcauugaaucaauacggaauggcacguacgaccaugacguuuaucgagaugaggcucugaacaaucgcuuucagaucaaggggguggaacucaaaaguggauacaaggacuggauucuguggaucuccuucgccauuagcugcuuucuucugugugucguguugcucggcuucaucaugugggcuugccagagagguaacauaagguguaauaucugcauuuga

SEQ ID NO: 135845 - RNA, 1689 nt, Artificial Sequence
  derived and/or modified sequence opt3 from hemagglutinin_precursor__InfluenzaA__AAA43185
auggccaucauuuaccugauacuccuuuucaccgcugugagaggcgaccagaucugcauuggguaucacgcaaacaauagcacagagaaggucgauacuaaccuggaaaggaauguuacggugacccaugccaaagacaucuuggagaagacacacaacggaaaauuauguaagcugaaugguauucccccucuagaacucggcgauugcuccaucgcgggguggcugcuuggaaacccagagugugaccggcuguugucuguaccggaauggucauacauaauggagaaagagaauccccgcgauggccucugcuauccugguaguuuuaacgacuacgaggaacugaagcaucugcucagcuccgugaagcacuucgaaaaagucaagaucuuaccaaaagaucgauggacucaacauaccacaaccgggggaucucgugcuugugccgugucgggcaaucccucauuuuucagaaacaugguuuggcugacuaaggagggcagcgacuauccuguggcaaaagggaguuacaauaacacauccggagagcagaugcuuauuaucugggguguccaccacccaauugaugaaaccgagcagaggacguuguaucagaaugugggcacuuacguaucuguugggaccagcacacugaacaagcgguccacucccgaaaucgccacccgcccuaaggugaauggacaaggcgguagaauggaguuuucauggacacuacucgacaugugggauaccauaaacuucgaaaguacggggaaccugauugcuccagaguacggauuuaaaaucagcaagagggggucuuccggcauuaugaaaacugagggcacacuugaaaauugcgagaccaagugucagacuccgcugggagcaaucaacacaaccuugcccuuccauaauguccacccucucacgaucggugaaugcccaaaauaugugaagucagagaaacugguguuagccaccggccugcggaacgucccccagauugaaagccgcgggcucuuuggagcuauagccggcuucaucgaggguggguggcagggcaugguugacggaugguacggcuaucaucacaguaaugaucaagggucuggauacgcggcagacaaggaguccacacagaaggccuuugacgguauuacuaacaaagugaauagcguaaucgaaaagaugaacacccaguucgaggcugugggcaaagaauuugggaaucuugagcgaagacuggaaaacuugaauaagaggauggaggauggauuccuagacgucuggacauauaacgccgagcugcucgugcugauggaaaaugagcggacucuugauuuccacgacucgaacguuaaaaaucuguacgauaaggugcguaugcaguugcgcgacaacgucaaggaacucggcaacgguuguuuugaguucuaucauaaaugcgaugacgaguguaugaacucugugaagaaugggaccuacgauuacccuaaauaugaagaggaauccaagcugaauagaaacgagauaaaaggcguaaaguuaucaaguaugggaguuuaccaaauucuggcaaucuaugcuacaguggccggcagccuaucccucgcgaucaugauggccgggauuucuuuuuggaugugcagcaauggaucacugcagugcaggaucuguauuuga

SEQ ID NO: 135846 - RNA, 1701 nt, Artificial Sequence
  derived and/or modified sequence opt3 from hemagglutinin_precursor__InfluenzaA__AAA43187
augaagaccaucauugcccugagccacauauucugccucgugcuuggccaguaccugcccgggaacgacaauuccacagcuacuuuguguuuaggacaucacgcagucccuaacgguacgcugguuaaaaccaucacaaaugaucaaauugaggugacuaacgccaccgaauugguacagucuucaaguacaggcaagaucugcaauaacccacauaggauucucgacgggaucgauuguacccugauagacgcgcuucugggagauccgcacugcgacggcuuucagaaugagacuugggauuuguucguggaaagaagcaaggcuuuuuccaacuguuaucccuacgacgucccugauuaugccucucuccggucgcugguggcaucaagcgguacacuggaguucaucaccgaaggguuuacguggacuggaguuacccagaauggcggcaguaacgccugcaagcgcgggccaggauccgguuucuuuucucgacucaauugguuaacaaaaagcgaguccacuuaccccgugcugaacgucaccaugccuaauaacgacaauuucgauaaacuuuauauuuggggcgugcaucacccaucaacaaaccaagagcagaccaguuuguacguacaggcuagcgggcguguuacggugucuacuagaaggucccagcaaacaaucauucccaacaucggaucacggccuuggguccgcggccugagcaguagaauaucuauuuauuggaccaucgugaagccaggugacgugcuagucauuaauuccaacgcaaaucucaucgccccgaggggguacuuuaaaaugcggacuggaaagagcucgaucaugcgcucugaugcucccauugacacauguauauccgaaugcaucaccccuaacggcucaauuccaaaugacaaacccuuccagaacguuaauaagaucacguacggcgccuguccuaaauaugugaagcagaacacccugaaacuugcgacacgaaugagaaauguaccagagaaacagacuagggggcuguuuggagcaauagccgguuucauugaaaacggcugggaggggaugaucgauggaugguacggcuuucggcaccaaaauagugaggguaccgggcaggcugccgaccuaaagagcacacaggcagcuaucgaucaaauuaacggcaaacucaaucgugugaucgaaaagacuaacgagaaauuccaucagauugaaaaggaguucuccgaagucgagggacgcauacaggaccuggagaaauauguggaagauaccaagaucgacuuauggucuuacaaugccgagcugcucguugcgcuugaaaaccagcacacaauugaucugaccgacagcgagaugaacaaguuguuugaaaagacuagaaggcaacuacgggagaaugccgaggauaugggcaacgggugcuucaagaucuaugacaaaugugauaaugcaugcaucgaaucaauucgaaacggaacguacgaccaugacguguaucgcgaugaggcucugaauaacagauuucagauaaagggugucgaacucaaaaguggcuacaaggacuggauccuguggauuuccuucgccaucagcugcuuucuucugugugugguauugcucggguucauuaugugggcuugccagaggggaaauauccgguguaacauaugcaucuga

SEQ ID NO: 135847 - RNA, 1698 nt, Artificial Sequence
  derived and/or modified sequence opt3 from hemagglutinin_precursor__InfluenzaA__AAA43209
augaaggccaaacugcucgugcuucuguacgcuuucgucgcaaccgacgccgauacaaucugcauuggcuaucacgcgaacaauagcacugacacgguugauaccauauuugagaagaacguggcuguaacacauuccgugaauuuguuagaagacagacacaacgggaaacuguguaagcuaaaaggaaucgcaccccuccagcuggguaagugcaauauuacuggcuggcuucuggggaacccugagugugauucuuugcucccagccaggucauggaguuacaucgucgaaaccccgaauagcgagaacggagccugcuaucccggcgacuucauugauuacgaggagcugcgggagcaacuguccucugugucgucacucgaacgcuuugagaucuucccuaaggaaagcaguuggccaaaucauacauuuaacgguguuaccguguccuguucucaccgagggaaaagcuccuucuaucguaauuuacuguggcuuacuaagaaaggagacucauaccccaaguugacaaacaguuaugucaauaacaaaggcaaggaggugcugguacuauggggcguucaucacccuucuagcuccgaugagcagcagucacucuacagcaaugggaacgcuuacgugagugucgcaucuuccaacuauaauagaagguuuaccccagaaauagccgcucggcccaaggugaaagaccagcacggacgcaugaacuacuauuggacgcugcuugagccuggugauacuaucauuuucgaagccaccggcaaucugaucgcgccaugguacgcauuugccuugagcagaggguucgagucgggaauuaucacaucuaacgcuuccaugcaugaaugcaauacuaagugucaaaccccgcagggcucaauaaacaguaaucuccccuuucagaacauucacccugugacaaucggugagugcccaaaauaugucaggagcaccaagcugcggaugguuacgggguuacgcaauauucccuccauccaguaccgaggacuguucggcgccaucgcaggcuuuauugaagggggauggacugguaugauagacggcugguauggguaccaucaccaaaacgaacagggaucuggcuacgcugccgaucagaaaagcacacagaaugcgaucaacgguauuaccaauaaggugaacucaguaaucgagaaaaugaauacucaauucacagccguggggaaggaguucaacaaccucgaaaagagaauggaaaaucuuaacaaaaaggucgacgacggcuuucuggauauauggaccuauaaugcagaguugcuagugcugcucgagaacgaaaggacgcuggacuuccacgaucuuaauguuaaaaaccuguacgagaaggugaaaagucaguugaagaauaacgcuaaggaaauuggaaauggcuguuuugaguucuaucauaaaugcgacaacgaauguauggaguccguccggaaugggaccuacgauuauccuaaguacagcgaggaaucuaaacucaaccgugagaagaucgacggagugaaacuggaaucaauggguguauaucagaucuuagccauuuacaguacaguugcuagcucccuggugcuacucgucucucugggcgccaucucguuuuggaugugcagcaaugggucccuucaaugccgcauuuguauauga

SEQ ID NO: 135848 - RNA, 1683 nt, Artificial Sequence
  derived and/or modified sequence opt3 from hemagglutinin_precursor__InfluenzaA__AAC40998
augaacacccagauccugauucucgcccuuguggcuauaauccccacaaaugcagacaagauuugccugggccaccaugccgucagcaacggggcgaaaguuaauacuuugacggagagaggaguggaaguagugaacgcuaccgagacagucgaaaggacuaaugugccucggaucuguuccaaggguaaacgcaccguugauuuaggccaaugcgggcugcuaggaacaauuaccggcccaccgcagugugaccaguuccucgaguuuucugccgaucugaucauagaacgacgugaggguaacgacgugugcuaccccgggaaguucgucaaugaggaagcacuuagacagauccugaggaaaucaggaggcauugauaaggagacuaugggcuuuacauauagugggauccggaccaacggagccacgagcgcuugucgcagauccgguucuucguucuacgcagaaaugaagugguugcucucaaauacugacaacgccgcuuuuccucaaaugaccaaaagcuauaagaauauuaggaaagauccagcccugaucauauggggcauucaccauaguggguccacagcggagcagacuaagcuguacggaucuggcaacaaacucaucaccguggguagcuccaauuaucagcagucauucguacccaguccuggggcacggccacaaguuaacggacagagcggccgcauugacuuucacugguuaaugcugaaucccaacgauacagugaccuucucuuuuaacggcgccuucaucgcuccugaccgagccuccuuucuuagagggaagucaaugggaauccagagcgagguccagguggaugcaaauugcgaaggugacuguuaccauaguggcgggacgauuuugucuucccugccauuccaaaacauaaauagcaggacugugggagagugcccgcgguaugucaagcaggaaucgcuacuccuggcuacaggcaugaaaaacguucccgagaucccuaagggucgugggcuuuuuggcgccauugcgggauucaucgaaaauggcugggaggggcugguggauggaugguacgguuuccgccaccagaacgcccaaggcgaggggaccgcagcugacuacaaaucuacucaguccgccauagaccagauuacaggaaaguugaauagacucaucgagaaaaccaaccagcaauuugaacugaucgauaaugaguucacggaaguagaaaagcagauuggcaacgugaucaauuggaccagggacucauuaacagagauguggaguuauaacgcugagcugcucgucgccauggaaaaucagcacacuauugaucuugcagacagcgagaugaacaaacuguacgaacgggugcgacgccaguugagagagaaugccgaagaggaugguaccggguguuuugagauauuccauaagugcgacgaugacuguauggcuuccaucaggaacaacacauaugaucacucuaaguaccgggaagaggcgauucaaaaucgcauccagaucgacccaguuaaacuaagcucaggcuauaaggaugugauucugugguuuaguuucggagcauccugcuuuauacuccuggccaucgcuaugggccuugucuucauuugcgugaaaaacgggaauaugagauguacuaucugcauuuga

SEQ ID NO: 135849 - RNA, 1683 nt, Artificial Sequence
  derived and/or modified sequence opt3 from hemagglutinin_precursor__InfluenzaA__AAC40999
augaacacccagauccugauucucgcccuuguagcuauaauccccacaaaugcagacaagauuugccugggccaccaugccgucagcaacgggacuaaaguuaauacguugaccgagagaggaguggaaguagugaacgcgacagagacugucgaaaggaccaaugugccucggaucuguuccaaggguaaacgcacaguugauuuaggccaaugcgggcugcuaggaaccauuacuggcccaccgcagugugaccaguuccucgaguuuucugcugaucugaucauagaacgacgugagggugacgaugugugcuaccccgggaaguucgucaacgaggaagcccuuagacagauccugagggagucaggaggcauugacaaagaaacaaugggcuuuaccuauagugggauccggacgaauggagcaacuagcgccugucgcagauccgguucuucguucuacgcugagaugaagugguugcucucaaacaccgauaaugcagccuuuccucaaaugacaaagagcuauaaaaacauuaggaaggacccagcucugaucauauggggcauucaccauaguggguccacugccgagcagaccaaacuguacggaucuggcaauaagcucaucacaguggguagcuccaacuaucagcagucauucguacccauuccuggggcgcggccacaaguuaauggacagaguggccgcaucgauuuucacugguuaaugcugaaccccaaugacaccgugacguucagcuuuaacggcgcauucaucgccccugaucgagcuucuuuucuuagagggaaauccauggguauucagucagaaguccagguggacgccaacugcgagggagauuguuaccauagcggcgggacuauauugaauaaccugccauuccaaaauaucaacggaagggcagugggcaagugcccgcgguaugucaagcaggaaagucuacuccuggcuacagguaugaaaaauguucccgagauuccuaaggggcguggccuuuuuggagccaucgcgggcuucauagaaaacgggugggagggacugguggacgguugguacggcuuccgccaccagaaugcccaaggggagggaaccgcagcugacuacaaaucuacucaguccgccauugaucagaucacaggcaaguugaacagacucaucgagaaaaccaaucagcaauuugaacugauugacaacgaguucacggaaguagaaaagcagaucgguaaugugauuaacuggaccagggauagcaugacagaggucuggucguauaaugcugaguuacugguggccauggaaaaccagcacacuauagaccucgcagauucugagaugaauaaacuuuacgaacggguucgacgccagcugagagagaacgccgaagaggacgggaccggcuguuuugagaucuuccauaagugcgaugacgauuguauggcuuccauuaggaacaauacauaugaccacucaaaguaccgggaagaggcgauccaaaaccgcauccagauugauccagugaaauugaguagcggauauaaggacgucauacuaugguuuuccuucggcgcaucuugcuuuauccugcucgccauugcuauggggcugguguucaucugcgugaaaaauggaaacaugagauguacuauuugcaucuga

SEQ ID NO: 135850 - RNA, 1698 nt, Artificial Sequence; identical to SEQ ID NO: 124504
  derived and/or modified sequence opt3 from hemagglutinin__InfluenzaA__ACA28844

SEQ ID NO: 135851 - RNA, 1698 nt, Artificial Sequence; identical to SEQ ID NO: 129809
  derived and/or modified sequence opt3 from hemagglutinin__InfluenzaA__ACA28844/m1

SEQ ID NO: 135852 - RNA, 1701 nt, Artificial Sequence; identical to SEQ ID NO: 131166
  derived and/or modified sequence opt3 from hemagglutinin__InfluenzaA__ACV82259

SEQ ID NO: 135853 - RNA, 1701 nt, Artificial Sequence; identical to SEQ ID NO: 131166
  derived and/or modified sequence opt3 from hemagglutinin__InfluenzaA__ACV82259/m1

SEQ ID NO: 135854 - RNA, 1701 nt, Artificial Sequence; identical to SEQ ID NO: 131166
  derived and/or modified sequence opt3 from hemagglutinin__InfluenzaA__ACV82259/m2

SEQ ID NO: 135855 - RNA, 1701 nt, Artificial Sequence; identical to SEQ ID NO: 124683
  derived and/or modified sequence opt3 from hemagglutinin__InfluenzaA__ACP41953

SEQ ID NO: 135856 - RNA, 1701 nt, Artificial Sequence; identical to SEQ ID NO: 134257
  derived and/or modified sequence opt3 from hemagglutinin__InfluenzaA__AFM72832

SEQ ID NO: 135857 - RNA, 1701 nt, Artificial Sequence
  derived and/or modified sequence opt3 from hemagglutinin__InfluenzaA__EPI516528
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaggagcucagggagcagcugucaagcgugaguuccuucgaacgguuugagauuuuccccaagacaucuagcuggccuaaucacgauuccaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaguucucgcuauuccaagaaauuuaagccagagauugcaauccgacccaaagugcgugaucaggagggaagaaugaauuacuauuggacucugguggaaccuggugacaagauuaccuucgaggccacaggcaaccuagucguuccaagguacgcuuuugccauggaacggaacgcagggagcggaaucauaauuucggauacuccggugcaugacugcaauaccacaugucaaacccccaaaggcgcuaucaacacgucucucccuuuccagaauauucacccaaucacuaucgguaagugccccaaguauguaaaauccacaaagcugcgccuugccaccgggcugagaaacauuccuucaauacagaguaggggauuguuuggcgcgaucgccggcuucauugaagggggauggacugguaugguggacggcugguacggguaucaucaccagaaugaacaaggaagcggcuacgcagcugaucucaaauccacacagaacgccaucgacgagauaaccaauaaggucaacucugugauugagaaaaugaauacgcaguuuaccgcuguugguaaggaguucaaccaccuggaaaagcggaucgaaaauuuaaacaaaaagguggaugacggguuccuggauaucuggacauacaaugccgagcuccuuguccuguuggaaaacgagcgcacucuagacuaucaugauagcaaugugaaaaaccuguacgagaagguacgaucacagcucaaaaacaaugcaaaggaaauuggcaacggauguuuugaguucuaucacaagugcgacaauaccuguauggaaaguguuaaaaacggcacauacgauuauccaaaguacuccgaggaagccaaacugaauagagaggagaucgacggggugaaacuugaaagcacuaggauuuaucaaauacuggcuaucuacucuaccgucgcgucaaguuuggugcucgucgugagccugggagcaauuuccuuuuggaugugcucuaacgguucguuacauugccggaucuguguuuga

SEQ ID NO: 135858 - RNA, 1701 nt, Artificial Sequence
  derived and/or modified sequence opt3 from hemagglutinin__InfluenzaA__AGM53850
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaggagcucagggagcagcugucaagcgugaguuccuucgaacgguuugagauuuuccccaagacaucuagcuggccuaaucacgauuccaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuccaacguccgcugaucaacagucauuguaccagaacgccgacgcguacguguucgucgggagcagucgcuauucuaagaaauuuaagcccgagauugcaauccgaccuaaagugcgugaucaggagggaagaaugaauuacuauuggacucugguggaaccaggugacaagauuaccuucgaggccacaggcaaccuagucguuccgagguacgcuuuugccauggaacggaacgcaggguccggaaucauaauuagcgauacucccgugcaugacugcaauaccacaugucaaaccccuaaaggcgcuaucaacacgucgcucccauuccagaauauucaccccaucacuaucgguaagugcccuaaguauguaaaaucuacaaagcugcgccuugccaccgggcugagaaacauuccauccauacagucaaggggauuguuuggcgcgaucgccggcuucauugaagggggauggacugguaugguggacggcugguacggguaucaucaccagaaugaacaaggaaguggcuacgcagcugaucucaaaagcacacagaacgccaucgacgagauaaccaauaaggucaacuccgugauugagaaaaugaauacgcaguuuaccgcuguugguaaggaguucaaccaccuggaaaagcggaucgaaaauuuaaacaaaaagguggaugacggguuccuggauaucuggacauacaaugccgagcuccuuguccuguuggaaaacgagcgcacucuagacuaucaugauucuaaugugaaaaaccuguacgagaagguacgaagccagcucaaaaacaaugcaaaggaaauuggcaacggauguuuugaguucuaucacaagugcgacaauaccuguauggaaucaguuaaaaacggcacauacgauuaucccaaguacagugaggaagccaaacugaauagagaggagaucgacggggugaaacuugaauccacuaggauuuaucaaauacuggcuaucuacagcaccgucgcgucuucauuggugcucgucgugagucugggagcaauuagcuuuuggaugugcuccaacgguucuuuacagugccggaucuguaucuga

SEQ ID NO: 135859 - RNA, 1701 nt, Artificial Sequence
  derived and/or modified sequence opt3 from hemagglutinin__InfluenzaA__EPI731463
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaagaacucagggagcagcugucaagcgugaguuccuucgaacgguuugagauuuuccccaauacaucuagcuggccuaaccacgauuccaauaagggugucaccgccgcuuguccacaugcaggggccaagucauuuuauaaaaaccugaucuggcucgugaagaaaggaaauaguuaccccaaguuaagcaaaucuuauauaaacgacaagggcaaggaaguacugguucuuuggggcauccaccacccuuccacgucagcugaucaacagagcuuguaccagaaugccgacgcguacguguucgucgggaguucucgcuauuccaaaaaguuuaaaccagagauugcaauccgacccaaggugcguggacaggaggguagaaugaacuacuauuggacucugguggaaccuggcgauaaaauuaccuucgaggccacagggaaccuagucguuccaagguacgcuuuugccauggaacggaaugcaggaagcggcaucauaauuucggacacuccggugcaugauugcaacaccacaugucaaacccccaagggugcuaucaauacgucucucccuuuccagaacauucacccaaucacuaucgggaaaugccccaaguauguaaaguccacaaaacugcgccuugccaccggacugagaaauauuccuucaauacagaguaggggcuuguuuggcgcgaucgccggguucauugagggagguuggacuggcaugguggacgggugguacggauaucaucaccagaacgaacaaggcagcgguuacgcagcugaccucaaguccacacagaaugccaucgaugagauaaccaacaaagucaauucugugauugagaagaugaacacgcaguuuaccgcuguugggaaagaguucaaucaccuggagaagcggaucgaaaacuuaaauaagaaaguggacgauggcuuccuggacaucuggacauacaacgccgagcuccuuguccuguuggaaaaugagcgcacucuagauuaucaugacagcaacgugaagaaccuguacgagaaaguacgaucacagcucaagaauaacgcaaaagaaauuggaaauggcuguuuugaguucuaucacaagugcgauaacaccuguauggaaaguguuaagaaugggacauacgacuauccaaaauacuccgaggaagccaagcugaacagagaggagaucgauggagugaaacuugaaagcacuaggauuuaucaaauacuggcuaucuacucuaccgucgcgucaaguuuggugcucgucgugagccugggugcaauuuccuuuuggaugugcucuaauggcucguuacagugccggaucuguaucuga

SEQ ID NO: 135860 - RNA, 1701 nt, Artificial Sequence; identical to SEQ ID NO: 126514
  derived and/or modified sequence opt3 from hemagglutinin__InfluenzaA__EPI696972

SEQ ID NO: 135861 - RNA, 1701 nt, Artificial Sequence; identical to SEQ ID NO: 135702
  derived and/or modified sequence opt3 from hemagglutinin__InfluenzaA__EPI662594

SEQ ID NO: 135862 - RNA, 1701 nt, Artificial Sequence
  derived and/or modified sequence opt3 from hemagglutinin__InfluenzaA__EPI685579
augaaggccauccuggugguccuccuuuacaccuucacaacugcuaacgcagacacgcugugcauuggcuaucacgccaauaacagcaccgauacaguugacacuguguuggagaagaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuaacucggacaauggaacaugcuauccaggcgauuuuaucaacuacgaagaacucagggagcagcugucaagcgugaguuccuucgaacgguuugagauuuucccgaagaccucuagcuggcccaaucacgacuccaacaagggugucacggcagccuguccucaugcuggggcaaaaucauuuuauaagaaucugaucuggcucgugaaaaagggaaacaguuacccaaaauuaaaucaaagcuauauaaacgauaagggcaaggaaguacugguucuuuggggcauccaccaccccucuacuaccgccgaccagcaguccuuguaccagaacgcugaugccuacguguucgucgggacaucacgcuauagcaaaaaguuuaaaccugagauugcgacucgaccaaaggugcgugacagagagggaaggaugaauuacuauuggacccugguggaacccggugauaaaaucacauucgaggcaaccggcaaccuagucguuccucgguacgccuuuacgauggaacgcaaugcugggaguggaauuaucauaucugacacuccagugcaugauugcaacacaaccugucaaacuccggagggcgccauuaauacaucccuccccuuccagaacauccacccuauuaccaucgguaagugcccaaaauauguaaagagcacgaagcugagacuugcaaccgggcugaggaaugugcccucgauccagucucggggauuguuuggcgcuauugccggcuucauagaagggggauggacagguauggucgacggcugguacggguaucaucaccagaacgagcaaggauccggcuacgcggccgaccucaaaucaacucagaaugcaaucgauaagauuaccaacaaagugaauaguguuaucgagaagaugaacacacaguuuacugcuguggguaaagaguucaaucaccuggagaagcgcauagaaaacuuaaauaagaaagucgacgauggguuccuggacauuuggaccuacaacgccgagcuccuugugcuguuggaaaacgagcgaacacuagauuaucaugacagcaauguaaagaaccuguacgagaaaguuagaaaucagcucaagaacaaugcuaaagaaaucggcaacggauguuuugaguucuaucacaagugcgauaauaccuguauggaauccgugaagaacggcacuuacgacuauccuaaauacucugaggaagccaagcugaauagggagaaaaucgauggggucaaacuugagagcacgcggauuuaucaaauccuggcaauuuacucaacaguggccaguuccuugguccucgugguuagccugggagcuauaucuuuuuggaugugcucaaacgguaguuuacagugccguaucuguauuuga

SEQ ID NO: 135863 - RNA, 1701 nt, Artificial Sequence
  derived and/or modified sequence opt3 from hemagglutinin__InfluenzaA__EPI830230
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuaacucggacaauggaacaugcuauccaggcgauuuuaucaacuacgaagaacucagggagcagcugucaagcgugaguuccuucgaacgguuugagauuuucccgaagaccucuagcuggcccaaucacgacuccaacaagggugucacggcagccuguccucaugcuggggcaaaaucauuuuauaagaaucugaucuggcucgugaaaaagggaaacaguuacccaaaauuaaaucaaagcuauauaaacgauaagggcaaggaaguacugguucuuuggggcauccaccaccccucuacuaccgccgaccagcaguccuuguaccagaacgcugaugccuacguguucgucgggacaucacgcuauagcaaaauguuuaagccugagauugcgacucgaccaaaagugcgugacagagagggaaggaugaauuacuauuggacccugguggaacccggugauaagaucacauucgaggcaaccggcaaccuagucguuccucgguacgccuuuacgauggaacgcaaugcugggaguggaauuaucauaucugacacuccagugcaugauugcaacacaaccugucaaacuccggagggcgccauuaauacaucccuccccuuccagaacauccacccuauuaccaucgguaaaugcccaaaguauguaaaaagcacgaagcugagacuugcaaccgggcugaggaaugugcccucgauccagucucggggauuguuuggcgcuauugccggcuucauagaagggggauggacagguauggucgacggcugguacggguaucaucaccagaacgagcaaggauccggcuacgcggccgaccucaagucaacucagaaugcaaucgauaaaauuaccaacaaggugaauaguguuaucgagaaaaugaacacacaguuuacugcuguggguaaggaguucaaucaccuggagaaacgcauagaaaacuuaaauaagaaggucgacgauggguuccuggacauuuggaccuacaacgccgagcuccuugugcuguuggaaaacgagcgaacacuagauuaucaugacagcaauguuaaaaaccuguacgagaagguaagaaaucagcucaaaaacaaugcuaaggaaaucggcaacggauguuuugaguucuaucacaaaugcgauaauaccuguauggaauccgugaagaacggcacuuacgacuauccuaaguacucugaggaagccaaacugaauagggagaagaucgauggggucaaacuugagagcacgcggauuuaucaaauccuggcaauuuacucaacaguggccaguuccuugguccucgugguuagccugggagcuauaucuuuuuggaugugcucaaacgguaguuuacagugccguaucuguauuuga

SEQ ID NO: 135864 - RNA, 1701 nt, Artificial Sequence; identical to SEQ ID NO: 124672
  derived and/or modified sequence opt3 from hemagglutinin__InfluenzaA__ACQ45338

SEQ ID NO: 135865 - RNA, 1701 nt, Artificial Sequence; identical to SEQ ID NO: 124672
  derived and/or modified sequence opt3 from hemagglutinin__InfluenzaA__ACQ45338/m1

SEQ ID NO: 135866 - RNA, 1701 nt, Artificial Sequence; identical to SEQ ID NO: 124672
  derived and/or modified sequence opt3 from hemagglutinin__InfluenzaA__ACQ45338/m2

SEQ ID NO: 135867 - RNA, 1701 nt, Artificial Sequence; identical to SEQ ID NO: 124334
  derived and/or modified sequence opt3 from hemagglutinin__InfluenzaA__ACU79871

SEQ ID NO: 135868 - RNA, 1701 nt, Artificial Sequence
  derived and/or modified sequence opt3 from hemagglutinin__InfluenzaA__ACU79871/m1
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgagcuagugcagucuucaaguacaggcaagaucugcaacaauccacacaggauucucgacgggaucgauuguacccugauagacgcucugcugggagauccgcauugcgacguauuucagaacgaaacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaacuuuauauuuggggcgugcaccauccaucaacaaaucaagagcagaccaguuuguacguacaggcaagcgggcguguuacggugucuacuagaaggucccagcaaacaaucauucccaacaucgagucacggccuuggguccgcggacagagcaguagaauaucuauuuauuggaccaucgugaagccaggcgacgugcuggucauuaacuccaaugguaaccuaaucgccccgaggggguacuuuaaaaugcggacuggaaagagcucgaucaugcgcucugacgcucccauugauacauguauauccgaaugcaucaccccuaauggcucaauuccaaacgacaaacccuuccagaauguuaacaagaucacguacggcgccuguccuaaauaugugaagcagaauacccucaagcuggcgacagggaugcgaaacguaccagagaaacaaacuagaggacuuuuuggugcaauagccggcuucauugaaaaugggugggagggaaugaucgauggcugguacgguuuuaggcaccagaacagugaggggaccggccaggcugccgaccuuaagagcacacaagcagcuaucgaucagauuaauggaaaagugaaccggaucauugaaaagacuaaugagaaauuccaccagauagaaaaggaguucuccgaagucgagggccguauccaggacuuggagaaauauguggaagauaccaagauugaccucuggucuuacaacgccgagcuguuaguugcgcuggaaaaucaacauacaaucgaucucaccgacagcgagaugaacaaacuuuuugaaaagacucgcagacagcugagggagaacgccgaggauauggggaauggaugcuucaagaucuaucacaagugugacaacgcaugcauugaaucaauacggagugguacguacgaccaugauguguaucgagacgaggcuuugaauaaccgcuuucagaucaagggcgucgaacuaaaauccggguacaaggauuggauucuguggaucagcuucgccauuucuugcuuucuccugugugugguacuucugggauucaucaugugggcuugccagagaggcaauauaagguguaacaucugcauuuga

SEQ ID NO: 135869 - RNA, 1701 nt, Artificial Sequence
  derived and/or modified sequence opt3 from hemagglutinin__InfluenzaA__EPI643118
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauaaguacccagcauuaaaugugacuaugcccaacaacgagcaguuugacaagcuguauauuuggggaguccaccauccuggcaccgauaaagaccagaucuucccauacgcccagucuuccggcagaauaauugugucaacaaagaggagccaacaggcuguaauccccaauauugggagucggccucgcaucagagauaucccaucuaggauuuccauauacuggacuaucguuaaaccgggagacauucuuuugaucaacagcaccgguaaucugauagcgccccggggcuauuuuaagcuacgcucggggaaaucuuccauuaugcgaucagacgccccuaucggaaaguguaagagugaaugcaucacaccaaacggcagcauucccaaugauaaaccuuuccagaacgugaauagaaucaccuacggugcauguccaagguaugucaagcacuccacgcucaaacuggccacugggaugcggaacgugcccgagaagcagacacguggaauuuuuggcgcuauagccggcuucaucgaaaaugggugggagggaaugguggacgguugguacggcuuucgccaccaaaacucugaggggagaggacaggcagcugaucuuaaaagcacccaggccgcgauugaccaaaucaauggcaagcugaacagguugaucgguaaaacuaaugaaaaguuccaucagauugagaaggaauuuucagaggucgaagggcggauacaggaucucgagaaauauguugaggacacaaagaucgaucuguggaguuacaacgccgaauuacugguggcacucgagaaucagcacaccauugaccuuacggauuccgaaaugaacaaacuguuugagaagaccaaaaagcaauugcgagaaaacgcugaggacaugggcaauggaugcuucaagaucuaucauaaaugugauaacgccugcauuggcagcauccgcaaugggacauacgaccacaacguauacagagacgaggcucuaaauaacagguuucagauaaagggaguggaacugaaaucugguuauaaggauuggauccucuggauuucauucgccaucaguugcuuucugcuuugugucgcacuguugggcuucauuaugugggccugccagaaagggaauauccgguguaacauaugcauuuga

SEQ ID NO: 135870 - RNA, 1701 nt, Artificial Sequence; identical to SEQ ID NO: 134457
  derived and/or modified sequence opt3 from hemagglutinin__InfluenzaA__EPI675798

SEQ ID NO: 135871 - RNA, 1701 nt, Artificial Sequence
  derived and/or modified sequence opt3 from hemagglutinin__InfluenzaA__EPI578430
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccucuuguuaccccuaugacgucccugauuacgcaucgcugcggucauugguggccagcaguggcacccucgaauuuaacaaugaguccuucaacuggacugguguuacacaaaaugggaccucuagcgcuugcauccgccgauccucaaguagcuuuuucucucgucugaacuggcugacgcaucucaauuauaaguacccagcauuaaacgugacuaugcccaauaacgagcaguuugacaagcuguauauuuggggaguccaccauccuggcaccgauaaagaccagaucuucccauacgcccaguccucaggcagaauaacagugagcacuaagaggagucaacaggcuguaauucccaacaucgggucucggccucgcauuagagauaucccauccaggaucagcauuuacuggaccauaguuaaaccgggagacauccuuuugauuaauucgacagguaaccugaucgcgccccggggcuauuuuaagauacgcucugggaaauccucaauuaugcgaagugacgccccuaucggaaaguguaagagcgaaugcaucaccccaaauggcuccauucccaacgauaaaccuuuccagaaugugaacagaaucacguacggugcauguccaagguaugucaagcacucuacucuaaaacucgccacagggaugcggaaugugcccgagaagcagacccguggaauuuuuggcgcuauagccggcuucaucgaaaacgggugggagggaaugguggacgguugguacggcuuucgccaccaaaauagcgaggggagaggacaggcagcugaucugaaaucaacucaggccgcgauugaccaaaucaacggcaaacuuaauaggcugaucgguaaaacaaacgaaaaguuccaucagauugagaaggaguucagugaagucgaagggcggauacaggauuuggagaaauauguugaggacaccaagaucgaucucugguccuacaaugccgaacuguuaguggcacuggagaaccagcacacgauugaccucaccgauagcgaaaugaauaaacuuuuugagaagacaaagaagcaacugcgagaaaacgcugaggacaugggcaacggaugcuucaagaucuaucauaaaugugauaaugccugcauuggcucuauccgcaacgggacuuacgaccacaauguauacagagacgaggcuuugaacaauagguuucagauaaagggaguggaacuaaaaucagguuauaaggauuggauccuguggauuaguuucgccaucagcugcuuucuccugugugucgcacuucugggcuucauuaugugggccugccagaaagggaacauccgguguaauauaugcauuuga

SEQ ID NO: 135872 - RNA, 1701 nt, Artificial Sequence
  derived and/or modified sequence opt3 from hemagglutinin__InfluenzaA__EPI614406
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccucuuguuaccccuaugacgucccugauuacgcaucgcugcggucauugguggccagcaguggcacccucgaauuuaacaaugaguccuucaacuggacugguguuacacaaaaugggaccucuagcgcuugcauccgccgauccucaaguagcuuuuucucucgucugaacuggcugacgcaucucaauuauaaguacccagcauuaaacgugacuaugcccaauaacgagcaguuugacaagcuguauauuuggggaguccaccauccuggcaccgauaaagaccagaucuucccauacgcccaguccucaggcagaauaacagugagcacuaagaggagucaacaggcuguaauucccaacaucgggucucggccucgcauuagaaauaucccauccaggaucagcauuuacuggaccauaguuaaaccgggagauauccuuuugauuaacucgacagguaaucugaucgcgccccggggcuauuuuaagauacgcucugggaaauccucaauuaugcgaagugacgccccuaucggaaaguguaagagcgaaugcaucaccccaaacggcuccauucccaaugacaaaccuuuccagaacgugaauagaaucacguacggugcauguccaagguaugucaagcacucuacucuaaaacucgccacagggaugcggaacgugcccgagaagcagacccguggaauuuuuggcgcuauagccggcuucaucgaaaaugggugggagggaaugguggaugguugguacggcuuucgccaccaaaacagcgaggggagaggacaggcagcugaccugaaaucaacucaggccgcgauugaucaaaucaauggcaaacuuaacaggcugaucgguaaaacaaaugaaaaguuccaucagauugagaaggaguucagugaagucgaagggcggauacaggacuuggagaaauauguugaggauaccaagaucgaccucugguccuacaacgccgaacuguuaguggcacuggagaaucagcacacgauugaucucaccgacagcgaaaugaacaaacuuuuugagaagacaaagaagcaacugcgagaaaacgcugaggauaugggcaauggaugcuucaagaucuaucauaaaugugacaacgccugcauuggcucuauccgcaaugggacuuacgaucacaacguauacagagacgaggcuuugaauaacagguuucagauaaagggaguggaacuaaaaucagguuauaaggacuggauccuguggauuaguuucgccaucagcugcuuucuccugugugucgcacuucugggcuucauuaugugggccugccagaaagggaauauccgguguaacauaugcauuuga

SEQ ID NO: 135873 - RNA, 1695 nt, Artificial Sequence
  derived and/or modified sequence opt3 from hemagglutinin__InfluenzaA__ACU65077/m1
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggaaaagacccacaaugggaaguugugugauuuagacggagucaaaccccugauucuaagagauugcucaguggccgguuggcuccugggcaacccuaugugugacgaguuuaucaauguuccagaauggaguuauauaguggagaaggcgaacccggucaaugaucuuugcuaccccggggacuucaacgauuaugaggaacugaagcauuugcucagcaggaucaaucacuuugagaaaauucagaucauuccuaaguccucuuggucgucacaugaagcuagccugggagugaguuccgccuguccauaccagggcaaaucuagcuucuuucggaacguaguuuggcugaucaagaaaaauuccacauaucccacuauaaagcgcucauacaacaauaccaaccaagaggaccucuuagugcugugggguauucaccacccuaaugaugcagccgagcagacaaaacuuuaucagaacccaaccacuuacaucagugucgggacaagcaccuugaaccagcgacuggugccccguauugcuacgagaucuaaagugaauggacaauccggcaggauggaguucuuuuggacuauccuaaagccuaacgacgcaaucaauuucgaaucaaacggcaauuuuauugccccagaauacgcuuauaaaauagucaagaaaggggauagcaccaucaugaagagugagcucgaauacggaaacugcaauacaaaaugucagacuccgaugggugccauuaacucuuccaugcccuuccauaauauccacccucugaccauaggcgagugcccaaaguauguuaagagcaaccggcuugugcuggcgacaggguugcgcaauucgccccagagagagaccaggggacucuuuggcgcaauugccgguuucaucgaagggggauggcagggcaugguagacggcugguacggguaucaucacucuaacgagcaaggauccgguuacgcugccgacaaagaaucaacgcagaaggcaaucgauggcgugacuaauaaagucaacaguauuaucgacaagaugaauacacaguuugaggcuguggggcgggaguucaacaaccuggaacgccgaauugagaauuuaaacaaaaagauggaagauggauuccuggacguuuggaccuauaaugccgagcuccuugugcugauggaaaacgagagaacuuuggauuuucacgacagcaaugucaagaaccuauacgauaaagugaggcugcaacuccgggacaaugcgaaggaacugggcaacgguuguuucgaguuuuaccauaaaugcgauaaugaguguauggaauccguacguaacgggacauaugacuacccucaguauucugaggaagcccgccuuaagagagaggagauaagcggcguuaaacuggaaucaaucggaauuuaccagaucuugaguaucuauuccaccguggcaagcucucucgcucuggccauuauggucgcuggcuuaucacuguggaugugcaguaaugggagccuacagugcaggauauguaucuga

SEQ ID NO: 135874 - RNA, 1695 nt, Artificial Sequence; identical to SEQ ID NO: 135873
  derived and/or modified sequence opt3 from hemagglutinin__InfluenzaA__ACU65077/m2

SEQ ID NO: 135875 - RNA, 1707 nt, Artificial Sequence; identical to SEQ ID NO: 122044
  derived and/or modified sequence opt3 from hemagglutinin__InfluenzaA__ABP51976

SEQ ID NO: 135876 - RNA, 1707 nt, Artificial Sequence; identical to SEQ ID NO: 122044
  derived and/or modified sequence opt3 from hemagglutinin__InfluenzaA__ABP51976/m1

SEQ ID NO: 135877 - RNA, 1695 nt, Artificial Sequence
  derived and/or modified sequence opt3 from hemagglutinin__InfluenzaA__ABW90125
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggagaaaaagcacaaugggaaauugugugauuuagacggagucaagccccugauucuaagagauugcucaguggccgguuggcuccugggcaacccuaugugugacgaauuuaucaauguuccagaauggaguuauauaguggagaaggcgaacccggucaaugaucuuugcuaccccggggacuucaacgauuaugaggaacugaaacauuugcucagcaggaucaaucacuuugagaagauucagaucauuccuaaauccuacuggucuucgcaugaggcuucacugggagugagcagugccuguccauaucagggcaaguccucuuucuuucggaacguaguuuggcugaccaaaaagaauagcacauaccccacuaucaagcgcuccuauaacaauaccaaccaagaagaccucuuagugcugugggguauacaccacccuaaugaugcagccgagcagacaaaacuuuaccagaacccaaccacuuacauuucagucgggacaaguaccuugaaccagcgacuggugccccguaucgcuacgagaagcaaggugaauggacaaucuggcaggauggaguucuuuuggacuauucuaaaaccuaacgacgcaaucaauuucgaauccaacggcaauuuuaucgccccagaauaugcuuacaagauugucaaaaagggggauucaaccauaaugaaaagcgagcucgaauauggaaacugcaauacaaagugucagacuccgaugggugccaucaacaguucuaugcccuuccauaauauucacccucugaccaucggcgagugcccaaaguacguuaaauccaaccggcuugugcuggcgacaggguugcgcaauagcccccagagagagaccaggggacucuuuggcgcaauagccgguuucauugaagggggauggcagggcaugguagacggcugguauggguaccaucacucgaacgagcaaggaucugguuaugcugccgacaaggaauccacgcagaaagcaaucgauggcgugacuaauaaggucaacucaaucauugacaaaaugaauacacaguuugaggcuguggggcgggaguucaacaaccuggaacgccgaaucgagaauuuaaacaagaagauggaagauggauuccuggacguuuggaccuacaaugccgagcuccuugugcugauggaaaacgagagaacuuuggauuuucacgacaguaaugucaaaaaccuauacgauaaggugaggcugcaacuccgggacaaugcgaaagaacugggcaacgguuguuucgaguuuuaucauaagugcgauaaugaguguauggaaagcguacguaacgggacauacgacuauccucaguacuccgaggaagcccgccuuaaaagagaggagauuucuggcguuaagcuggaaagcauaggaaucuaucagauuuugucaaucuacaguaccguggcauccagccucgcucuggccaucauggucgcuggcuuaucucuguggaugugcucaaaugggagucuacagugcaggauuuguauauga

SEQ ID NO: 135878 - RNA, 1695 nt, Artificial Sequence
  derived and/or modified sequence opt3 from hemagglutinin__InfluenzaA__ABW90126
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggagaaaaagcacaaugggaaauugugugauuuagacggagucaagccccugauucuaagagauugcucaguggccgguuggcuccugggcaacccuaugugugacgaauuuaucaauguuccagaauggaguuauauaguggagaaggcgaacccggucaaugaucuuugcuaccccggggacuucaacgauuaugaggaacugaaacauuugcucagcaggaucaaucacuuugagaagauucagaucauuccuaaauccucuuggucgucacaugaagcuagccugggagugaguuccgccuguccauaccagggcaagucuagcuucuuucggaacguaguuuggcugaucaaaaagaacuccaccuaucccacaauaaaggguucauacaauaauacuaaccaagaggaccucuuagugcugugggggauucaccacccuaaugaugcagccgagcagaccaaacuuuaucagaacccaacaaccuacaucagugucggaacuagcacauugaaccagcgccuggugccccgaauugcuacccguucuaaggugaauggccaauccggcagaauggaguucuuuuggacgauccuaaaaccuaacgacgcaaucaauuucgaaucaaacgggaauuuuauugccccagaauacgcuuauaagauagucaaaaagggagauagcacuaucaugaaaagugagcucgaauacgguaacugcaauaccaagugucagacaccgaugggcgccauuaacucuuccaugcccuuccauaauauccacccucugacuauaggggagugcccaaaguauguuaaaagcaacaggcuugugcuggcgaccggauugcgcaauucgccccagcgggagacaagaggccucuuuggugcaauugccggguucaucgaaggaggcuggcagggcaugguagacgggugguacggauaucaucacucuaacgagcaagguuccggcuacgcugccgacaaggaaucaacccagaaagcaaucgauggggugacgaauaaggucaacaguauuaucgacaaaaugaauacucaguuugaggcugugggaagggaguucaacaaccuggaacggcgcauugagaauuuaaacaagaagauggaagauggcuuccuggacguuuggacauauaaugccgagcuccuugugcugauggaaaacgagcgaaccuuggauuuucacgacagcaaugucaaaaaccuauacgauaaggugagacugcaacucagggacaaugcgaaagaacuggguaacggguguuucgaguuuuaccauaagugcgauaaugaguguauggaauccguacggaacggcacuuaugacuacccucaguauucugaggaagcccgucuuaaacgcgaggagauaagcggaguuaagcuggaaucaaucggcauuuaccagaucuugaguaucuauuccacaguggcaagcucucucgcucuggccauuauggucgcuggguuaucacuguggaugugcaguaauggaagccuacagugcagaauauguaucuga

SEQ ID NO: 135879 - RNA, 1695 nt, Artificial Sequence
  derived and/or modified sequence opt3 from hemagglutinin__InfluenzaA__ABW90127
auggagaagaucgugcuucucuucgccauugucagccuuguuaaauccgaccagauaugcaucggcuaccacgcuaacaauucuaccgaacaaguggauacaauuauggagaagaacguaacugugacgcaugcacaggacauccuggagaaaaagcacaaugggaaauugugugauuuagacggagucaagccccugauucuaagagauugcucaguggccgguuggcuccugggcaacccuaugugugacgaguuuaucaauguuccagaauggaguuauauaguggagaaggcgaacccggucaaugaucuuugcuaccccggggacuucaacgauuaugaggaacugaaacauuugcucagcaggaucaaucacuuugagaagauucagaucauuccuaaauccucuuggucgucacaugaagcuagccugggagugaguuccgccuguccauaccagggcgagucuagcuucuuucggaacguaguuuggcugaucaagaaaaauuccaccuaucccacaauaaagcgcucauacaacaauacuaaccaagaggaccucuuagugcugugggguauucaccacccuaaugaugcagccgaacagaccaagcuguaucagaacccaacaaccuacaucagugucgggacuagcacauugaaccagcgacuggugccccguauugcuaccagaucuaaagugaauggacaauccggcaggauggaguucuuuuggacgauccuaaagccuaacgacgcaaucaauuucgaaucaaacggcaauuuuauugccccagaguacgcuuauaaaauagucaagaaaggggauagcacuaucaugaagagugaacucgaguacggaaacugcaauaccaaaugucagacaccgaugggugccauuaacucuuccaugcccuuccauaauauccacccucugacuauaggcgagugcccaaaguauguuaagagcaaccggcuugugcuggcgaccggguugcgcaauucgccccagagagaaacaaggggacucuuuggcgcaauugccgguuucaucgaagggggauggcagggcaugguagacggcugguacggguaucaucacucuaacgaacaaggauccgguuacgcugccgacaaagagucaacccagaaggcaaucgauggcgugacgaauaaagucaacaguauuaucgacaagaugaauacucaguuugaagcuguggggcgggaguucaacaaccuggagcgccgaauugaaaauuuaaacaaaaagauggaggauggauuccuggacguuuggacauauaaugccgaacuccuugugcugauggagaacgaaagaaccuuggauuuucacgacagcaaugucaagaaccuauacgauaaagugaggcugcaacuccgggacaaugcgaaggagcugggcaacgguuguuucgaguuuuaccauaaaugcgauaaugaauguauggaguccguacguaacgggacuuaugacuacccucaguauucugaagaggcccgccuuaagagagaggaaauaagcggcguuaaacuggagucaaucggaauuuaccagaucuugaguaucuauuccacaguggcaagcucucucgcucuggccauuauggucgcuggcuuaucacuguggaugugcaguaaugggagccuacagugcaggauauguaucuga

SEQ ID NO: 135880 - RNA, 1695 nt, Artificial Sequence
  derived and/or modified sequence opt3 from hemagglutinin__InfluenzaA__ABW90128
auggagaagaucgugcuucucuucgccauugucagccuuguuaaauccgaccagauaugcaucggcuaccacgcuaacaauucuaccgaacaaguggauacaauuauggagaagaacguaacugugacgcaugcacaggacauccuggagaaaaagcacaaugggaaauugugugauuuagacggagucaagccccugauucuaagagauugcucaguggccgguuggcuccugggcaacccuaugugugacgaguuuaucaauguuccagaauggaguuauauaguggagaaggcgaacccggucaaugaucuuugcuaccccggggacuucaacgauuaugaggaacugaaacauuugcucagcaggaucaaucacuuugagaagauucagaucauuccuaaauccucuuggucgucacaugaagcuagccugggagugaguuccgccuguccauaccagggcaagucuagcuucuuucggaacguaguuuggcugaucgagaaaaauuccaccuaucccacaauaaagcgcucauacaacaauacuaaccaagaggaccucuuagugcugugggguauucaccacccuaaugaugcagccgaacagaccaagcuguaucagaacccaacaaccuacaucagugucgggacuagcacauugaaccagcgacuggugccccguauugcuaccagaucuaaagugaauggacaauccggcaggauggaguucuuuuggacgauccuaaagccuaacgacgcaaucaauuucgaaucaaacggcaauuuuauugccccagaguacgcuuauaaaauagucaagaaaggggauagcacuaucaugaagagugaacucgaguacggaaacugcaauaccaaaugucagacaccgaugggugccauuaacucuuccaugcccuuccauaauauccacccucugacuauaggcgagugcccaaaguauguuaagagcaaccggcuugugcuggcgaccggguugcgcaauucgccccagagagaaacaaggggacucuuuggcgcaauugccgguuucaucgaagggggauggcagggcaugguagacggcugguacggguaucaucacucuaacgaacaaggauccgguuacgcugccgacaaagagucaacccagaaggcaaucgauggcgugacgaauaaagucaacaguauuaucgacaagaugaauacucaguuugaagcuguggggcgggaguucaacaaccuggagcgccgaauugaaaauuuaaacaaaaagauggaggauggauuccuggacguuuggacauauaaugccgaacuccuugugcugauggagaacgaaagaaccuuggauuuucacgacagcaaugucaagaaccuauacgauaaagugaggcugcaacuccgggacaaugcgaaggagcugggcaacgguuguuucgaguuuuaccauaaaugcgauaaugaauguauggaguccguacguaacgggacuuaugacuacccucaguauucugaagaggcccgccuuaagagagaggaaauaagcggcguuaaacuggagucaaucggaauuuaccagaucuugaguaucuauuccacaguggcaagcucucucgcucuggccauuauggucgcuggcuuaucacuguggaugugcaguaaugggagccuacagugcaggauauguaucuga

SEQ ID NO: 135881 - RNA, 1695 nt, Artificial Sequence
  derived and/or modified sequence opt3 from hemagglutinin__InfluenzaA__ABW90129
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggagaaaaagcacaaugggaaauugugugauuuagacggagucaagccccugauucuaagagauugcucaguggccgguuggcuccugggcaacccuaugugugacgaguuuaucaauguuccagaauggaguuauauaguggagaaggcgaacccggucaaugaucuuugcuaccccggggacuucaacgauuaugaggaacugaaacauuugcucagcaggaucaaucacuuugagaagauucagaucauuccuaaauccucuuggucgucacaugaagcuagccugggagugaguuccgccuguccauaccagggcaagucuagcuucuuucggaacguaguuuggcugaucaaaaagaacuccgcauaucccaccauaaagcgcucauacaauaauacaaaccaagaggaccucuuagugcugugggguauucaccacccuaaugaugccgcugagcagacugaacuuuaucagaacccaaccacauacaucagugucgggaccagcacuuugaaccagcgacuggugccccguauugcaacaagaucuaaagugaauggacaauccggcaggauggaguucuuuuggaccauccuaaagccuaacgacgccaucaauuucgaaucaaacggcaauuuuauugcuccagaguacgccuauaaaauagucaagaaaggggauagcacgaucaugaagagugaacucgaguacggaaacugcaauacuaaaugucagaccccgaugggugcgauuaacucuuccaugcccuuccauaauauccacccucugacaauaggcgagugcccaaaguauguuaagagcaaccggcuugugcuggcaacuggguugcgcaauucgccccagagagaaaccaggggacucuuuggcgccauugcugguuucaucgaagggggauggcagggcaugguagacggcugguacggguaucaucacucuaacgaacaaggauccgguuacgccgcagacaaagagucaacacagaaggcuaucgauggcgugaccaauaaagucaacaguauuaucgacaagaugaauacgcaguuugaagccguggggcgggaguucaacaaccuggagcgccgaauugaaaauuuaaacaaaaagauggaggauggauuccuggacguuuggacuuauaaugcggaacuccuugugcugauggagaacgaaagaacauuggauuuucacgacagcaaugucaagaaccuauacgauaaagugaggcugcaacuccgggacaaugccaaggagcugggcaacgguuguuucgaguuuuaccauaaaugcgauaaugaauguauggaguccguacguaacgggaccuaugacuacccucaguauucugaagaggcacgccuuaagagagaggaaauaagcggcguuaaacuggagucaaucggaauuuaccagaucuugaguaucuauuccacuguggcuagcucucucgcccuggcuauuauggucgccggcuuaucacuguggaugugcaguaaugggagccuacagugcaggauauguaucuga

SEQ ID NO: 135882 - RNA, 1695 nt, Artificial Sequence
  derived and/or modified sequence opt3 from hemagglutinin__InfluenzaA__ABW90130
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggagaaaaagcacaaugggaaauugugugauuuagacggagucaagccccugauucuaagagauugcucaguggccgguuggcuccugggcaacccuaugugugacgaauuuaucaauguuccagaauggaguuauauaguggagaaggcgaacccggucaaugaucuuugcuaccccggggacuucaacgauuaugaggaacugaaacauuugcucagcaggaucaaucacuuugagaagauucagaucauuccuaaauccucuuggucgucacaugaagcuagccugggagugaguuccgccuguccauaccagggcaaguucucuuucuuccggaacguaguuuggcugaucaaaaagaauagcaccuaucccacaauaaagcgcuccuacaacaauacuaaccaagaggaccucuuagugcugugggguauucaccacccuaaugaugcagccgagcagaccaaacuuuaucagaacccaacaaccuacaucucagucgggacaaguacuuugaaccagcgacuggugccccguauugcuaccagaagcaaggugaauggacaaucuggcaggauggaauuuuucuggacgauccuaaaaccuaacgacgcaaucaauuuugaguccaacggcaauuucauugccccagaauacgcuuauaagauagucaaaaagggggauucaacuaucaugaaaagcgagcucgaauacggaaacugcaauaccaagugucagacaccgaugggugccauuaacaguucuaugcccuuucauaauauccacccucugacuauaggcgagugcccaaaguauguuaaauccaaccggcuugugcuggcgaccggguugcgcaauagcccccagagagagacaaggggacucuucggcgcaauugccgguuuuaucgaagggggauggcagggcaugguagacggcugguacggguaucaucacucgaacgagcaaggaucugguuacgcugccgacaaggaauccacccagaaagcaaucgauggcgugacgaauaaggucaacucaauuaucgacaaaaugaauacucaguucgaggcuguggggcgggaauuuaacaaccuggagcgccgaauugagaauuuaaacaagaagauggaagauggauuucuggacguuuggacauauaaugccgagcuccuugugcugauggaaaacgagagaaccuuggauuuccacgacaguaaugucaaaaaccuauacgauaaggugaggcugcaacuccgggacaaugcgaaagaacugggcaacgguuguuuugaguucuaccauaagugcgauaaugaguguauggaaagcguacguaacgggacuuaugacuacccucaguauuccgaggaagcccgccuuaaaagagaggagauaucuggcguuaagcuggaaagcaucggaauuuaccagaucuugucaaucuauaguacaguggcauccagccucgcucuggccauuauggucgcuggcuuaucucuguggaugugcucaaaugggagucuacagugcaggauauguaucuga

SEQ ID NO: 135883 - RNA, 1695 nt, Artificial Sequence
  derived and/or modified sequence opt3 from hemagglutinin__InfluenzaA__ABW90132
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggagaaaaagcacaaugggaaauugugugauuuagacggagucaagccccugauucuaagagauugcucaguggccgguuggcuccugggcaacccuaugugugacgaguuuaucaauguuccagaauggaguuauauaguggagaaggcgaacccggucaaugaucuuugcuaccccggggacuucaacgauuaugaggaacugaaacauuugcucagcaggaucaaucacuuugagaagauucagaucauuccuaaauccucuuggucgucacaugaagcuagccugggagugaguuccgccuguccauaccagggcaagucuagcuucuuucggaacguaguuuggcugaucaaaaagaacuccaccuaucccacaauaaagcgcucauacaauaauacuaaccaagaggaccucuuagugcugugggguauucaccacccuaauaacgcagccgagcagaccgaacuuuaucagaacccaacaaccuacaucagugucgggacuagcacauugaaucagcgacuggugccccguauugcuaccagaucuaaagugaacggacaauccggcaggauggaguucuuuuggacgauccuaaagccuaaugaugcaaucaacuucgaaucaaauggcaacuuuauugccccagaguacgcuuauaaaauagucaagaaaggggacagcacuaucaugaagagugaacucgaguacggaaauugcaacaccaaaugucagacaccgaugggugccauuaauucuuccaugcccuuccauaacauccacccucugacuauaggcgagugcccaaaguauguuaagagcaaucggcuugugcuggcgaccggguugcgcaacucgccccagagagaaacaaggggacucuuuggcgcaauugccgguuucaucgaagggggauggcagggcaugguagauggcugguacggguaucaucacucuaaugaacaaggauccgguuacgcugccgacaaagagucaacccagaaggcaaucgacggcgugacgaacaaagucaauaguauuaucgauaagaugaacacucaguuugaagcuguggggcgggaguucaacaaucuggagcgccgaauugaaaacuuaaauaaaaagauggaggacggauuccuggauguuuggacauauaacgccgaacuccuugugcugauggagaaugaaagaaccuuggacuuucacgauagcaacgucaagaaucuauacgacaaagugaggcugcaacuccgggauaacgcgaaggagcugggcaaugguuguuucgaguuuuaccauaaaugcgacaacgaauguauggaguccguacguaaugggacuuaugauuacccucaguauucugaagaggcccgccuuaagagagaggaaauaagcggcguuaaacuggagucaaucggaauuuaccagaucuugaguaucuauuccacaguggcaagcucucucgcucuggccauuauggucgcuggcuuaucacuguggaugugcaguaacgggagccuacagugcaggauauguaucuga

SEQ ID NO: 135884 - RNA, 1695 nt, Artificial Sequence
  derived and/or modified sequence opt3 from hemagglutinin__InfluenzaA__ABW90133
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggagaaaaagcacaaugggaaauugugugauuuagacggagucaagccccugauucuaagagauugcucaguggccgguuggcuccugggcaacccuaugugugacgaauuuaucaauguuccagaauggaguuauauaguggagaaggcgaacccggucaaugaucuuugcuaccccggggacuucaacgauuaugaggaacugaaacauuugcucagcaggaucaaucacuuugagaagauucagaucauuccuaaauccucuuggucgucacaugaagcuagccugggagugaguuccgccuguccauaccagggcaagcccucuuucuuucggaacguaguuuggcugaucaaaaagaauagcaccuauccuacaauaaagcgcuccuacaacaauacuaaccaagaggaccucuuagugcugugggguauucaccacccaaaugaugcagccgagcagaccaaacuuuaucagaaccccacaaccuacaucucagucgggacaaguacuuugaaccagcgacuggugccucguauugcuaccagaagcaaggugaauggacaaucuggcaggauggaguucuuuuggacgauccuaaaaccaaacgacgcaaucaauuucgaauccaacggcaauuuuauugccccggaauacgcuuauaagauagucaaaaagggggauucaacuaucaugaaaagcgagcucgaauacggaaacugcaauaccaagugucagacacccaugggugccauuaacaguucuaugccuuuccauaauauccacccacugacuauaggcgagugccccaaguauguuaaauccaaccggcuugugcuggcgaccggguugcgcaauagcccucagagagagacaaggggacucuuuggcgcaauugccgguuucaucgaagggggauggcagggcaugguagacggcugguacggguaucaucacucgaacgagcaaggaucugguuacgcugccgacaaggaauccacccagaaagcaaucgauggcgugacgaauaaggucaacucaauuaucgacaaaaugaauacucaguuugaggcuguggggcgggaguucaacaaccuggaacgccgaauugagaauuuaaacaagaagauggaagauggauuccuggacguuuggacauauaaugccgagcuccuugugcugauggaaaacgagagaaccuuggauuuucacgacaguaaugucaaaaaccuauacgauaaggugaggcugcaacuccgggacaaugcgaaagaacugggcaacgguuguuucgaguuuuaccauaagugcgauaaugaguguauggaaagcguacguaacgggacuuaugacuacccacaguauuccgaggaagcccgccuuaaaagagaggagauaucuggcguuaagcuggaaagcaucggaauuuaccagaucuugucaaucuauaguacaguggcauccagccucgcucuggccauuauggucgcuggcuuaucucuguggaugugcucaaaugggagucuacagugcaggauauguaucuga

SEQ ID NO: 135885 - RNA, 1695 nt, Artificial Sequence
  derived and/or modified sequence opt3 from hemagglutinin__InfluenzaA__ABW90134
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggagaaaaagcacaaugggaaauugugugauuuagacggagucaagccccugauucuaagagauugcucaguggccgguuggcuccugggcaacccuaugugugacgaauuuaucaauguuccagaauggaguuauauaguggagaaggcgaacccggucaaugaucuuugcuaccccggggacuucaacgauuaugaggaacugaaacauuugcucagcaggaucaaucacuuugagaagauucagaucauuccuaaauccucuuggucgucacaugaagcuagccugggagugaguuccgccuguccauaccaggagaagucuagcuucuuucggaacguaguuuggcugaucaaaaagaacuccaccuaucccacaauaaagcgcucauacaauaauacuaaccaagaggaccucuuagugcuguggggcauucaccacccuaaugaugcagccgaacagaccaaacuuuaucagaacccaacaaccuacaucagugucgguacuagcacauugaaccagcgacuggugccccguauugcuaccagaucuaaggugaaugggcaauccggaaggauggaguucuuuuggacgauccuaaaaccuaacgacgcaaucaauuucgaaucaaacggcaauuuuauugccccagaguacgcuuauaagauagucaaaaagggcgauagcacuaucaugaaaagugaacucgaguacgggaacugcaauaccaagugucagacaccgaugggagccauuaacucuuccaugcccuuccauaauauccacccucugacuauaggugagugcccaaaguauguuaaaagcaaccggcuugugcuggcgaccggcuugcgcaauucgccccagagagaaacaagggggcucuuuggagcaauugccggcuucaucgaggguggguggcagggaaugguagacggcugguacggcuaucaucacucuaacgaacaaggguccggauacgcugccgacaaggagucaacccagaaagcaaucgauggugugacgaauaaggucaacaguauuaucgacaaaaugaauacucaguuugaagcugugggccgggaguucaacaaccuggagcgccgaauugaaaauuuaaacaagaagauggaggauggguuccuggacguuuggacauauaaugccgaacuccuugugcugauggagaacgaaagaaccuuggauuuucacgacagcaaugucaaaaaccuauacgauaaggugaggcugcaacuccgggacaaugcgaaagagcugggaaacggcuguuucgaguuuuaccauaagugcgauaaugaauguauggaguccguacguaacgguacuuaugacuacccucaguauucugaagaggcccgccuuaaaagagaggaaauaagcgggguuaagcuggagucaaucggcauuuaccagaucuugaguaucuauuccacaguggcaagcucucucgcucuggccauuauggucgcuggauuaucacuguggaugugcaguaauggcagccuacagugcaggauauguaucuga

SEQ ID NO: 135886 - RNA, 1695 nt, Artificial Sequence
  derived and/or modified sequence opt3 from hemagglutinin__InfluenzaA__ABW90135
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggaaaagaagcacaaugggaaauugugugauuuagacggagucaagccccugauucuaagagauugcucaguggccgguuggcuccugggcaacccuaugugugacgaguuuaucaauguuccagaauggaguuauauaguggagaaggcgaacccggucaaugaucuuugcuaccccggggacuucaacgauuaugaggaacugaaacauuugcucagcaggaucaaucacuuugagaagauucagaucauuccuaaauccucuuggucgucacaugaagcuagccugggagugaguuccgccuguccauaccagggcaagucuagcuucuuucggaacguaguuuggcugaucaauaaaaacuccaccuaucccacaauaaagcgcucauacaauaacacuaaucaagaggaccucuuagugcugugggguauucaccacccuaacgaugcagccgagcagaccaaacuuuaucagaacccaacaaccuacaucagugucgggacuagcacauugaaucagcgacuggugccccguauugcuaccagaucuaaagugaacggacaauccggcaggauggaguucuuuuggacgauccuaaagccuaaugacgcaaucaacuucgaaucaaauggcaacuuuauugccccagaauacgcuuauaaaauagucaagaaaggggauagcacuaucaugaagagugagcucgaauacggaaauugcaacaccaaaugucagacaccgaugggugccauuaauucuuccaugcccuuccauaacauccacccucugacuauaggcgagugcccaaaguauguuaagagcaaucggcuugugcuggcgaccggguugcgcaacucgccccagagagagacaaggggacucuuuggcgcaauugccgguuucaucgaagggggauggcagggcaugguagacggcugguacggguaucaucacucuaaugagcaaggauccgguuacgcugccgacaaagaaucaacccagaaggcaaucgauggcgugacgaacaaagucaauaguauuaucgacaagaugaacacucaguuugaggcuguggggcgggaguucaacaaucuggaacgccgaauugagaacuuaaauaaaaagauggaagauggauuccuggacguuuggacauauaacgccgagcuccuugugcugauggaaaaugagagaaccuuggauuuucacgacagcaacgucaagaaucuauacgauaaagugaggcugcaacuccgggacaacgcgaaggaacugggcaaugguuguuucgaguuuuaccauaaaugcgauaacgaguguauggaauccguacguaaugggacuuaugacuacccucaguauucugaggaagcccgccuuaagagagaggagauaagcggcguuaaacuggaaucaaucggaauuuaccagaucuugaguaucuauuccacaguggcaagcucucucgcucuggccauuauggucgcuggcuuaucacuguggaugugcaguaacgggagccuacagugcaggauauguaucuga

SEQ ID NO: 135887 - RNA, 1695 nt, Artificial Sequence
  derived and/or modified sequence opt3 from hemagglutinin__InfluenzaA__HB649491
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggagaaaaagcacaaugggaaauugugugauuuagacggagucaagccccugauucuaagagauugcucaguggccgguuggcuccugggcaacccuaugugugacgaauuuaucaauguuccagaauggaguuauauaguggagaaggcgaacccggucaaugaucuuugcuaccccggggacuucaacgauuaugaggaacugaaacauuugcucagcaggaucaaucacuuugagaagauucagaucauuccuaaauccucuuggucgucacaugaagcuagccugggagugaguuccgccuguccauaccagggcaagucuagcuucuuucggaacguaguuuggcugaucaaaaagaacuccaccuaucccacaauaaagcgcucauacaauaauacuaaccaagaggaccucuuagugcugugggguauucaccacccuaaugaugcagccgagcagaccaaacuuuaucagaacccaacaaccuacaucagugucgggacuagcacauugaaccagcgacuggugccccguauugcuaccagaucuaaggugaauggacaauccggcaggauggaguucuuuuggacgauccuaaaaccuaacgacgcaaucaauuucgaaucaaacggcaauuuuauugccccagaauacgcuuauaagauagucaaaaagggggauagcacuaucaugaaaagugagcucgaauacggaaacugcaauaccaagugucagacaccgaugggugccauuaacucuuccaugcccuuccauaauauccacccucugacuauaggcgagugcccaaaguauguuaaaagcaaccggcuugugcuggcgaccggguugcgcaauucgccccagagagagacaaggggacucuuuggcgcaauugccgguuucaucgaagggggauggcagggcaugguagacggcugguacggguaucaucacucuaacgagcaaggauccgguuacgcugccgacaaggaaucaacccagaaagcaaucgauggcgugacgaauaaggucaacaguauuaucgacaaaaugaauacucaguuugaggcuguggggcgggaguucaacaaccuggaacgccgaauugagaauuuaaacaagaagauggaagauggauuccuggacguuuggacauauaaugccgagcuccuugugcugauggaaaacgagagaaccuuggauuuucacgacagcaaugucaaaaaccuauacgauaaggugaggcugcaacuccgggacaaugcgaaagaacugggcaacgguuguuucgaguuuuaccauaagugcgauaaugaguguauggaauccguacguaacgggacuuaugacuacccucaguauucugaggaagcccgccuuaaaagagaggagauaagcggcguuaagcuggaaucaaucggaauuuaccagaucuugaguaucuauuccacaguggcaagcucucucgcucuggccauuauggucgcuggcuuaucacuguggaugugcaguaaugggagccuacagugcaggauauguaucuga

SEQ ID NO: 135888 - RNA, 1683 nt, Artificial Sequence; identical to SEQ ID NO: 132004
  derived and/or modified sequence opt3 from hemagglutinin__InfluenzaA__EPI439507

SEQ ID NO: 135889 - RNA, 1701 nt, Artificial Sequence
  derived and/or modified sequence opt3 from hemagglutinin__InfluenzaA__EPI482777
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaaaauagacacaacgggaagcuauguaaacucaggggaguggcgccccugcaucuugguaagugcaauauagcuggcuggcuguuggggaacccugagugugaaucucucucaaccgccaguagcugguccuacaucguugagacuucuaauucggauaacggaacaugcuauccaggcgacuuuauuaauuacgaagaacugcgggagcagcugucaagcgugaguuccuucgaacgcuuugagaucuucccgaaaaccucuagcuggcccaaccacgauacgaaucgaggugucacugcagccuguccucaugcuggggcaaacuccuuuuaucguaaucucgugugguuaguaaagaagggaaacucauacccaaaaauuaacaagaguuauaucaauaacaaagaaaaggagguucuggugcuuugggccauacaccaccccagcaccucugcugaccaacaguccuuguaccagaaugccgaugcguacgucuucgugggcucaagcagauauaguaggaaauuugagccugaaaucgcaacacggccaaaggugcgcgaccaggccggcagaaugaacuacuauuggacucuggucgagcccggggauaagauuaccuucgaagcuacaggaaaucuaguugccccuagguacgcauuugcucucaaacggaacucugguuccggcaucauuaucagcgacaccucggugcaugauugcgacacgacuugucaaacaccaaauggggccauaaacaccucucugccguuccagaauauucaccccguaacuaucggagagugcccuaaguaugugaaauccacaaaguuacgcauggcgaccggccugcgaaacauuccaucaauccagaguagagguuuguuuggggccaucgcaggauucauugaaggcggcuggacggggaugauagauggaugguacgguuaucaucaccagaaugagcaaggcagcggguacgcugccgaccucaaauccacccagaacgcuaucgacggaauuacaaauaaggucaacucugugaucgagaaaaugaauacucaguuuaccgccguuggcaaggaguucagccaccuggagaggcggauagaaaacuuaaacaagaaaguggaugacgguuuccuggauauuuggacauacaaugcagagcuccuuguccuguuggaaaacgagcguacucuagacuaucaugauucaaaugugaagaaccuguacgagaaaguacgcagucagcucaagaauaacgccaaagaaaucgggaauggcuguuuugaguucuaucacaagugcgacgauauguguauggaauccguuaagaacggaaccuacgacuaucccaaauacagcgaggaagcuaagcugaauagagaggagaucgauggcgugaaacuugaaucuacaaggauuuaucaaauccuggcgauuuacucaaccgucgcaaguagcuuggugcucgucgugucccugggggccauaucuuuuuggaugugcucgaacggaagccuucagugccggaucuguauuuga

SEQ ID NO: 135890 - RNA, 1701 nt, Artificial Sequence; identical to SEQ ID NO: 127600
  derived and/or modified sequence opt3 from hemagglutinin__InfluenzaA__EPI745532

SEQ ID NO: 135891 - RNA, 1701 nt, Artificial Sequence
  derived and/or modified sequence opt3 from hemagglutinin__InfluenzaA__EPI278594
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccgaucacgaaucaaauaagggugucaccgccgcuuguccucaugcaggggccaaaaguuuuuauaagaaccugaucuggcucgugaaaaagggaaauagcuacccaaaauuaucuaaguccuauauaaacgacaagggcaaagagguacugguucuuuggggcauccaccaccccucaacgagcgcugaucaacagaguuuguaccagaaugccgacgcguacguguucgucgggacuucucgcuauuccaagaaauuuaagccugagauugcaauccgaccaaaagugcgugaucaggaaggaagaaugaacuacuauuggacccugguggagcccggugacaagauuacauucgaagccacuggcaaucuagucguuccuagguacgcuuuugccauggagcggaacgcagggagcggaaucauaauuucggauaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgagcaaggaagcggcuacgcagcugaucucaaauccacccagaaugccauugacaagaucacgaacaaaguuaauucugugauagagaagaugaacacccaguuuacagcuguggguaaggaguucaaucaccuggagaaacggauugaaaacuuaaauaagaaagucgaugacggguuccuggauaucuggacuuacaacgccgagcuccuugugcuguuggaaaaugagcgcacccuagacuaucaugauagcaacguaaagaaucuguacgagaaaguucgaucacagcucaagaacaacgcaaaggaaaucggcaauggauguuuugaguucuaucacaaaugcgacaacacauguauggaaagugugaagaauggcacuuacgauuauccuaaauacuccgaggaagccaagcugaacagagaggagauugacggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 135892 - RNA, 1701 nt, Artificial Sequence
  derived and/or modified sequence opt3 from hemagglutinin__InfluenzaA__AEE69009
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaggagcucagggagcagcugucaagcgugaguuccuucgaacgguuugagauuuuccccaagacaucuagcuggccuaaucacgauuccaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuccaacguccgcugaucaacagucauuguaccagaacgccgacacuuacguguucgucgggagcagucgcuauucuaagaaauuuaagcccgagauugcgauccgaccuaaagugcgugaucaggagggaagaaugaauuacuauuggacccugguggaaccaggugacaagauuacauucgaggcaacuggcaaccuagucguuccgagguacgccuuugcuauggaacggaacgccggguccggaaucauaauuagcgauacccccgugcaugacugcaauacaaccugucaaacgccuaaaggcgcaaucaacacuucgcucccauuccagaauauucaccccaucacaaucgguaagugcccuaaguauguaaaaucuaccaagcugcgccuugcuacugggcugagaaacauuccauccauacagucaaggggauuguuuggcgccaucgcgggcuucauugaagggggauggacagguaugguggacggcugguacggguaucaucaccagaaugaacaaggaaguggcuacgccgcagaucucaaaagcacccagaacgcuaucgacgagauaacgaauaaggucaacuccgugauugagaaaaugaauacccaguuuacagccguugguaaggaguucaaccaccuggaaaagcggaucgaaaauuuaaacaaaaagguggaugacggguuccuggauaucuggacuuacaaugcugagcuccuuguccuguuggaaaacgagcgcacccuagacuaucaugauucuaaugugaaaaaccuguacgagaagguacgaagccagcucaaaaacaaugccaaggaaauuggcaacggauguuuugaguucuaucacaagugcgacaauacauguauggaaucaguuaaaaacggcacuuacgauuaucccaaguacagugaggaagcaaaacugaauagagaggagaucgacggggugaaacuugaauccaccaggauuuaucaaauacuggccaucuacagcacagucgcuucuucauuggugcucgucgugagucugggagcgauuagcuuuuggaugugcuccaacgguucuuuacagugccggaucuguaucuga

SEQ ID NO: 135893 - RNA, 1701 nt, Artificial Sequence; identical to SEQ ID NO: 124967
  derived and/or modified sequence opt3 from hemagglutinin__InfluenzaA__GQ280797

SEQ ID NO: 135894 - RNA, 1701 nt, Artificial Sequence; identical to SEQ ID NO: 124700
  derived and/or modified sequence opt3 from hemagglutinin__InfluenzaA__EPI178457

SEQ ID NO: 135895 - RNA, 1701 nt, Artificial Sequence; identical to SEQ ID NO: 124700
  derived and/or modified sequence opt3 from hemagglutinin__InfluenzaA__EPI176470

SEQ ID NO: 135896 - RNA, 1701 nt, Artificial Sequence
  derived and/or modified sequence opt3 from hemagglutinin__InfluenzaA__EPI280341
augaaggccauccuggugguccuccuucacaccuucgcuacagcaaacgccgacacucugugcauuggcuaccaugcgaauaacagcacggauaccguugacacaguguuggagaagaauguaacugugacccacuccgucaacuuacuggaagauaagcauaaugggaaacuauguaagcucagaggaguggcuccccugcaccuugguaaaugcaacauagccggcuggauccuggggaauccugagugugaaucuuugucaacagcaaguagcugguccuauauuguugagaccucuucgucagacaacggaacuugcuacccaggcaauuuuaucgauuaugaggagcucagggagcagcugagcaguguguccucuuucgaacgguuugagauuuucccgaagacaagcuccuggcccgaccaugauucaaacaagggugucaccgccgcuuguccucacgcaggggccaaaaguuuuuacaagaaucugaucuggcucgugaaaaagggaaacagcuauccaacguuaucuaaauccuacauaaaugacaagggcaaggaaguacugguucuuuggggcauccaccaucccucaacuagcgcugaucaacagaguuuguaucagaacgccgacgcguacguguucgucgggaccucucgcuacuccaaaaaguuuaaaccugagauugcaauccgaccaaaggugcguaaucaggagggaagaaugaacuauuacuggacacugguggaacccggugauaaaauuacuuucgaggccaccggcaaccuagucgcuccuagguaugccuuugcaauggaacggaaugcugggagcggaaucauaauuucggacacaccaguucacgauugcaacaccacgugucaaacuccgaagggcgccaucaauacaucucuccccuuccagaacauucauccuaucaccaucgguaaaugcccaaaguacgugaaguccacuaaacugcgccuugcgacagggcugagaaauguacccucaauucagaguaggggauuguuuggcgccauagcaggcuucaucgaagggggauggaccgguaugguggacggcugguauggguaccaccaccagaacgaacaaggaagcggcuaugcugccgaccucaaguccacgcagaaugcuauugauaaaaucaccaacaaggucaauucugugauagagaaaaugaacacacaguuuacugccguugguaaggaguucaaucaucuggaaaagcggauugagaacuuaaauaaaaagguggacgauggguuccuggacaucuggaccuacaacgcagaacuccuuguccuguuggagaaugaacgcacacuagauuaccacgacagcaacgugaaaaaccuguaugagaagguacgaucacagcucaaaaauaacgccaaggagaucggcaauggauguuuugaguucuaccauaagugcgauaacacuuguauggaaaguguuaaaaauggcaccuaugacuacccuaaguauuccgaagaggcuaaacugaacagagaagagauugauggggugaaacuugagagcacaaggaucuaccaaauucuggcgauauauucuaccgucgcaucaaguuuggugcucgucgugagccugggagccaucuccuuuuggaugugcucuaaugguucguuacagugccggauuuguaucuga

SEQ ID NO: 135897 - RNA, 1701 nt, Artificial Sequence
  derived and/or modified sequence opt3 from hemagglutinin__InfluenzaA__EPI240319
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugauagagagggaaggaugaauuacuauuggacuuugguggaacccggugacaagaucaccuucgaggccacaggcaaccuggucguuccucgguacgcuuuugccauggaacgcaacgcagggucgggaauaauuaucucugauacuccagugcaugacugcaauaccacaugucagaccccgaaaggcgcuauuaacacgucccuacccuuccaaaauauccacccuaucacuauugguaagugcccaaaguauguaaaaucaacaaagcucagacuggccaccgggcuuaggaacgugcccaguauacagagccggggacuguuuggcgcgaucgccggcuucauugaagggggauggacugguauggucgacggcugguacggguaucaucaccagaaugaacagggauccggcuacgcagcugauuugaaaucuacacaaaacgccaucgacgagauaaccaauaaggugaacagcguuauugagaaaaugaauacgcaguuuaccgcuguggguaaggaguucaaccaccucgagaagcgcaucgaaaaucugaacaaaaaggucgaugacggguucuuagauaucuggacauacaaugccgagcugcucgugcuucuggaaaacgagcgaacuuuggacuaucaugauucaaauguuaaaaaccuauacgagaagguaagaagucagcugaaaaacaaugcaaaggaaauuggcaacggauguuuugaguucuaucacaagugcgacaauaccuguauggaauccgugaaaaacggcacauacgauuauccuaaguacagcgaggaagccaaacucaauagggaggagaucgacggggucaagcuggaaucuacucggauuuaucagauacuugcuaucuacucaaccguggcgaguagccuggucuuggugguuucccucggagcaauuucuuuuuggaugugcucgaacgguagccugcaaugccguaucuguaucuga

SEQ ID NO: 135898 - RNA, 1701 nt, Artificial Sequence; identical to SEQ ID NO: 124865
  derived and/or modified sequence opt3 from hemagglutinin__InfluenzaA__EPI183134

SEQ ID NO: 135899 - RNA, 1701 nt, Artificial Sequence
  derived and/or modified sequence opt3 from hemagglutinin__InfluenzaA__EPI368693
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccaguuguccucaugcuggggcaaagagcuuuuauaaaaaucugauauggcuggugaaaaagggaaacucuuacccaaaacucuccaagucauauaucaaugacaagggcaaagaaguauuaguucuguggggcauucaccaccccagcacgagugccgaucaacagucucuuuaccagaacgcugacgccuacguguucgucggguccagccgcuauucgaagaaauuuaagccugagaucgcgauucgaccaaaagugcguggacaggaggguagaaugaauuacuauuggacuuugguggaacccggcgauaagaucaccuucgaggcaacagggaaccuggucguuccuagguacgccuuugcuauggaacggaacgccggaucuggcauaauuaucuccgacacuccagugcaugauugcaauaccacaugucaaaccccgaaaggugcaauuaacacgucacuacccuuccagaauauccacccuaucacuauugggaagugcccaaaguauguaaaaaguacaaagcuccgccuggcuaccggacuuagaaacgugcccagcauacaguccaggggccuguuuggcgccaucgcgggguucauugagggagguuggacuggcauggucgacgggugguacggauaucaucaccagaaugaacaaggcucugguuacgccgcagacuugaaaagcacacagaacgcuaucgaugagauaaccaauaaggugaacucaguuauugagaaaaugaauacgcaguuuaccgccguggggaaggaguucaaccaccucgaaaagcggaucgaaaaucugaacaaaaaggucgacgauggcuucuuagacaucuggacauacaaugcugagcugcucgugcuucuggaaaacgagcgcacuuuggauuaucaugacaguaauguuaaaaaccuauacgagaagguacgaucccagcugaaaaacaaugccaaggaaauuggaaacggcuguuuugaguucuaucacaagugcgauaauaccuguauggaaagcgugaaaaacgggacauacgacuauccuaaguacucugaggaagcaaaacucaauagagaggagaucgauggagucaagcuggaaucaacuaggauuuaucaaauacuugccaucuacaguaccguggcuagcucccuggucuuggugguuucucucggugcgauuucguuuuggaugugcagcaacggcucccugcagugccggaucuguaucuga

SEQ ID NO: 135900 - RNA, 1701 nt, Artificial Sequence
  derived and/or modified sequence opt3 from hemagglutinin__InfluenzaA__EPI291788
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaaaauagacacaacgggaagcuauguaaacucaggggaguggcgccccugcaucuugguaagugcaauauagcuggcuggcuguuggggaacccugagugugaaucucucucaaccgccaguagcugguccuacaucguugagacuucuaauucggauaacggaacaugcuauccaggcgacuuuauuaauuacgaagaacugcgggagcagcugucaagcgugaguuccuucgaacgcuuugagaucuucccgaaaaccucuagcuggcccaaccacgauacgaaucgaggugucacugcagccuguccucaugcugggaccaacuccuuuuaucguaaucucauuugguuagugaagaagggaaacucauacccaaaaaucaacaagaguuauauaaauaacaaagaaaaggagguacugguucuuugggcaauccaccaccccagcacaucugccgaccaacaguccuuguaccagaaugcugaugccuacguguucgucggcucaagcagauauaguaggaaauuugagccugaaauugcgacucggccaaaggugcgcgaccaggcaggcagaaugaacuacuauuggacccugguggagcccggggauaagaucacauucgaagccaccggaaaucuagucguuccuagguacgcuuuugcccucaaacggaacucugguuccggcauuaucauaagcgacacgucggugcaugauugcgacacuacaugucaaaccccaaauggggcaauuaacacuucucugccguuccagaauauccaccccguaacaauuggagagugcccuaaguaugugaaauccaccaaguuacgcauggcuacgggccugcgaaacaucccaucaauccagaguagagguuuguuuggggccauugcgggauucauagaaggcggcuggaccgggaugaucgauggaugguacgguuaucaucaccagaaugagcaaggcagcggguacgccgcagaccucaaauccacacagaacgcuauugacggaaucacuaauaaggucaacucugugauagagaaaaugaauacccaguuuacagccguuggcaaggaguucagccaccuggagaggcggauugaaaacuuaaacaagaaaguggaugacgguuuccuggauaucuggacuuacaaugcugagcuccuuguccuguuggaaaacgagcguacccuagacuaucaugauucaaaugugaagaaccuguacgagaaaguacgcagucagcucaagaauaacgccaaagaaaucgggaauggcuguuuugaguucuaucacaagugcgacgauacauguauggaauccguuaagaacggaaccuacgacuaucccaaauacagcgaggaagcaaagcugaauagagaggagauugauggcgugaaacuugaaucuacuaggaucuaucaaauucuggccauauacucaacggucgcuaguagcuuggugcucgucgugucccugggggcgaucucuuuuuggaugugcucgaacggaagccuucagugccggauuuguaucuga

SEQ ID NO: 135901 - RNA, 1701 nt, Artificial Sequence
  derived and/or modified sequence opt3 from hemagglutinin__InfluenzaA__EPI482788
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaaaauagacacaacgggaagcuauguaaacucaggggaguggcgccccugcaucuugguaagugcaauauagcuggcuggcuguuggggaacccugagugugaaucucucucaaccgccaguagcugguccuacaucguugagacuucuaauucggauaacggaacaugcuauccaggcgacuuuauuaauuacgaagaacugcgggagcagcugucaagcgugaguuccuucgaacgcuuugagaucuucccgaaaaccucuagcuggcccaaccacgauacgaaucgaggugucacugcagccuguccucaugcugggaccaacuccuuuuaucguaaucucauuugguuagugaagaagggaaacucauacccaaaaaucaacaagaguuauauaaauaacaaagaaaaggagguacugguucuuugggcaauccaccaccccagcacaucugccgaccaacaguccauuuaccagaaugcugaugccuacguguucgucggcucaagcagauauaguaggaaauuugagccugaaaucgcgacucggccaaaggugcgcgaccaggcaggcagaaugaacuacuauuggaccuugguggagcccggggauaagauuacauucgaagccaccggaaaucuggucguuccuagguacgcuuuugcccuaaaacggaacucugguuccggcaucauaauuagcgacacgucggugcaugauugcgacacuacaugucaaaccccaaauggggcaaucaacacuucucucccguuccagaauauucaccccguaacaaucggagagugcccuaaguaugugaaauccaccaagcugcgcauggcuacgggccuucgaaacaucccaucaauucagaguagaggucuguuuggggccauagcgggauucaucgaaggcggcuggaccgggaugauugauggaugguacgguuaucaucaccagaaugagcaaggcagcggguacgccgcagacuugaaauccacacagaacgcuaucgacggaauaacuaauaaggucaacucugugauugagaaaaugaauacccaguuuacagccguuggcaaggaguucagccaccucgagaggcggaucgaaaaccugaacaagaaaguggaugacgguuucuuagauaucuggacuuacaaugcugagcugcucguccuucuggaaaacgagcguaccuuggacuaucaugauucaaaugugaagaaccuauacgagaaaguacgcagucagcugaagaauaacgccaaagaaauugggaauggcuguuuugaguucuaucacaagugcgacgauacauguauggaauccguuaagaacggaaccuacgacuaucccaaauacagcgaggaagcaaagcucaauagagaggagaucgauggcgugaaacuggaaucuacuaggauuuaucaaauacuugccaucuacucaacggucgcuaguagccugguguuggucgugucccucggggcgauuucuuuuuggaugugcucgaacggaagccugcagugccggaucuguaucuga

SEQ ID NO: 135902 - RNA, 1701 nt, Artificial Sequence
  derived and/or modified sequence opt3 from hemagglutinin__InfluenzaA__EPI178946/m1
augaaggccaucauugugguccugcucuacaccuucgcuacagcagacgccgauacucuuugcauaggcuaucacgcgaacaauagcacggacaccguugauacagugcuggagaaaaacguaacugugacccauuccgucaauuuguuagaaaacaagcacgacgggaaacuguguaagcuaagaggaguggcuccccuccaucuggguaaaugcaauaucgccggcuggcuucuggggaacccugagugugaaucuuuguuuacagcaucaaguuggagcuacauuguugagaccccaaauuccgauaacggaacuugcuauccgggcgacuucaucaauuacgaagaacucagggagcaccugucuucggugagcucauuugaacgguucgagauuuuucccaaggccaacaguuggccuaaucaugauacaaacaagggugucaccgcugcauguccauaugccggggcuaauuccuucuaccgcaaccugaucuggcucgugaaaaagggaaauucuuaucccaaauuaagcaaguccuacauaaacaacaaaaagaaggaaguacugguuaucuggggcauucaccacccuccaacgucaacugaccagcaaacccuuuaccagaaugccgaugcguauguguuugucggcaguagcaaauacucuaagcgauucaaacccgagaucgcagcccguccuaaggugagaaaccaggcugggaggaugaauuauuacuggacauugauugagccaggagacacuaucaccuuugaagccacagguaaccugguggucccgcgguaugcauucgcuaugaaacgcggcuccgggucaggaauaauuguuagcgaugcccccgugcaugacugcaauaccacgugucagacuccuaagggcgcgaucaacacaagucuaccauuucaaaauauucaccccguaaccaucggugagugcccuaaauacgugaagucuacuaagcucagaauggccacagggcugaggaacaucccauccauucagagccggggacuuuucggcgcaauagcuggcuuucuggaagggggauggaccgguaugaucgauggcugguauggguaccaucaccagaaugagcagggaucgggcuacgccgcugaccaaaaaucuacgcagaacgccauugacgguaucaccaauaaggucaacuccauaauugagaaaaugaauacacaguucacugcaguggggaaggaguucaaccaguuggagaaacgcaucgaaucacucaauaacaagguugaugacggcuuucuggauaucuggaccuauaacgccgagauguuagugcugcucgaaaaugagcgaacacuugacuaccacgauaguaacgucaagaaucuguaugaaaaagugagaagccaauugaagaacaaugcuaaagagauuggaaacggcuguuucgaguuuuaccauaagugcgacaauacuuguauggaauccguuaaaaacgggaccuaugauuaccccaaguauucugaggaagcgaagcuaaauagggaggaaaucgacggaguaaaacuggagagcgcacggauuuaccagauacucgccaucuacucaacaguggcuaguucccugguccuucuggugagcuugggugccgucucuuucuggaugugcucaaacggcagucuccagugccguauuuguaucuga

SEQ ID NO: 135903 - RNA, 1701 nt, Artificial Sequence
  derived and/or modified sequence opt3 from hemagglutinin__InfluenzaA__EPI482791/m2
augaaggccaucauugugguccugcucuacaccuucgcuacagcagacgccgauacucuuugcauaggcuaucacgcgaacaauagcacggacaccguugauacagugcuggagaaaaacguaacugugacccauuccgucaauuuguuagaaaacaagcacgacgggaaacuguguaagcuaagaggaguggcuccccuccaucuggguaaaugcaauaucgccggcuggcuucuggggaacccugagugugaaucuuuguuuacagcaucaaguuggagcuacauuguugagaccccaaauuccgauaacggaacuugcuauccgggcgacuucaucaauuacgaggagcucagggagcaccugucuucggugagcucauuugaacgguucgagauuuuucccaaggccaacaguuggccuaaucaugaaacaaacaagggugucaccgcugcauguccauaugccggggcuaauuccuucuaccgcaaccugaucuggcucgugaaaaagggaaauucuuaucccaaauuaagcaaguccuacauaaacaacaaaaagaaggagguacugguuaucuggggcauucaccacccuccaacgucaacugaucagcaaacccuuuaccagaaugccgacgcguauguguuugucggcaguagcaaauacucuaagcgauucaaacccgagaucgcagcccguccuaaggugagaaaccaggcugggaggaugaauuauuacuggacauugauugaaccaggagauacuaucaccuuugaggccacagguaaccugguggucccgcgguaugcauucgcuaugaaacgcggcuccgggucaggaauaauuguuagcgacgcccccgugcaugauugcaauaccacgugucagacuccuaagggcgcgaucaacacaagucuaccauuucaaaauauucaccccguaaccaucggugaaugcccuaaauacgugaagucuacuaagcucagaauggccacagggcugaggaacaucccauccauucagagccggggacuuuucggcgcaauagcuggcuuucuggaagggggauggaccgguaugaucgacggcugguauggguaccaucaccagaaugaacagggaucgggcuacgccgcugaucaaaaaucuacgcagaacgccauugacgguaucaccaauaaggucaacuccauaauugagaaaaugaauacacaguucacugcaguggggaaggaguucaaccaguuggaaaaacgcaucgagucacucaauaacaagguugacgauggcuuucuggacaucuggaccuauaacgccgaaauguuagugcugcucgagaaugaacgaacacuugauuaccacgacaguaacgucaagaaucuguaugagaaagugagaagccaauugaagaacaaugcuaaagagauuggaaacggcuguuucgaauuuuaccauaagugcgauaauacuuguauggaguccguuaaaaacgggaccuaugacuaccccaaguauucugaagaggcgaagcuaaauagggaagagaucgauggaguaaaacuggagagcgcacggauuuaccagauacucgccaucuacucaacaguggcuaguucccugguccuucuggugagcuugggugccgucucuuucuggaugugcucaaacggcagucuccagugccguauuuguaucuga

SEQ ID NO: 135904 - RNA, 1701 nt, Artificial Sequence
  derived and/or modified sequence opt3 from hemagglutinin__InfluenzaA__EPI291799
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaaaauagacacaacgggaagcuauguaaacucaggggaguggcgccccugcaucuugguaagugcaauauagcuggcuggcuguuggggaacccugagugugaaucucucucaaccgccaguagcugguccuacaucguugagacuucuaauucggauaacggaacaugcuauccaggcgacuuuauuaauuacgaagaacugcgggagcagcugucaagcgugaguuccuucgaacgcuuugagaucuucccgaaaaccucuagcuggcccaaccacgauacgaaucgaggugucacugcagccuguccucaugcugggaccaacuccuuuuaucguaaucucauuugguuagugaagaagggaaacucauacccaaaaaucaacaagaguuauauaaauaacaaagaaaaggagguacugguucuuugggcaauccaccaccccagcacaucugccgaccaacaguccuuguaccagaaugcugaugccuacguguucgucggcucaagcagauauaguaggaaauuugagccugaaauugcgacucggccaaaggugcgcgaccaggcaggcagaaugaacuacuauuggacccugguggagcccggggauaagaucacauucgaagccaccggaaaucuagucguuccuagguacgcuuuugcccucaaacggacgucugguuccggcauuaucauaagcgacacuucggugcaugauugcgacacaaccugucaaacuccaaacggggcaauuaauacaucucugccguuccagaacauccaccccguaaccauuggagagugcccuaaguaugugaaauccacgaaguuacgcauggcuaccggccugcgaaauaucccaucaauccagaguagagguuuguuuggggccauugcgggauucauagaaggcggcuggacagggaugaucgauggaugguacgguuaucaucaccagaacgagcaaggcagcggguacgccgcagaccucaaauccacucagaaugcuauugacggaaucaccaacaaggucaauucugugauagagaaaaugaacacacaguuuacugccguuggcaaggaguucagccaccuggagaggcggauugaaaauuuaaacaagaaaguggaugacgguuuccuggauaucuggaccuacaacgcugagcuccuuguccuguuggaaaaugagcguacacuagacuaucaugauucaaacgugaagaaucuguacgagaaaguacgcagucagcucaagaacaaugccaaagaaaucgggaacggcuguuuugaguucuaucacaagugcgacgauaccuguauggaauccguuaagaauggaacuuacgacuaucccaaauacagcgaggaagcaaagcugaacagagaggagauugauggcgugaaacuugaaucuacgaggaucuaucaaauucuggccauauacucaacagucgcuaguagcuuggugcucgucgugucccugggggcgaucucuuuuuggaugugcucgaauggaagccuucagugccggauuuguaucuga

SEQ ID NO: 135905 - RNA, 1701 nt, Artificial Sequence
  derived and/or modified sequence opt3 from hemagglutinin__InfluenzaA__EPI482799
augaaggccauccuggugguccuccuuuacaccuucacaacugcuaacgcagacacgcugugcauuggauaucacgccaauaacagcaccgauacaguugacacuguguuggagaaaaauguaaccgugacacauuccgucaacuuacuggaaaauagacacaacgggaagcuauguaaacucaggggaguggcgccccugcaucuugguaagugcaauauagcuggcuggcuguuggggaacccugagugugaaucucucucaaccgccaguagcugguccuacaucguugagacuucuaauucggauaacggaacaugcuauccaggcgacuuuauuaauuacgaagaacugcgggagcagcugucaagcgugaguuccuucgaacgcuuugagaucuucccgaaaaccucuagcuggcccaaccacgaaacgaaucgaggugucacugcagccuguccucaugcugggaccaacuccuuuuaucguaaucucauuugguuagugaagaagggaaacucauacccaaaaaucaacaagaguuauauaaauaacaaagagaaggagguacugguucuuugggcaauccaccaccccagcacaucugccgaucaacaguccuuguaccagaaugcugacgccuacguguucgucggcucaagcagauauaguaggaaauuugaaccugagauugcgacucggccaaaggugcgcgaucaggcaggcagaaugaacuacuauuggacccugguggaacccggggacaagaucacauucgaggccaccggaaaucuagucguuccuagguacgcuuuugcccucaaacggacgucugguuccggcauuaucauaagcgauacuucggugcaugacugcgauacaaccugucaaacuccaaacggggcaauuaauacaucucugccguuccagaacauccaccccguaaccauuggagaaugcccuaaguaugugaaauccacgaaacuucgcauggcuaccggccugcgaaauaucccaucaauccagaguagagguuuguuuggggccauugcgggauucauagagggcggcuggacagggaugaucgacggaugguacgguuaucaucaccagaacgagcaaggcagcggguacgccgcagaucucaaauccacucagaaugcuauugacggaaucaccaacaaggucaauucugugauagaaaagaugaacacacaguuuacugccguuggcaaggaguucagccaccuggaaaggcggauugagaauuuaaacaagaaaguggacgaugguuuccuggacaucuggaccuacaacgcugaacuccuuguccuguuggagaaugagcguacacuagauuaucaugacucaaacgugaagaaucuguacgaaaaaguacgcagucagcucaagaacaaugccaaagagaucgggaacggcuguuuugaguucuaucacaagugcgaugacaccuguauggaguccguuaagaauggaacuuacgauuaucccaaauacagcgaagaggcaaagcugaacagagaggaaauugacggcgugaaacuugagucuacgaggaucuaucaaauucuggccauauacucaacagucgcuaguagcuuggugcucgucgugucccugggggcgaucucuuuuuggaugugcucgaauggcagcuuacagugccggauuuguaucuga

SEQ ID NO: 135906 - RNA, 1701 nt, Artificial Sequence
  derived and/or modified sequence opt3 from hemagglutinin__InfluenzaA__EPI291807
augaaggccaucauugugguccugcucuacaccuucgcuacagcagacgccgauacucuuugcauaggcuaucacgcgaacaauagcacggacaccguugauacagugcuggagaaaaacguaacugugacccauuccgucaauuuguuagaaaacaagcacgacgggaaacuguguaagcuaagaggaguggcuccccuccaucuggguaaaugcaauaucgccggcuggcuucuggggaacccugagugugaaucuuuguuugcagccucaaguuggagcuacauuguugagacaccaaauuccgauaacggaaccugcuauccgggcgacuucaucaauuacgaagaacucagggagcaccugucuucggugaguagcuuugaacgguucgagauuuuucccaaggcuaacaguuggccuaaucaugauacuaacaagggugucacagcagccuguccauaugcuggggccaauuccuucuaccgcaaccugaucuggcucgugaaaaagggaaauucuuaucccaaauuaagcaaguccuacauaaacaacaaaaagaaggaaguacugguuaucuggggcauucaccacccuccaaccucaacggaccagcaaacucuuuaccagaaugcggaugcauauguguuugucggcaguagcaaauacucuaagcgauucaaacccgagaucgccgcucguccuaaggugagagaccaggccgggaggauggauuauuacuggaccuugauugagccaggagacacaaucacuuuugaagcaaccgguaaccugguggucccgcgguaugcuuucgccaugaaacgcggcuccgggucaggaauaauuguuagcgaugcgcccgugcaugacugcaauacaaccugucagacgccuaagggcgccaucaacacuucacuaccauuucaaaauauucaccccguaacaaucggugagugcccuaaauacgugaagucuaccaagcucagaauggcaacugggcugaggaacaucccauccauucagagccggggacuuuucggcgcuauagccggcuuuaucgaagggggauggacagguaugauugacggcugguauggguaccaucaccagaaugagcagggaucgggcuacgcugccgaucaaaaaucuacccagaacgcaaucgacgguauaacgaauaaggucaacuccauuaucgagaaaaugaauacccaguucacagccguggggaaggaguucucacagcuggagaaacgcaucgaaaguuugaacaauaagguugaugacggcuuucucgauauuuggacuuauaacgcugagcuguuagugcugcucgaaaaugagcgaacccuugacuaccacgauagcaacgucaagaaccuguaugaaaaagugagaucccaauugaagaauaacgcgaaagagaucggaaauggcuguuucgaguuuuaccauaagugcgacaacacauguauggaaucuguuaaaaaugggacuuaugauuaccccaaguauagcgaggaagcaaagcuaaacagggaggaaauugacggaguaaaacuggagucagcccggauauaccagauccucgcuauuuacaguaccguggccuccagccugguccuucuggugucuuugggugcagucucauucuggaugugcaguaauggcagccuccagugccguaucuguaucuga

SEQ ID NO: 135907 - RNA, 1701 nt, Artificial Sequence
  derived and/or modified sequence opt3 from hemagglutinin__InfluenzaA__EPI638970
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaaaauagacacaacgggaagcuauguaaacucaggggaguggcgccccugcaucuugguaagugcaauauagcuggcuggauccuggggaacccugagugugaaucuuugucaaccgccaguagcugguccuacauuguugagacuucuaauucggaaaacggaacaugcuauccaggcgauuuuaucaauuacgaggagcuccgggaacagcugucaagcgugaguuccuucgagcgcuuugaaauuuucccgaaaaccucuagcuggcccaaccacgacacgaauaagggugucacugcagccuguccucauuccgggaccaacucauuuuaucgaaaucugguguggcucguacaaaagggaaacaguuacccaaaaaucaacaagagcuauauaaauaacaaagagaaugagguuuuagugcugugggcuauccaccaccccucuacauccgcagaucagcagucacuuuacaagaacgccgacgcuuacgucuucgugggcagcagucguuauucuagaaaauuugaaccugagauugccacuaggccaaaggugcgggaucaggcgggccgcaugaauuacuauuggaccuuggucgaacccggggacaagaucacauucgaggcaaccggaaaccugguugccccuagauacgcuuuuacgcuaaaaaggaacuccgguagcggcauuaucauaucggauacuucugugcaugacugcgauacaaccugucaaacuccaaauggggccauuaauacaucccucccguuccagaacauccaccccguaaccauuggagaaugcccuaaguaugugaaaucaacgaagcugcggauggcaaccggccuucgcaauaucccaaguauccagagccgaggucuguuuggggcuauugccggauucauagagggcggcuggacagggaugaucgacggaugguacgguuaucaucaccagaacgagcaaggcuccggguacgcggccgauuugaaaucuacucagaaugcaauugacggaaucaccaacaaggucaauagcgugauagaaaagaugaacacacaguuuacugcuguuggcaaagaguucucacaccucgaaagaaggauugagaaccugaauaagaaaguggacgaugguuucuuagacaucuggaccuacaacgccgaacugcucguccuucuggagaaugagcggacauuggauuaucaugacaguaacgugaagaaucuauacgaaaaaguacguucccagcugaagaacaaugcuaaagagaucgggaacggcuguuuugaguucuaucacaagugcgaugacauguguauggaaagcguuaagaauggaaccuacgauuaucccaaauacucugaagaggccaagcucaaccgcgaggaaauugacggcgugaaacuggagucaacuaagaucuaucaaauucuugcaauauacaguacggucgccagcucccugguguuggucgugucucucggggcuaucucguuuuggaugugcagcaauggaucccugcagugcagaauuuguaucuga

SEQ ID NO: 135908 - RNA, 1701 nt, Artificial Sequence
  derived and/or modified sequence opt3 from hemagglutinin__InfluenzaA__ABI19015
augaaggccaucauugugguccugcucuacaccuucgcuacagcagacgccgauacucuuugcauaggcuaucacgcgaacaauagcacggacaccguugauacagugcuggagaaaaacguaacugugacccauuccgucaauuuguuagaaaacaagcacgacgggaaacuguguaagcuaagaggaaucgcuccccuccaucuggguaaaugcaauauugccggcuggauccuugggaacccugagugugaaucucuguuuacaaccucaaguuggagcuacauuguggagacuccaaauuccgauaacggaacaugcuauccgggcgacuucaucaauuacgaagaguugagggagcaccucucuucgguuaguagcuuugaacgguucgagauauuucccaaggcaaacaguuggccuuaucaugauaccaauaagggugugacggccgcuuguccauacgcaggggccaacuccuucuaucgcaaucugaucuggcuggucaaaaagggaaacucuuaccccaaacucagcaaguccuacauuaauaacaaaaagaaggaaguguuaguaaucuggggcauucaccacccuccaacuucaaccgaccagcaaacacuguaucagaacgcugaugccuacguuuuugugggcaguagcaaauauucuaagcgauucaaacccgagaucgcggcacguccuaaggucagagaccaggccgggaggauggauuacuauuggacucuuauagagccaggagacaccauuacauuugaagcuaccgguaauuugguggugccgcgguacgccuucacgaugaaacgcggcuccgggucaggaaucauugucagcgaugcacccguucaugacugcaacacuacaugucagaccccuaagggcgcuaucaauacuucacugccauuucaaaacauccaccccgugacaauuggugagugcccuaaauauguaaagucuaccaagcuaagaauggccacggggcucaggaauauaccauccauccagagccggggacuguucggcgcgauugccggcuuuaucgaagggggauggaccgguaugauagacggcugguacggguaccaucaccagaacgagcagggaucgggcuaugcagcugaucaaaaaucuacacagaaugccauugacgguaucacuaacaaggucaauuccaucauugaaaagaugaacacccaguucacagcuguggggaaagaguucucacagcuugagaaacgcaucgaaagucugaauaacaagguggaugacggcuuuuuggauauuuggacuuacaaugccgagcuccugguuuuacuggaaaacgagcgaacccucgacuaucacgauagcaaugugaagaaccuuuacgaaaaagucagaucccaacugaagaacaaugcaaaagagauaggaaacggcuguuucgaguuuuaucauaagugcgacgauacauguauggaaucugugaaaaaugggaccuacgacuaucccaaguacagcgaggaagccaaguugaacaggcaggagaucgauggaguaaaacuagaaucagcucggauuuaccagauccuggcgaucuauaguacuguugcauccagccucgugcugcuugucucucugggugccgugucauucuggaugugcaguaauggcagcuugcaaugccguauuuguauauga

SEQ ID NO: 135909 - RNA, 1701 nt, Artificial Sequence
  derived and/or modified sequence opt3 from hemagglutinin__InfluenzaA__EPI687790
augaaggccauccuggugguccuccuuuacaccuucacaacugcuaacgcagacacgcugugcauuggcuaucacgccaauaacagcaccgauacaguugacacuguguuggagaagaauguaaccgugacacauuccgucaacuuacuggaagauaagcacaaugggaaacuauguaagcucggagguguggcgccccugcaucuuggcaaaugcaacauagcuggguggauccugggaaauccugagugugaaucuuugucaaccgccaguagcugguccuacauuguugagacuucuaacucggacaauggcacaugcuauccaggugauuuuaucaacuacgaagaacucagagagcagcugucaagcgugaguuccuucgaaagguuugagauuuucccgaagaccucuagcuggcccaaucacgacuccaacaagggggucacggcagccuguccucaugcuggagcaaaaucauuuuauaagaaucugaucuggcucgugaaaaagggcaacaguuacccaaaauuaaaucaaagcuauauaaacgauaagggcaaggaaguacugguucuuugggggauccaccaccccucuacuaccgccgaccagcaguccuuguaccagaacgcugaugccuacguguucgucggaacaucacgguauagcaaaaaguuuaaaccugagauugcgacucgcccaaaggugcgagaccaagagggucguaugaauuacuauuggacccugguggaacccggcgauaaaaucacauucgaggcaaccgggaaccuagucguuccuagauacgccuuuacgauggaaaggaaugcuggaaguggcauuaucauaucugacacuccagugcaugauugcaacacaaccugucagacuccggagggugccauuaauacaucccuccccuuccagaacauccacccuauuaccaucgggaagugcccaaaauauguaaagagcacgaagcugcggcuugcaaccggacugcgcaaugugcccucgauccagucuagaggcuuguuuggcgcuauugccggguucauagaaggagguuggacaggcauggucgacgggugguacggauaucaucaccaaaacgagcagggcuccgguuacgcggccgaccucaaaucaacucagaaugcaaucgauaagauuaccaacaaagugaauaguguuaucgagaagaugaacacacaguuuacugcuguggggaaagaguucaaucaccuggagaagaggauagaaaacuuaaauaagaaagucgacgauggcuuccuggacauuuggaccuacaacgccgagcuccuugugcuguuggaaaacgagcggacacuagauuaucaugacagcaauguaaagaaccuguacgagaaaguucgcaaucaacucaagaacaaugcuaaagaaaucggaaacggcuguuuugaguucuaucacaagugcgauaauaccuguauggaauccgugaagaacgggacuuacgacuauccuaaauacucugaggaagccaagcugaaucgagagaaaaucgauggagucaaacuugagagcacgagaauuuaucagauccuggcaauuuacucaacaguggccaguuccuugguccucgugguuagccugggugcuauaucuuuuuggaugugcucaaacggcaguuuacagugcaggaucuguauuuga

SEQ ID NO: 135910 - RNA, 1701 nt, Artificial Sequence
  derived and/or modified sequence opt3 from hemagglutinin__InfluenzaA__EPI841265
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucggagguguggcgccccugcaucuuggcaaaugcaacauagcuggguggauccugggaaauccugagugugaaucuuugucaaccgccaguagcugguccuacauuguugagacuucuaacucggacaauggcacaugcuauccaggugauuuuaucaacuacgaagaacucagagagcagcugucaagcgugaguuccuucgaaagguuugagauuuucccgaagaccucuagcuggcccaaucacgacuccaacaagggggucacggcagccuguccucaugcuggagcaaaaucauuuuauaagaaucugaucuggcucgugaaaaagggcaacaguuacccaaaauuaaaucaaagcuauauaaacgauaagggcaaggaaguacugguucuuugggggauccaccaccccucuacuaccgccgaccagcaguccauuuaccagaacgcugaugccuacguguucgucggaacaucacgguauagcaaaaaguuuaaaccugagaucgcgacucgcccaaaggugcgagaccaagagggucguauuaauuacuauuggaccuugguggaacccggcgauaaaaucacauucgaggcaaccgggaaccuggucguuccuagauacgccuuuacgauggaaaggaaugcuggaaguggcauaauuaucucuaacacuccagugcaugacugcaauacaaccugucagacuccggagggugccauuaacacaucccuacccuuccagaauauccacccuaucaccauugggaagugcccaaaauauguaaagagcacgaagcuccggcuggcaaccggacuucgcaacgugcccucgauacagucuagaggccuguuuggcgcuaucgccggguucauugaaggagguuggacaggcauggucgaugggugguacggauaucaucaccaaaaugagcagggcuccgguuacgcggccgacuugaaaucaacucagaacgcaaucgacaagauaaccaauaaagugaacaguguuauugagaagaugaauacacaguuuacugcuguggggaaagaguucaaccaccucgagaagaggaucgaaaaucugaacaagaaagucgaugacggcuucuuagauaucuggaccuacaacgccgagcugcucgugcuucuggaaaaugagcggacauuggacuaucaugauagcaacguaaagaaucuauacgagaaaguucgcaaccaacugaagaauaacgcuaaagaaauuggaaauggcuguuuugaguucuaucacaagugcgacaacaccuguauggaauccgugaagaaugggacuuacgauuauccuaaauacucugaggaagccaagcucaaccgagagaaaaucgacggagucaagcuggagagcacgagaauuuaucagauacuugcaaucuacucaacaguggccaguucccuggucuuggugguuagccucggugcuauuucuuuuuggaugugcucaaauggcagucugcagugcaggaucuguaucuga

SEQ ID NO: 135911 - RNA, 1701 nt, Artificial Sequence
  derived and/or modified sequence opt3 from hemagglutinin__InfluenzaA__EPI291846
augaaggccaucauugugguccugcucuacaccuucgcuacagcagacgccgauacucuuugcauaggcuaucacgcgaacaauagcacggacaccguugauacagugcuggagaaaaacguaacugugacccauuccgucaauuuguuagaaaacaagcacgacgggaaacuguguaaucuaaagggaguggcuccccuccaucuggguaaaugcaacaucgccggcuggcuucuggggaauccugagugugaaucuuuguuuacagcaucaaguuggagcuacauuguugagaccccaaacuccgauaauggaacuugcuauccgggcgacuucaucaacuacgaggagcucagagagcaccugucuucggugagcucauuugaaagguucgagauuuuucccaaggucaauaguuggccuaaccaugauacaaauaagggugugaccgccgcuuguccauaugcaggggccaacuccuucuaccggaaucugaucuggcucgugaaaaagggaaacucuuaucccaaauuaagcaaguccuacauaaacaauaaaaagaaggaaguucuggugaucuggggcauucaccacccuccaacgucaacugaccagcaaacccuuuaccagaacgcugaugccuaugucuuugugggcaguagcaaauacucuaagcgcuucgagcccgagaucgcggcacgaccuaaagugcguaaucaggccgggagaaugaacuauuacuggacauugauugaaccaggagacacuaucaccuuugaggcuacagguaaucuggucguuccgagguaugccuucgcaaugcggcgcggcuccgggucaggaauaauugugagcgaugcucccguacaugacugcaacaccacgugucagacuccuaagggcgccaucaauacaagucuaccauuucaaaacauucaccccgugaccaucggugaaugcccuaaauacgucaagucuacuaaacucagaauggcgacagggcugaggaauaucccauccauucagagccggggacuuuucggcgccauagcaggcuuucuggaagggggauggaccgguaugaucgauggcugguauggguaccaucaccagaacgaacagggaucgggcuacgcugccgaccaaaagucuacgcagaaugcuauugacgguaucaccaacaagguaaauuccauaauugagaaaaugaacacacaguucacugccguugggaaggaguucucacaguuggaaaaacgcaucgagagucucaauaacaagguggaugacggcuuucuggauaucuggaccuauaacgcagaaauguuaguccugcucgagaaugaacgaacacuugacuaccacgauagcaacgugaaaaaucuguaugagaagguaagaucccaauugaagaacaaugccaaagagauuggaaacggcuguuucgaauuuuaccauaagugcgacaauacuuguauggagucuguuaggaacgggaccuaugauuaccccaaauauagcgaagaggcuaagcuaaaucgggaagagaucgacggagugaaacuggagucagcgcguauuuaccagauacucgcaaucuacaguacagucgccuccagccuggugcuucuggucucuuugggugcugugucauucuggaugugcaguaacggcagccuccagugccgcauuuguaucuga

SEQ ID NO: 135912 - RNA, 1695 nt, Artificial Sequence
  derived and/or modified sequence opt3 from hemagglutinin__InfluenzaA__EPI558121
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaaaauagacacaacgggaagcuauguaaacucaggggaguggcgccccugcaucuugguaagugcaauauagcuggcuggcuguuggggaacccugagugugaaucucucucaaccgccaguagcugguccuacaucguugagacuucuaauucggauaacggaacaugcuauccaggcgacuuuauuaauuacgaagaacugcgggagcagcugucaagcgugaguuccuucgaacgcuuugagaucuucccgcaaaccucuagcuggcccaaccacgauacgaaucgaggugucacugcagccuguccucaugcugggaccaacuccuuuuaucguaaucucgugugguuaguaaagaagggaaacucauacaguaagauuaacaaaagcuauaucaauaacaaggaaaaagagguucuggugcuuugggcaauacaccacccaucuacauccgccgaccagcagucauuguaccagaaugcugaugccuacgucuucgugggcagcaguagauauucuaggaaguuugagcccgaaaucgcgacucggccuaaagugcgcgaccaagcaggcagaaugaacuacuauuggacccuggucgagccaggggauaagauuacauucgaagccaccggaaaucuaguugcucccagguacgccuuugcacucaagcggaacuccgguagcggcaucauuaucucggacacgucugugcaugauugcgacacuacaugucagaccccuaauggggcuauaaacacuucccugccauuccagaauauucacccgguaacaaucggagagugccccaaauaugugaagucaaccaaacuucgcauggccacgggccugcgaaacauuccuaguauccagagcagagguuuguuuggggcgaucgccggauucauugaaggcggcuggaccgggaugauagauggaugguacgguuaucaucaccaaaaugagcagggcuccggguacgcagcugaccucaagucuacacagaacgccaucgacggaauuacuaauaaagucaacagcgugaucgagaagaugaauacccaguuuacagcuguuggcaaagaguucucacaccuggagaggcggauagaaaacuuaaacaagaagguggaugacgguuuccuggauauuuggacuuacaaugccgagcuccuuguccuguuggaaaacgagcguacccuagacuaucaugauaguaaugugaaaaaccuguacgagaagguacgcucccaacucaaaaauaacgcaaaggaaaucgggaauggcuguuuugaguucuaucacaaaugcgacgauauguguauggaaagcguuaagaacggaacauacgacuauccaaaguacucugaggaagccaaacugaauagagaggagaucgauggcgugaaacuugaaucaaccaggauuuaucagauccuggcuauuuacaguacugucgcgagcuccuuggugcucgucgugucucugggggcaauaucguuuuggaugugcagcaacggauccuuacagugccggaucuga

SEQ ID NO: 135913 - RNA, 1701 nt, Artificial Sequence; identical to SEQ ID NO: 134457
  derived and/or modified sequence opt3 from hemagglutinin__InfluenzaA__EPI564139

SEQ ID NO: 135914 - RNA, 1701 nt, Artificial Sequence; identical to SEQ ID NO: 135702
  derived and/or modified sequence opt3 from hemagglutinin__InfluenzaA__EPI786706

SEQ ID NO: 135915 - RNA, 1701 nt, Artificial Sequence
  derived and/or modified sequence opt3 from hemagglutinin__InfluenzaA__EPI395313
augaaggccauccugauugugcuccuuuacaccuucacaacugcuaacgcagacacgcugugcauaggcuaucacgccaauaacagcaccgauacagucgacacuguuuuggagaaaaaugugaccguaacacauuccgugaacuuacuggaaaauagacacaacgggaagcuauguaaacucaggggagucgcgccccugcaucuugguaagugcaauaucgcuggcuggcuguuggggaacccugagugugaaucucucucaaccgccaguagcugguccuacauuguggagacuucuaauucggauaacggaacaugcuauccaggcgacuuuaucaauuacgaagaacugcgggagcagcugucaagcguuaguuccuucgaacgcuuugagauuuucccgaaaaccucuagcuggcccaaccacgauacgaaucgaggugugacugcagccuguccucaugcugggaccaaguccuuuuauaagaaccucaucuggauagccaaaaagggaaauucauacccaaaaaucaacaagaguuauauuaacaauaaagaaaaggaggucuuagugcugugggcaauccaccaccccagcacaucugcugaccaacagucccuuuaccagaacgccgaugcguacguauucguuggcucaagccguuauaguagaaaguuugagccugaaauugcaacuaggccaaaagugcgggaccaggccggccgcaugaauuacuauuggaccuuggucgagcccggggauaagaucacauucgaagcuaccggaaaccugguggccccuagauacgcauuugcucuaaaaaggaacucugguuccggcauaauuaucagcgacacgucggugcaugauugcgacacuacaugucaaaccccaaauggggccauuaauacuucucucccguuccagaacauccaccccgucacaaucggagagugcccuaaguauguuaaauccaccaagcugcggauggcgacgggccuucgcaauauuccaucaauacagagucgaggucuguuuggggccaucgcaggauucauugaaggcggcuggaccgggaugaucgauggaugguacgguuaucaucaccagaacgagcaaggcagcggguacgcugccgacuugaaauccacacagaaugcuauagacggaauuacuaacaagguaaauucugugaucgagaagaugaacacccaguuuacagccgugggcaaagaguucagccaccucgagagaaggaucgaaaaucugaacaagaaagucgaugacgguuucuuagauauuuggacuuacaacgcagagcugcucgugcuucuggaaaaugagcggaccuuggacuaucaugauucaaacguuaagaaucuauacgagaaagugcguagucagcugaagaacaaugccaaggaaaucgggaacggcuguuuugaguucuaucacaaaugcgacgauauguguauggaauccgucaagaauggaacauacgacuaucccaaauacagcgaggaagcuaagcucaaccgcgaggugauugauggcguaaaacuggagucuaccagaauauaucaaauccuugcgauuuacgcaacuguugccucaagucugguguuggucgugagccucggggcuaucuccuuuuggaugugcucuaauggaucgcugcagugcaggaucuguauuuga

SEQ ID NO: 135916 - RNA, 1701 nt, Artificial Sequence
  derived and/or modified sequence opt3 from hemagglutinin__InfluenzaA__EPI291696
augaaggccauccugcucgugcuucuguacaccuucacagcugcaaacgccgacacuuugugcauuggcuaucacgcgaauaacagcacggauaccgucgacacaguuuuagagaaaaaugugacuguaacccauuccgugaaccugcuagaaaauagacacaacgggaagcucuguaaacugaggggagugcccccucuucaucuggguaagugcaauauagcuggcugguugcucgggaacccagagugugaacugcuguuuacagccucuucauggaguuacaucgucgagaccagcaauuccgauaacggaacuugcuauccgggcgacuucauuaauuacgaggaacuccgggagcaguuaucuucgguuucuagcuuugaacgcuucgagaucuuucccaaagcaaguuccuggccugaucacgaaacaaaccgaggugugaccgccgcuuguccauaugcaggggccaauucuuucuaccguaaccugauuuggcuugucaagaagggaaauagcuaucccaaauuguccaagucauacgugaacaacaaagagaaggagguacugguucuauggggcauccaucacccuccaacgaguacugaccaacagagccucuaccagaaugcugaugccuauguguuugucggcucauccaaauacaacaagaaguucaaacccgaaauggcggcaagaccuaaggugagggggcaggccggacggaugaauuauuacuggacccugguggcuccaggugacacaauaacuuuugaggccaccggcaaccuugucguuccgcgcuaugcauucgcuaugaaaagagggucaggaagcggcaucauuaucagugauacacccgugcacgacugcaauaccacgugucaaacuccuaagggugccauuaacacaucucugccauuucagaauauccaucccguaaccauaggggaaugcccuaaauacgugaaguccacuaaauugaggauggcgacaggacuccggaacauuccaagcauccagucgcgcggccuguucggcgccauugcaggguuuaucgagggagguuggaccggcaugaucgaugggugguauggauaccaccaucagaaugaacaaggcucugguuacgcugccgaccgaaaguccacgcagaacgcuauugaugggauaaccaauaaggucaacucagugaucgagaaaaugaauacacaguucacugccguuggcaaggaguucaaccacuuagaaaagagaauugagaaucugaacaagaaaguggacgacggauuucucgaugucuggaccuauaacgcagaacuucugguguugcuagagaaugaaaggacacuggacuaccacgauaguaacguaaagaaucucuaugagaagguucggagccagcugaaaaacaaugccaaggagaucggcaacggguguuucgaauuuuaccauaaaugcgacgauacuuguauggaguccgugaagaauggaaccuaugacuaccccaaauauucugaagagagcaaacuuaaccgugaagagauagauggugucaagcuggagucaacacgcauuuaccaaaucuuggcuaucuacaguaccguggcguccagccucguccugucugugucauuaggcgcaauuaguuucuggaugugcagcaaugggucccugcagugcagaaucuguauuuga

SEQ ID NO: 135917 - RNA, 1701 nt, Artificial Sequence; identical to SEQ ID NO: 131847
  derived and/or modified sequence opt3 from hemagglutinin__InfluenzaA__ACU80014

SEQ ID NO: 135918 - RNA, 1701 nt, Artificial Sequence; identical to SEQ ID NO: 124685
  derived and/or modified sequence opt3 from hemagglutinin__InfluenzaA__EPI177400

SEQ ID NO: 135919 - RNA, 1701 nt, Artificial Sequence; identical to SEQ ID NO: 125128
  derived and/or modified sequence opt3 from hemagglutinin__InfluenzaA__ACT36512

SEQ ID NO: 135920 - RNA, 1704 nt, Artificial Sequence
  derived and/or modified sequence opt3 from hemagglutinin__InfluenzaA__AJE30344
auggagaagaucgugcugcuccuugccgucauuagccugguuaaauccgaccagauaugcaucggcuaccacgcuaacaauucuaccaagcaaguggauacaauuauggagaaaaacguaacugugacgcaugcacaggacaucuuggagaagacccacaaugggaaauuaugugaucugaacggagucaagccccuaauucucaaggacugcucaguggccgguuggcugcuuggcaauccuaugugugaugaguucaucagaguuccagaauggaguuauauaguggaaagggcgaacccggcuaaugaccugugcuaccccgggacauugaacgauuaugaggagcucaaacaucugcugagccggaucaaucacuuugaaaagaaccucauuaucccucgcuccucuuggccaaaucaugagacuucguuaggagucucagccgcaugucccuaccagggcgccagcaguuucuuucgaaacgugguauggcugauuaaaaagaaugacgcuuauccuaccaucaaaauauccuacaacaauacaaaccgugaagaucuuuugauucugugggguauccaccacucuaacaaugcagccgagcagaccaaccuauauaagaauccagacacuuacguuagcguggggacauccacccucaaccaaagacugguccccaagauugcuacgaggucacaggugaauggacagaguggccggauggauuucuuuuggacuauccuuaaaccuaacgacgccauccauuucgagagcaauggcaacuuuauugcgccagaauacgcauauaagauagugaaaaagggggauucuaccaucaugaaauccgagauggaauacggacacugcaauacaaagugucagacuccgauuggugccaucaacucaagcaugcccuuccauaauauacacccucugaccauuggcgagugcccaaaauaugucaagaguaacaaguugguucucgcuacagggcugcgcaauucucccuuaagagaaaggcggcgcaaacgaggacuguuuggcgccaucgcagguuucaucgaagggggauggcaaggcaugguggacggcugguacggguaucaccauuccaacgagcagggaagcgguuacgcugccgacaaggaaucgacccagaaagcgauugauggcguaacgaauaaggugaacucuaucauugacaaaaugaacacucaguuugaggccgucgggagagaguucaauaaccucgaaaggcggauagaaaaucuuaacaagaagauggaggauggauuucuggacguguggacauauaaugcagaguugcuaguucugauggaaaacgagcguacccucgauuuccacgacuccaaugugaaaaaccuguacgauaagguccgccuucaacugagagacaaugcuaaagaauugggcaacgguuguuucgaguuuuaccauaagugcgauaaugaauguauggagucagugaggaacgggacuuaugacuacccuaaauauagugaggaagccauccucaagcgggaggaaauuagcggcguaaagcuggaguccaucggaacauaccagaucuuaucuauuuauagcaccguugcuucaagucuggcccuagcaauaaucguggccggccucucccuguggaugugcagcaaugggucucuucagugccgaauuuguaucuga

SEQ ID NO: 135921 - RNA, 1701 nt, Artificial Sequence; identical to SEQ ID NO: 135900
  derived and/or modified sequence opt3 from hemagglutinin__InfluenzaA__EPI178948

SEQ ID NO: 135922 - RNA, 1701 nt, Artificial Sequence; identical to SEQ ID NO: 135900
  derived and/or modified sequence opt3 from hemagglutinin__InfluenzaA__EPI178949

SEQ ID NO: 135923 - RNA, 1701 nt, Artificial Sequence
  derived and/or modified sequence opt3 from hemagglutinin__InfluenzaA__EPI590132
augaaggccauccugauugugcuccuuuacaccuucacaacugcuaacgcagacaaaauaugcaucggcuaucacgccaauaacagcacggauaccgucgacacaguucuggagaagaaugugacuguaacccauuccgugaacuuguuagaaaauaaacacaacgggaagcuguguaaacuaagaggagucgcgccccuccaucuggguaagugcaauauugcuggcuggcuucuggggaacccugagugugaaucuuuggccacagcaucaaguuggagcuacaucguggagaccuccucuucgaauaacggaacuugcuauccaggcgauuuuauuaauuacgaagaacucagggagcagcugucaagcguuaguuccuucgaaaaguuugagaucuucccgaaaacaucuagcuggcccaaccacgaaaccaauaagggugugacggccgcuuguccucaugcagggacuaacuccuuuuauaaaaaucugauauggcucgucaagaaagagaacucauacccaaagaucaacauuaguuauaccaauaaccggggaaaggagguguuaguacugugggccauccaccaucccccuacaagcacugaccaacagucucuuuaccagaaugcuaacuccuacguuuucgugggcucaagccgcuauagucgaaaauuugaaccagagauugccacccgucccaaggucagaggccaggcggggaggaugaauuacuauuggacauugguggaaccuggagauaaaaucaccuucgaggcaacggguaaccugguggucccacgguacgccuuugcucuaaagcgcaauucuggcuccgggauaauuaucagcgaaacuccgguucacgacugcgauacaaccugucaaacucccaacggagccauuaauacaucgcucccuuuccagaacauccacccagugaccaucggcgagugccccaaauauguaaagucuacgaaacugagaauggcaaccggucuuaggaauauuccuuccauacagucacgggggcuguuuggagcuaucgccggcuucauugagggcggguggacaggaaugaucgacgguugguacggcuaucaucaccagaacgaacaagggaguggauacgcggccgaucucaagagcacucagaaugcaauagacggcauuaccaacaagguaaauuccgucaucgagaaaaugaacacacaguuuacugcuguggguaaggaguucucucacuuggagcgccgaaucgaaaaccugaauaaaaagguugaugacggguucauugauaucuggaccuacaacgccgaguuacuggugcuccuugagaaugaaagaacacuggacuaucaugacagcaacgucaaaaccuuguacgagaaggugaggucacagcuaaagaauaacgcuaaagaaauuggcaauggauguuuugaguucuaucacaagugcgaugacacuuguauggaaagugugaaaaacggcacguacgauuauccaaaguacuccgaggaggccaaacugaaucgggaagagauagacgggaucaagcucgaaagcacacguauuuaucaaauccuggcaaucuacucuaccguugccucaagucuugugcuggucgugagcuugggagcuauuuccuuuuggaugugcucuaacgguucgcuccagugccgcgucuguauauga

SEQ ID NO: 135924 - RNA, 1701 nt, Artificial Sequence; identical to SEQ ID NO: 123752
  derived and/or modified sequence opt3 from hemagglutinin__InfluenzaA__ABU80400

SEQ ID NO: 135925 - RNA, 1698 nt, Artificial Sequence
  derived and/or modified sequence opt3 from hemagglutinin__InfluenzaA__ABO21709
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucaggucauggaguuauauuguggaaacucccaacagcgagaauggaaucuguuacccuggcgacuucauugauuaugaagaacuccgggagcaauuauccucuguuucgucauuugaacgcuucgagaucuuuccaaaagaaagcaguuggcccaaccauaauaccaacggugugacagcugcaugcucccacgaggggaagucuagcuucuaccgaaaucugcuuugguugaccgagaaggaaggauccuauccuaaacugaagaacucauacgucaauaaaaagggcaaagaggugcuaguacucuggggcauacaucacccacccaacaguaaggaacagcagaaccuguaucagaaugagaacgccuacguuagcguggucacuucuaauuacaaccguagauuuacaccugaaaucgcugagaggccaaaggugcgggaccaagccgggcgcaugaauuauuacuggacccuucugaaaccgggagauacgauuaucuucgaggcgaacgguaauuugauugcacccauguaugccuuugcucucuccagaggcuucgggucaggaaucauaacuagcaacgccaguaugcacgaauguaauaccaagugccagacaccucugggcgcaauuaacucuuccuuaccauaccagaauauccaucccgugacuauuggugaguguccuaaauaugucaggagcgcuaagcugcggaugguuaccgggcuccgcaacaauccaucgauccagucucgaggacuuuuuggcgccaucgcgggcuucauugaagggggauggacagguaugauagacggcugguacggguaucaccaucaaaacgagcagggauccggcuacgccgcagaucagaaaucaacccagaaugcuaucaacgguauuacgaacaaggugaauacuguaaucgagaaaaugaacauacaauuuacagccguggggaaggaguucaauaagcuggagaaaagaauggaaaacuugaauaagaaagucgacgauggcuuucuagacauuuggaccuacaacgcugagcugcucgugcugcuugaaaaugagaggacucuggacuuccacgauaguaacguuaagaauuuguaugaaaaagucaagagccagcucaagaacaaugccaaagagaucggaaacggcugcuucgaguuuuaccacaagugugacaaugaaugcauggaguccgugcggaacgggacauaugauuaccccaaauauucugaagagagcaagcugaaucgugagaaaguggacggaguaaaguuagaaucaauggguaucuaccagauucuggcaaucuauaguaccguugccuccagccuagugcuccuggucucucuuggcgcuauuucauucuggaugugcaguaacgggagcuugcaaugucgcauaugcaucuga

SEQ ID NO: 135926 - RNA, 1701 nt, Artificial Sequence; identical to SEQ ID NO: 124672
  derived and/or modified sequence opt3 from hemagglutinin__InfluenzaA__CAZ65588

SEQ ID NO: 135927 - RNA, 1701 nt, Artificial Sequence; identical to SEQ ID NO: 135702
  derived and/or modified sequence opt3 from hemagglutinin__InfluenzaA__EPI697744

SEQ ID NO: 135928 - RNA, 1701 nt, Artificial Sequence; identical to SEQ ID NO: 135862
  derived and/or modified sequence opt3 from hemagglutinin__InfluenzaA__EPI768525

SEQ ID NO: 135929 - RNA, 1701 nt, Artificial Sequence
  derived and/or modified sequence opt3 from hemagglutinin__InfluenzaA__EPI726930
augaaggccauccuggugguccuccuuuacaccuucacaacugcuaacgcagacacgcugugcauuggcuaucacgccaauaacagcaccgauacaguugacacuguguuggagaagaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuaacucggacaauggaacaugcuauccaggcgauuuuaucaacuacgaagaacucagggagcagcugucaagcgugaguuccuucgaacgguuugagauuuucccgaaggcaucuagcuggcccaaucacgacuccaacaagggugucaccgccgcuuguccucaugcaggggccaaaucauuuuauaagaaucugaucuggcucgugaaaaagggaaacaguuacccaaaauuaaaucaaagcuauauaaacgauaagggcaaggaaguacugguucuuuggggcauccaccaccccucuacgacugcugaccagcaguccuuguaccagaacgccgaugcguacguguucgucgggaccucacgcuauagcaaaaaguuuaaaccugagauugcaacacgaccaaaggugcgugaccaagagggaagaaugaauuacuauuggacucugguggaacccggugauaaaaucaccuucgaggccacaggcaaccuagucguuccuagguacgcuuuuaccauggaacggaaugccgggaguggaauuaucauaucugacacgccagugcaugauugcaacacuacaugucagaccccggagggcgcaauuaauacuucccuccccuuccagaacauccacccuauuacaaucgguaagugcccaaaauauguaaagagcaccaagcugcgccuugcuacggggcugagaaaugugcccucgauccagucuaggggauuguuuggcgccauugcgggcuucauagaagggggauggaccgguauggucgacggcugguacggguaucaucaccaaaacgagcagggauccggcuacgccgcagaccucaaaucaacacagaaugcuaucgauaagauuacuaacaaagugaauaguguuaucgagaagaugaacacccaguuuacagccguggguaaagaguucaaucaccuggagaagcggauagaaaacuuaaauaagaaagucgacgauggguuccuggacauuuggacuuacaacgcugagcuccuugugcuguuggaaaacgagcgcacccuagauuaucaugacagcaauguaaagaaccuguacgagaaaguucgaaaucaacucaagaacaaugccaaagaaaucggcaacggauguuuugaguucuaucacaagugcgauaauacauguauggaauccgugaagaacggcaccuacgacuauccuaaauacucugaggaagcaaagcugaauagagagaaaaucgauggggucaaacuugagagcacuaggauuuaucagauccuggccauuuacucaacgguggcuaguuccuugguccucgugguuagccugggagcgauaucuuuuuggaugugcucaaacgguaguuuacagugccggaucuguauuuga

SEQ ID NO: 135930 - RNA, 1701 nt, Artificial Sequence
  derived and/or modified sequence opt3 from hemagglutinin__InfluenzaA__EPI813817
augaaggccauccuggugguccuccuuuacaccuucacaacugcuaacgcagacacgcugugcauuggcuaucacgccaauaacagcaccgauacaguugacacuguguuggagaagaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuaacucggacaauggaacaugcuauccaggcgauuuuaucaacuacgaagaacucagggagcagcugucaagcgugaguuccuucgaacgguuugagauuuucccgaaggcaucuagcuggcccaaucacgacuccaacaagggugucaccgccgcuuguccucaugcaggggccaaaucauuuuauaagaaucugaucuggcucgugaaaaagggaaacaguuacccaaaauuaaaucaaagcuauauaaacgauaagggcaaggaaguacugguucuuuggggcauccaccaccccucuacgacugcugaccagcaguccuuguaccagaacgccgaugcguacguguucgucgggaccucacgcuauagcaaaaaguuuaaaccugagauugcaacacgaccaaaggugcgugaccaagaggccagaaugaauuacuauuggacucugguggaacccggagauaaaaucaccuucgaggcuacagguaaccuagucguuccuagguacgccuuuaccauggaacggaaugcaggcagugggauuaucauaucugacacgccagugcaugauugcaacacuacaugucagaccccggagggagcuauuaauacuucccuccccuuccagaacauccacccuauuacaaucggcaagugcccaaaauauguaaagagcaccaagcugcgccuugccacgggucugagaaaugugcccucgauccagucuaggggguuguuuggagcgauugccggcuucauagaaggcggguggaccggaauggucgacgguugguacggcuaucaucaccaaaacgagcagggguccggauacgcagcugaccucaaaucaacacagaaugccaucgauaagauuacuaacaaagugaauaguguuaucgagaagaugaacacccaguuuacagcugugggcaaagaguucaaucaccuggagaagcggauagaaaacuuaaauaagaaagucgacgaugguuuccuggacauuuggacuuacaacgccgagcuccuugugcuguuggaaaacgagcgcacccuagauuaucaugacagcaauguaaagaaccuguacgagaaaguucgaaaucaacucaagaacaaugcaaaagaaaucgggaacggcuguuuugaguucuaucacaagugcgauaauacauguauggaauccgugaagaacggaaccuacgacuauccuaaauacucugaggaagccaagcugaauagagagaaaaucgauggcgucaaacuugagagcacuaggauuuaucagauccuggcuauuuacucaacgguggcgaguuccuugguccucgugguuagccugggggcaauaucuuuuuggaugugcucaaacggaaguuuacagugccggaucuguauuuga

SEQ ID NO: 135931 - RNA, 1701 nt, Artificial Sequence
  derived and/or modified sequence opt3 from hemagglutinin__InfluenzaA__EPI466626
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccucaaaagcacccagaaugcuauugauaagaucacaaacaaaguuaauuccgugauagagaagaugaacacucaguuuaccgccguggguaaagaguucaaucaccuggagaagcggauugaaaacuuaaauaagaaagucgacgauggguuccuggacaucuggacauacaacgcugagcuccuugugcuguuggaaaaugagcgcacucuagauuaucaugacucuaacguaaagaaccuguacgagaaaguucgaaaucaacucaagaacaaugccaaagaaaucggcaacggauguuuugaguucuaucacaagugcgauaauaccuguauggaaagcgugaagaacggcacauacgacuauccuaaauacucagaggaagcaaagcugaauagagagaaaauugauggggucaaacuugagaguaccaggaucuaucagauucuggccauauacuccacuguggcuagcucugucguguugguugugucacucggagcgaucaguuuuuggaugugcagcaacgguucccugcagugccggauuuguaucuga

SEQ ID NO: 135932 - RNA, 1701 nt, Artificial Sequence
  derived and/or modified sequence opt3 from hemagglutinin__InfluenzaA__EPI541966
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgaaucaaauaagggugucaccgccgcuuguccucaugcaggggccaaaaguuuuuauaagaaccugaucuggcucgugaaaaagggaaauagcuacccaaaauuaucucaauccuauauaaacgacaagggcaaggagguacugguucuuuggggcauccaccaccccucaacgacugcugaucagcagagcuuguaccagaaugccgacgcguacguguucgucgggaccagucgcuauucuaaaaaguuuaaaccugagauugcaauccgaccaaaggugcgugaucaagaaggaagaaugaacuacuauuggacacugguggagcccggugacaaaauuacuuucgaagccaccggcaaccuagucguuccuagguacgcuuuuacaauggagcggaaugccggguccggaaucauaauuagcgauaccccagugcaugacugcaacacgacuugucagacaccggaaggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgauggcugguacggguaucaucaccaaaacgagcagggaaguggcuacgccgcagaccucaaaagcacccagaaugcuauugacaagaucacaaacaaaguuaauuccgugauagaaaagaugaacacucaguuuaccgccguggguaaagaguucaaucaccuggaaaagcggauugagaacuuaaauaagaaagucgaugacggguuccuggauaucuggacauacaacgcugaacuccuugugcuguuggagaaugagcgcacucuagacuaucaugauucuaacguaaagaaccuguacgaaaaaguucgaaaucaacucaagaacaaugccaaagagaucggcaacggauguuuugaguucuaucacaagugcgacaauaccuguauggaaagcgugaagaacggcacauacgauuauccuaaauacucagaagaggcaaagcugaauagagagaaaauugacggggucaaacuugaaaguaccaggaucuaucagauucuggccauauacuccacuguggcuagcucugucguguugguugugucacucggagcgaucaguuuuuggaugugcagcaacgguucccugcagugccggauuuguaucuga

SEQ ID NO: 135933 - RNA, 1701 nt, Artificial Sequence
  derived and/or modified sequence opt3 from hemagglutinin__InfluenzaA__EPI652003
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgaaucaaauaagggugucaccgccgcuuguccucaugcaggggccaaaaguuuuuauaagaaccugaucuggcucgugaaaaagggaaauagcuacccaaaauuaucucaauccuauauaaacgacaagggcaaggagguacugguucuuuggggcauccaccaucccccuacgacugcugaucagcagucauuguaccagaaugccgacgcguacguguucgucgggaccagccgcuauaguaaaaaguuuaaaccagagauugcaauccgacccaaggugcgugaucaagaaggaagaaugaacuacuauuggacacugguggagccuggugacaaaauuacuuucgaagccaccggcaaccuagucguuccaagguacgcuuuuacaauggagcggaaugccgggucuggaaucauaauuuccgauaccccggugcacgacugcaacacgacuugucagacacccgaaggcgcaaucaauaccagccucccuuuccagaacauucacccaaucacuaucgguaagugccccaaauauguaaagucgacaaagcugcgccuugcuaccgggcugagaaaugugccuucuauucaguccaggggauuguuuggcgccauagcgggcuucaucgaagggggauggacggguauggucgauggcugguacggguaucaucaccaaaacgagcagggaucaggcuacgccgcagaccucaaaaguacccagaaugcuauugacaagaucacaaacaaagugaauagcguuauagaaaagaugaacacucaguuuaccgccguggguaaagaguucaaucaccuggaaaagcggauugagaacuuaaauaagaaagucgaugacggguuccuggauaucuggacauacaacgcugaacuccuugugcuguuggagaaugagcgcacucuagacuaucaugauuccaacguaaagaaccuguacgaaaaaguucgaaaucaacucaagaacaaugccaaagagaucggcaacggauguuuugaguucuaucacaagugcgacaauaccuguauggaaucugugaagaacggcacauacgauuauccaaaauacagcgaagaggcaaagcugaauagagagaaaauugacggggucaaacuugaaucaaccaggaucuaucagauucuggccauauacaguacuguggcuuccagcgucguguugguugugucucucggagcgaucucauuuuggaugugcaguaacgguagccugcagugccggauuuguaucuga

SEQ ID NO: 135934 - RNA, 1701 nt, Artificial Sequence
  derived and/or modified sequence opt3 from hemagglutinin__InfluenzaA__EPI291877
augaaggccaucauugugguccugcucuacaccuucgcuacagcagacgccgauacucuuugcauaggcuaucacgcgaacaauagcacggacaccguugauacagugcuggagaaaaacguaacugugacccauuccgucaauaucuuggaaaacaagcacgacgggaaauuauguaagcugagaggaguggcuccccuacaucucgguaaaugcaauauugccggcuggcugcuugggaacccugagugugaaucucuguuugcagccucaaguuggagcuacaucguugagacaccaaauuccgauaacggaaccugcuauccgggcgacuucauuaauuacgaagaguugagggagcaccucucuucggugagcucauuugaacgguucgagaucuuucccaaggcuaacaguuggccuaaucaugauacuaacaagggugucacagcagccuguccauaugcuggggccaauuccuucuaccgcaaccugauauggcuggugaaaaagggaaauucuuaucccaaacucagcaaguccuacaucaacaacaaaaagaaggaaguauuaguuauuuggggcauccaccacccuccaaccucaauugaccagcaaacgcuguaccagaaugcggaugcauauguguuugucggcaguagcaaauacucuaagcgauucaaacccgagaucgccgcucguccuaaggugagagaccaggccgggaggauggauuauuacuggacucuuauagagccaggagacaccauuacauuugaagcaacugguaacuugguggucccgcgguaugcuuucgccaugaaacgcggcuccgggucaggaaucauuguuagcgaugcgcccgugcaugacugcaauaccacaugucagaccccuaagggcgccaucaacacgagucugccauuucaaaauauccaccccguaacuauuggugagugcccuaaauacgugaagucuacaaagcuaagaauggcaaccgggcucaggaacauaccauccauccagagccggggacuguucggcgcuauugccggcuuuaucgaagggggauggacugguaugauagacggcugguauggguaccaucaccagaaugagcagggaucgggcuacgcugccgaucaaaaaucuacacagaacgcaauugacgguaucaccaauaaggucaacuccaucauugaaaagaugaauacgcaguucaccgccguggggaaagaguucucacagcuugagaaacgcaucgaaagucugaacaauaagguugaugacggcuuuuuggauauuuggacauauaacgcugagcuccugguguuacuggaaaaugagcgaacucucgacuaccacgauagcaacgucaagaaccuuuaugaaaaagugagaucccaacugaagaauaacgcgaaagagauaggaaauggcuguuucgaguuuuaccauaagugcgacaacaccuguauggaaucuguuaaaaaugggacauaugauuaccccaaguauagcgaggaagcaaaguugaacagggaggaaaucgacggaauuaaacuagagucagcccggaucuaccagauccuggcuauuuacaguacuguagccuccagccucgugcugcuugucucucugggugcagugucauucuggaugugcaguaauggcagcuugcagugccguauauguaucuga

SEQ ID NO: 135935 - RNA, 1701 nt, Artificial Sequence
  derived and/or modified sequence opt3 from hemagglutinin__InfluenzaA__ABR29595
augaaggccauccugcucgugcuucuguacaccuucacagcugcaaacgccgacacuuugugcauuggcuaucacgcgaauaacagcacggauaccgucgacacaguuuuagagaagaaugugacuguaacccauuccgugaaccugcuagaagauagacacaaugggaagcucuguaaacugaggggagucgcuccccuucaucuggguaagugcaacauagccggcugguugcucgggaauccugagugugaacugcuguuuacagcaucuucauggaguuacaucguggagaccagcaacuccgacaauggaacuugcuauccaggcgauuucauuaacuacgaagaacuccgggagcaguuaucuucgguuucuagcuuugaacgcuucgagaucuuuccgaaagccaguuccuggcccaaucacgaaacaaaccgaggugugaccgcugcauguccuuaugccggggcuaauucuuucuaccguaaccugauuuggcuugucaagaagggaaauagcuauccaaaauuguccaagucauacgugaacaacaaagagaaggagguacugguucuauggggcauccaucaucccccuacgaguacugaccaacagagccucuaccagaaugccgaugcguauguguuugucggcucauccaaauacaacaagaaguucaaaccagaaauagcaaccagacccaaggugagggggcaggccggacggaugaauuauuacuggacacugguggagccuggugacacuaucaccuuugaagcuacaggcaaccuugucguuccacgcuaugccuucgcaaugaaaagagggucaggaagcggcauuaucauuagugauaccccggugcacgacugcaauacgacuugucaaacacccaagggugcuaucaacaccucucugccuuuucagaauauacacccaguaacuauuggggagugccccaaauacgugaaguccacaaaauugaggauggccaccggacuccggaacaucccuagcauucagucgcgcggccuguucggcgcgaucgccggguuuaucgaaggagguuggacgggcaugauugaugggugguauggauaccaccaucagaaugagcaaggcucugguuacgcagcugaccgaaaguccacccagaacgccauagaugggaucacaaauaaggucaacucagugauugagaaaaugaauacucaguucaccgcuguuggcaaggaguucaaccacuuagagaaaagaaucgaaaaucugaacaagaaaguggacgacggauuucucgaugucuggacauauaacgccgagcuucugguguugcuagaaaaugagaggacucuggacuaccacgauaguaacguaaagaaucucuaugagaagguucggagccagcugaaaaacaaugcaaaggaaauaggcaacggguguuucgaguuuuaccauaaaugcgacgauaccuguauggaauccgugaagaauggaacauaugacuacccaaaauauucugaggaaagcaaacuuaaccgugaggagauugauggugucaagcuggaaucaacccgcaucuaccaaaucuuggccauuuacaguacuguggcuuccagccucguccuguuagugucucugggcgcgaucucauucuggaugugcaguaaugggagccuacagugcagaauuuguauauga

SEQ ID NO: 135936 - RNA, 1701 nt, Artificial Sequence
  derived and/or modified sequence opt3 from hemagglutinin__InfluenzaA__EPI291885
augaaggccaucauugugguccugcuccacaccuucgcuacagcagacgccgauacucuuugcauaggcuaccaugcgaacaauagcacggacaccguugauacagugcuggagaaaaacguaacugugacccacuccgucaauuuguuagaaacaaagcaugacgggaaacuguguaaccuaaagggaguggcuccccuccaccuggguaaaugcaauaucgccggcuggcuucuggggaacccugagugugaaucuuuguuuaccgcaucaaguuggagcuauauuguugagacuccaaauuccgauaacggaacaugcuacccgggcaauuucaucaacuaugaggagcucagagagcaucugucuucggugagcucauuugaaagguucgagauuuuucccaaggccaauaguuggccuaaccacgacaccaauaagggugucacggcugcauguccauacgccggggcuaacuccuucuaucggaaucugaucuggcucgugaaaaagggaaacucuuaccccaaauuaagcaaguccuauauaaacaauaaaaagaaggaaguacugguuaucuggggcauucaccauccuccaacuucaaccgaucagcaaacacuuuaccagaacgccgacgcguacguguuugucggcaguagcaaauauucuaagcgcuucgagcccgagaucgcagcccgaccuaaagugcguaaucaggcugggagaaugaacuacuauuggacuuugauugaaccaggagauaccaucacauuugaggccaccgguaaucugguggucccgagguacgcauucgcuaugcggcgcggcuccgggucaggaauaauuguuagcgacgcccccgugcacgauugcaacacgacuugucagacaccuaagggcgcgaucaauaccagucuaccauuucaaaacauucaucccguaacuaucggugaaugcccuaaauaugugaagucuacaaaacucagaauggccaccgggcugaggaauaucccauccauucagagccggggacuuuucggcgcaauagcuggcuuucuggaagggggauggacggguaugaucgacggcugguacggguaucaccaccagaacgaacagggaucgggcuacgccgcugaucaaaagucuacccagaaugccauugacgguaucacaaacaaggucaauuccauaauugagaaaaugaacacucaguucaccgcaguggggaaggaguucucacaguuggaaaaacgcaucgagagucucaauaacaagguugacgauggcuuucuggacaucuggacauacaacgccgaaauguuagugcugcucgagaaugaacgaacucuugauuaucaugacagcaacgucaaaaaucuguacgagaaggugagaucccaauugaagaacaaugcuaaagagauuggaaacggcuguuucgaauuuuaucacaagugcgauaauaccuguauggagucuguuaaaaacgggacauacgacuaucccaaguacagcgaagaggcgaaacuaaauagggaagagaucgauggaguaaagcuggagucagcacggauuuaucagauacucgccaucuacaguaccguggcuuccagccugguccuucuggugucuuugggugccgucucauucuggaugugcaguaacggcagccuccagugccguauuuguaucuga

SEQ ID NO: 135937 - RNA, 1701 nt, Artificial Sequence; identical to SEQ ID NO: 124672
  derived and/or modified sequence opt3 from hemagglutinin__InfluenzaA__EPI176515

SEQ ID NO: 135938 - RNA, 1701 nt, Artificial Sequence; identical to SEQ ID NO: 125128
  derived and/or modified sequence opt3 from hemagglutinin__InfluenzaA__EPI189182

SEQ ID NO: 135939 - RNA, 1701 nt, Artificial Sequence; identical to SEQ ID NO: 124920
  derived and/or modified sequence opt3 from hemagglutinin__InfluenzaA__EPI180574

SEQ ID NO: 135940 - RNA, 1701 nt, Artificial Sequence; identical to SEQ ID NO: 130725
  derived and/or modified sequence opt3 from hemagglutinin__InfluenzaA__EPI377499

SEQ ID NO: 135941 - RNA, 1701 nt, Artificial Sequence
  derived and/or modified sequence opt3 from hemagglutinin__InfluenzaA__EPI346916
augaaggccauccuggugguccuccuuuacaccuucacaacugcuacggcagacacccugugcauuggcuaucacgccaacaauagcacagauacuguugacaccguguuggagaaaaacguaacagugacccauuccgucaauuuacuggaaaacagacacaaugggaagcuauguaaacucaggggaguggcgccccugcaucuugguaagugcaacauagcuggcuggcuguuggggaauccugagugugaaucucucucaacugccaguagcugguccuacaucguugagacaucuaacucggauaauggaaccugcuauccaggcgacuuuauuaacuacgaagaacugcgggagcagcugucaagcgugaguuccuucgaacgcuuugagaucuucccgaaaacgucuagcuggcccaaucacgauacuaaccgaggugucaccgcagccuguccucaugacgggacaaauuccuuuuaucguaaccucauuugguuagugaagaagggaaauucauacccaaaaaucaacaagaguuauauaaacaauaaagaaaaggagauccugguacuuugggcuauucaccaccccagcacuucugcagaucaacaguccuuguaccagaacgccgacgcuuacguuuucgugggcucaagcagauauaguaggaaauuugagccugaagucgccacccggccaaaggugcgcgaucaggcgggcagaaugaauuacuauuggacacugguggagcccggggacaagaucaccuucgaagcaacgggaaaccuagucguuccuagguacgccuuugcucucaaacgcaauucugguuccggcauuaucauaagcgauacuucggugcaugacugcgauacaaacugucaaaccccaaauggggccauuaacacuucucugccguuccagaauauccaccccguaacaauuggagagugcccuaaguaugugaaauccaccaaguuacggauggcaacgggccugcgaaacaucccaucaauccagaguagagguuuguuuggggcuauugccggauucauagaaggcggcuggaccgggaugaucgacggaugguacgguuaucaucaccagaaugagcaaggcagcggguacgcggccgaccucaaauccacacagaacgcaauugauggaaucacuaauaaggucaacucugugauagagaaaaugaauacccaguuuacagcuguuggcaaggaguucagccaccuggagaggcggauugaaaacuuaaacaagaaaguggacgaugguuuccuggacaucuggacuuacaaugccgagcuccuuguccuguuggaaaacgagcguacccuagauuaucaugacucaaaugugaagaaccuguacgagaaaguacgcagucagcucaagaauaacgcuaaagaaaucgggaauggcuguuuugaguucuaucacaagugcgaugacauguguauggaauccguuaagaacggaacauacgauuaucccaaauacagcgaggaagccaagcugaauagagaggagauugacggcgugaaacuugaaucuaccaggaucuaucaaauucuggcaauauacucaacugucgccaguagcuuggugcucgucgugucccugggggcuaucucuuuuuggaugugcucgaacggaagccuucagugccggauuuguaucuga

SEQ ID NO: 135942 - RNA, 1689 nt, Artificial Sequence; identical to SEQ ID NO: 125299
  derived and/or modified sequence opt3 from hemagglutinin__InfluenzaA__ACV49600

SEQ ID NO: 135943 - RNA, 1701 nt, Artificial Sequence; identical to SEQ ID NO: 124345
  derived and/or modified sequence opt3 from hemagglutinin__InfluenzaA__BAF48361

SEQ ID NO: 135944 - RNA, 1701 nt, Artificial Sequence
  derived and/or modified sequence opt3 from hemagglutinin__InfluenzaA__EPI507594
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcaagcgcggaagcaauuccucauuuuucagucgacugaacuggcucacccauuuaaauuuuaaguauccagcccugaacgugacgaugcccaacaaugagcaguucgacaaacuuuacauuuggggcguccaccauccugugacugauaaggaccagaucuuuuuguaugcucagagcucuggccguauuaccguauccacaaaaagaucacaacaggccguuaucccaaacauaggguucaggccccggauucgcaauaucccuagcagaauuaguaucuacuggacuaucgugaagccaggagauauucugcuaauaaacucuaccgguaaucucaucgcgccgaggggcuacuuuaaaauucgguccggaaagagcucgaucaugcgcucugacgcacccauagggaaguguaaauccgaaugcauuacaccuaacggcucaaucccaaaugacaagcccuuccagaacgucaaucgaaucaccuauggugccuguccuagauacgugaaacagaguacgcugaagcuggcuacugggaugaggaacgugccagagaaacaaacacggggaauuuuuggcgccaucgcaggcuucauugaaaaugggugggagggaauggucgaugguugguauggcuuccgucaccagaacuuugaggggcgcggacaggcugccgaccuuaagagcacccaagcggccauagaucagaucaauggcaaauugaacagacucauugguaagacuaaugaaaaguuccaccagaucgagaaagaauuuuccgagguugaagggaggauccaggaccuggagaaguacguggaggauacaaaaauugacuuauggucuuauaacgcagaacugcucguagcucuugagaaccaacauaccauagaucugacggacagcgaaaugaauaaguuguucgagaaaaccaagaagcagcuacgggaaaacgccgaggauaugggcaauggaugcuuuaaaaucuaccacaagugugacaacgcuugcauuggcucaauccgaaaugggacauaugaucaugacguguaccgcgacgaggcccugaacaauagauuccagauuaaaggagucgaacucaagagugguuacaaagauuggauccuguggauauccuuugcaaucagcugcuuccuucuguguguggccuugcucggcuuuauuaugugggcuugccagaaggggaacaucagguguaauauuugcaucuga

SEQ ID NO: 135945 - RNA, 1701 nt, Artificial Sequence
  derived and/or modified sequence opt3 from hemagglutinin__InfluenzaA__EPI461953
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuucgagggacgcggccaggcugccgaccugaaauccacccaagcggccaucgaucagauuaaugguaaguugaacagacucaucgggaaaacuaaugaaaaguuucaccagaucgagaaggaguucucugaagucgaaggcaggauucaggaccuggagaaauacguugaggauacaaagauagacuuauggagcuauaacgcagaacugcucguggcucuugagaaccaacauaccaucgaucugacggacucagaaaugaauaaauuguuugagaagaccaaaaagcagcuacgggaaaacgccgaggauaugggaaauggcugcuucaagauuuaccacaaaugugacaacgcuugcaucgggaguauucgaaauggaacauaugaucaugacguauaccgcgacgaggcccugaacaauagauuucagaucaaggguguggaacucaaauccggcuacaaggauuggauacuguggaucagcuucgcaauuucuugcuuucuucugugugucgccuugcucggguucaucaugugggcuugccagaaaggaaacauuagguguaauaucugcauauga

SEQ ID NO: 135946 - RNA, 1701 nt, Artificial Sequence
  derived and/or modified sequence opt3 from hemagglutinin__InfluenzaA__EPI461953/m1
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcaagcgcggaagcaauuccucauuuuucagucgacugaacuggcucacccauuuaaauuuuaaguauccagcccugaacgugacgaugcccaacaaugagcaguucgacaaacuuuacauuuggggcguccaccauccugugacugauaaggaccagaucuuuuuguaugcucagagcucuggccguauuaccguauccacaaaaagaucacaacaggccguuaucccaaacauaggguacaggccccggauucgcaauaucccuagcagaauuaguaucuacuggacuaucgugaagccaggagauauucugcuaauaaacucuaccgguaaucucaucgcgccgaggggcuauuucaaaauucgguccggaaagagcucgaucaugcgcucugacgcacccauagggaaguguaaauccgaaugcauuacaccuaacggcucaaucccaaaugacaagcccuuucagaacgucaaucgaaucaccuacggugccuguccuagauaugugaaacagaguacgcugaagcuggcuacugggaugaggaacgugccagagaaacaaacacggggaauuuucggcgccaucgcaggcuuuauugaaaaugggugggagggaauggucgaugguugguacggcuuccgucaccagaacuucgaggggcgcggacaggcugccgaccuuaagagcacccaagcggccauagaucagaucaauggcaaauugaacagacucauugguaagacuaaugaaaaguuucaccagaucgagaaagaguucuccgaaguugaagggaggauccaggaccuggagaaguauguggaggauacaaaaauugacuuauggucuuacaacgcagaacugcucguagcucuugagaaccaacauaccauagaucugacggacagcgaaaugaauaaguuguuugagaaaaccaagaagcagcuacgggaaaacgccgaggauaugggcaauggaugcuucaaaaucuaucacaagugugacaacgcuugcauuggcucaauccgaaaugggacauacgaucaugacguguaccgcgacgaggcccugaacaauagauuucagauuaaaggagucgaacucaagagugguuauaaagauuggauccuguggauauccuucgcaaucagcugcuuucuucuguguguggccuugcucggcuucauuaugugggcuugccagaaggggaacaucagguguaauauuugcaucuga

SEQ ID NO: 135947 - RNA, 1701 nt, Artificial Sequence
  derived and/or modified sequence opt3 from hemagglutinin__InfluenzaA__EPI668105
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcggaagcuccucaaguuucuucagccgacugaauuggcugacgcaucucaacuauaaguacccagcauuaaaugugacuaugcccaacaacgagcaguuugacaagcuguauauuuggggcguccaccauccuggcaccgauaaagaccagaucuucccauacgcccagucuuccgggcguauaacagugucaacuaagagaagccaacaggcuguaauucccaauaucggaaguaggccucggauucgcgguaucccaucuagaaucuccauuuacuggaccauaguuaaaccgggcgauauccuuuugauuaacagcacagggaaucugaucgcccccaggggauauuuuaagauacggucgggcaaaucuuccauuaugcgcucagacgcgccuaucgguaaguguaagagugaaugcaucaccccaaacgggagcauucccaaugacaaaccuuuccagaacgugaaucgaaucacguacggagcauguccaagauaugucaagcacuccacucuaaaacucgccacaggcaugaggaacgugcccgagaagcagacccggggcauuuuuggggcuauagccggauucaucgaaaaugguugggagggcaugguggaugggugguacggauuucgucaccaaaacucugagggccgcggucaggcagcugaccugaaaagcacucaggccgcgauugaucaaaucaaugggaaacuuaacagacugaucggcaaaacaaaugaaaaguuccaucagauugagaaggaauuuucagaggucgaaggaaggauacaggacuuggagaaauauguugaggauaccaagaucgaccucuggaguuacaacgccgaacuguuaguggcacuggagaaucagcacacgauugaucucaccgacuccgaaaugaacaaacuuuuugagaagacaaagaagcaacugcgggaaaacgcugaggauaugggcaaugggugcuucaagaucuaucauaaaugugacaacgccugcauuggaagcauccgaaaugguacuuacgaucacaacguauaccgcgacgaggcuuugaauaacagauuucagauaaagggcguggaacuaaaaucuggguauaaggacuggauccuguggauuucauucgccaucaguugcuuucuccugugugucgcacuucugggauucauuaugugggccugccagaaaggcaauaucagguguaacauaugcauuuga

SEQ ID NO: 135948 - RNA, 1701 nt, Artificial Sequence
  derived and/or modified sequence opt3 from hemagglutinin__InfluenzaA__EPI578446
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauaaguacccagcauuaaaugugacuaugcccaacaacgagcaguuugacaagcuguauauuuggggaguccaccauccuggcaccgauaaagaccagaucuucccauacgcccagucuuccggcagaauaacagugucaacuaagaggagccaacaggcuguaauucccaauaucgggagucggccucgcauuagaggaaucccaucuaggaucuccauuuacuggaccauaguuaaaccgggugauauccuuuugauuaacagcacaggcaaucugaucgcgccccggggguauuuuaagauacgcucgggaaaaucuuccauuaugcgaucagacgccccuaucggcaaguguaagagugaaugcaucaccccaaacgguagcauucccaaugacaaaccuuuccagaacgugaauagaaucacguacggggcauguccaagguaugucaagcacuccacucuaaaacucgccacaggaaugcggaacgugcccgagaagcagacccguggcauuuuuggcgcuauagccggguucaucgaaaauggaugggaggguaugguggauggcugguacggguuucgccaccaaaacucugagggaagaggccaggcagcugaccugaaaagcacucaggccgcgauugaucaaaucaaugguaaacuuaacaggcugaucgggaaaacaaaugaaaaguuccaucagauugagaaggaauuuucagaggucgaaggccggauacaggacuuggagaaauauguugaggauaccaagaucgaccucuggaguuacaacgccgaacuguuaguggcacuggagaaucagcacacgauugaucucaccgacuccgaaaugaacaaacuuuuugagaagacaaagaagcaacugcgagaaaacgcugaggauaugggaaauggcugcuucaagaucuaucauaaaugugacaacgccugcauugggagcauccgcaauggaacuuacgaucacaacguauacagagacgaggcuuugaauaacagguuucagauaaaggguguggaacuaaaaucuggcuauaaggacuggauccuguggauuucauucgccaucaguugcuuucuccugugugucgcacuucugggguucauuaugugggccugccagaaaggaaauauccgguguaacauaugcauuuga

SEQ ID NO: 135949 - RNA, 1701 nt, Artificial Sequence; identical to SEQ ID NO: 134457
  derived and/or modified sequence opt3 from hemagglutinin__InfluenzaA__EPI551882

SEQ ID NO: 135950 - RNA, 1701 nt, Artificial Sequence
  derived and/or modified sequence opt3 from hemagglutinin__InfluenzaA__EPI344389
augaagaccaucauugccuucagcugcauacugugucucaucuuugcucagaaacuucccggcuccgacaacucuauggcaacacugugcuuggggcaccaugccgugccuaauggaacuuuagucaagacgauuaccgaugaccaaaucgagguuacaaacgcgacugaacuggugcagucaaguagcaccgguagaauuuguaauuccccacaccagauccuagauggcaaaaacugcacacucauagacgcucugcuuggggauccgcauugugacgaucugcagaauaaggagugggacuuguucguagaaaggucuaccgccuacucgaacugcuaucccuacuaugugccugauuacgcaacucuccggucacuggucgccagcaguggaaaucuggaguuuacacaagaauccuucaacuggaccggcguggcucaggacgguucuagcuaugcaugucgccgaggguccguuaauucauuuuucagucgucucaacugguuauacaaucugaacuauaaauacccagagcagaaugugacgaugcccaacaaugauaaguuugacaagcuguacaucuggggaguccaccauccuggcacugauaaagaccagaccaacuuguaugugcaagccagcggcagaguaauuguuucuacaaagaggucccagcagacugugaucccaaacauugggucacggcccuggguccgcggagugagcaguaucauaucuauuuacuggaccaucgugaaaccuggugacauucugcuaaucaauuccacaggcaaccucaucgcuccaagaggguauuucaagauucagagcggaaaaucgucuauaaugagguccgaugcccacaucgacgagugcaauucagaauguauuaccccgaacggcaguauccccaaugauaagccuuuucaaaacgucaauaagauaacguacggugcgugcccacgguauguuaaacagaacacucugaaacuugcaacagggaugcgcaaugugcccgagaagcagacccgaggaauuuucggcgccaucgcuggcuuuaucgaaaacgggugggagggaaugguagacgguugguacggcuucagacaccaaaauagcgaggggacuggacaggccgcagaucugaaguccacacaggcugccauuaaccagaucaccggcaaauugaauagggugauuaagaaaacgaacgaaaaguuucaucaaauagagaaggaguucucugaagucgaaggucggauccaggaccucgagaaauauguggaggauaccaagauugaccuguggagcuacaaugcggaauuacugguugcccucgagaaccagcacacaaucgaucuuacugacucagaaaugaguaaacuguucgagcguacccgcagacaguugagggaaaacgcagaggauauggggaauggcuguuuuaagaucuaccauaaaugcgacaacgcuugcauuggauccauacggaauggcacauaugaccacgauaucuaccgaaacgaggcccuaaauaaccgcuuccaaauuaagggggugcagcuuaagagcggauauaaagacuggauccucuggauuucuuuugcuaucucauguuuccugcuuugcgucgugcuguuggguuuuauaaugugggccugucagaagggcaauaucagaugcaacauuuguaucuga

SEQ ID NO: 135951 - RNA, 1701 nt, Artificial Sequence
  derived and/or modified sequence opt3 from hemagglutinin__InfluenzaA__EPI348782
augaagaccaucauugccuucagcugcauacugugucucaucuuugcucagaaacuucccggcuccgacaacucuauggcaacacugugcuuggggcaccaugccgugccuaauggaacuuuagucaagacgauuaccgaugaccaaaucgagguuacaaacgcgacugaacuggugcagucaaguagcaccgguagaauuuguaauuccccacaccagauccuagauggcaaaaacugcacacucauagacgcucugcuuggggauccgcauugugacgaucugcagaauaaggagugggacuuguucguagaaaggucuaccgccuacucgaacugcuaucccuacuaugugccugauuacgcaacucuccggucacuggucgccagcaguggaaaucuggaguuuacacaagaauccuucaacuggaccggcguggcucaggacgguucuagcuaugcaugucgccgaggguccguuaauucauuuuucagucgucucaacugguuauacaaacugaauuauaaguacccagagcagaacgugacgaugcccaauaacgauaaguuugacaaacuuuacaucuggggaguccaccauccuggcacugauaaggaccagaccaauauuuaugugcaagccagcggcagaguaaucguuucuacaaaaaggucccagcagacugugauuccaaacaucgggucacggcccuggguccgcggagugagcaguauaauuucuaucuacuggaccauugugaagccuggugacaucuugcugaucaacuccacaggcaaucuaauugcuccaagaggguauuucaaaauacagagcggaaagucgucuaucaugagguccgaugcccacauugacgagugcaacucagaauguaucaccccgaauggcaguauacccaacgauaagccuuuucaaaaugucaacaaaauuacguacggugcgugcccacgguauguuaagcagaauacucucaaacuggcaacagggaugcgcaacgugcccgagaagcagacccgaggaaucuucggcgccaucgcuggcuuuauugaaaaugggugggagggaaugguagacgguugguacggcuucagacaccaaaacagcgaggggacuggacaggccgcagaucuuaaauccacacaggcugccaucaaucagauuaccggcaagcugaacagggugauaaagaagacgaaugaaaaguuucaucaaaucgagaaagaguucucugaagucgaaggucggauucaggacuuggagaaguauguggaggauaccaaaaucgaccucuggagcuacaacgcggaacuguuaguugcccuggagaaucagcacacaaucgaucucacugacucagaaaugaguaaacuuuucgagcguacccgcagacagcugagggaaaacgcagaggauauggggaacggcuguuuuaaaauuuaccauaagugcgacaaugcuugcauaggauccauccggaacggcacauaugaccacgauauuuaccgaaaugaggccuugaacaaucgcuuccaaaucaagggggugcagcuaaaaagcggauauaaggacuggauucuguggaucucuuuugcuauaucauguuuccuccugugcgucgugcuucuggguuuuaucaugugggccugucagaaaggcaacauuagaugcaauaucuguauuuga

SEQ ID NO: 135952 - RNA, 1701 nt, Artificial Sequence
  derived and/or modified sequence opt3 from hemagglutinin__InfluenzaA__EPI642513
augaagaccaucauugccuucagcugcauacugugucucaucuuugcucagaaacuucccggcuccgacaagucuauggcaacacugugcuuggggcaccaugccgugccuaacggaacuuuagucaaaacgauuaccgaugaccaaaucgagguuacaaaugcgacugaacuggugcagucaaguagcaccuccagaauuuguaacucuccacaccagauccuagaugguaagaauugcacacucauagacgcucugcuuggcgauccgcauugugacgauuuccagaacaaaaagugggaccuguuuguagagaggucgaccgccuacucaaauugcuaucccuacuaugugccugauuacgcaacuuugcggagccucaucgccaguuccgggaaccuggaguucacacaagaaucuuuuaauuggaccggagucgcucaggacggcagcuccuaugcaugucgccgagguucagugaacaguuucuuuagccgucugaauuggcucuacaacuuaaauuauaaguacccagaacagaacguuacgaugcccaauaacgauaaauucgacaagcuguacauuuggggagugcaccauccugggacugauaaagaccagaccaaucuuuauguccaagccucuggcagagugaucguauccacaaagaggucacagcagacuguuauuccaaacaucggcagccggcccugggugcgcggggucaguucuauaauuuccaucuacuggaccauugugaaaccuggagacaucuugcugaucaacagcacagguaaucuaauugcuccaagaggcuauuuuaagauacagucggggaagucuuccaucaugaggucagaugcccacauugacgagugcaacagugaguguaucaccccgaauggaagcauacccaacgauaaaccuuuccaaaaugugaacaagauuacguacggcgcgugcccacgguaugucaaacagaauacucucaagcuggcaacagguaugcgcaacguucccgaaaaacagacccgagggaucuuuggagccaucgcuggcuucauugagaauggcugggaagggaugguggacggaugguacgguuuuagacaccaaaacuccgagggcacugggcaggccgcagaucuuaagucuacacaggcugccaucaaucagauuaccggaaaacugaacaggguaauaaagaagacgaaugagaaauuccaucaaaucgaaaaggaguucagcgaaguggagggccggauucaggacuuggaaaaauaugucgaggauaccaagaucgaccucuggucauacaacgcggagcuguuaguggcccuggaaaaucagcacacaaucgaucucacugacagugagauguccaaacuuuuugaacguacccgcagacagcugagggagaacgcagaagauauggguaacggguguuucaagauuuaccauaagugcgacaaugcuugcauaggcagcauccggaacggaacauaugaccacgauauuuaccgaaaugaggccuugaacaaucgcuuucaaaucaaaggcguucagcuaaagucuggguauaaagacuggauucuguggaucucauucgcuauaaguuguuuucuccugugcgugguccuucugggauucaucaugugggccugucagaaggguaacauuagaugcaauaucuguauuuga

SEQ ID NO: 135953 - RNA, 1701 nt, Artificial Sequence
  derived and/or modified sequence opt3 from hemagglutinin__InfluenzaA__EPI293965
augaagaccaucauugccuucagcugcauacugugucucaucuuugcucagaaacuucccggcuccgacaacucuauggcaacacugugcuuggggcaccaugccgugccuaauggaacuuuagucaagacgauuaccgaugaccaaaucgagguuacaaacgcgacugaacuggugcagucaaguagcaccgguagaauuuguaauuccccacaccagauccuagauggcaaaaacugcacacucauagacgcucugcuuggggauccgcauugugacgauuuccagaauaaggagugggaccuguuuguagaaaggucuaccgccuacucgaacugcuaucccuacuaugugccugauuacgcaacuuugcggucacucgucgccagcaguggaaaucuggaguucacacaagaauccuuuaacuggaccggcguggcucaggacgguucuagcuaugcaugucgccgaggguccguuaauucauucuuuagucgucugaacuggcucuacaauuuaaacuauaaauacccagagcagaaugugacgaugcccaacaaugauaaguucgacaagcuguacaucuggggaguccaccauccuggcacugauaaagaccagaccaaccuuuaugugcaagccagcggcagaguaauuguuucuacaaagaggucccagcagacugugaucccaaacauugggucacggcccuggguccgcggagugagcaguaucauaucuauuuacuggaccaucgugaaaccuggugacauuuugcugaucaauuccacaggcaaccuaaucgcuccaagaggguauuuuaagauucagagcggaaaaucgucuauaaugagguccgaugcccacaucgacgagugcaauucagaauguauuaccccgaacggcaguauccccaaugauaagccuuuccaaaacgucaauaagauaacguacggugcgugcccacgguauguuaaacagaacacucucaagcuggcaacagggaugcgcaaugugcccgagaaacagacccgaggaauuuuuggcgccaucgcuggcuucaucgaaaacgggugggagggaaugguagacgguugguacggcuuuagacaccaaaauagcgaggggacuggacaggccgcagaucuuaaguccacacaggcugccauuaaccagaucaccggcaaacugaauagggugauuaagaaaacgaacgaaaaguuccaucaaauagagaaggaguucucugaagucgaaggucggauccaggacuuggagaaauauguggaggauaccaagauugaccucuggagcuacaaugcggaacuguuaguugcccuggagaaccagcacacaaucgaucucacugacucagaaaugaguaaacuuuuugagcguacccgcagacagcugagggaaaacgcagaggauauggggaauggcuguuucaagaucuaccauaaaugcgacaacgcuugcauuggauccauacggaauggcacauaugaccacgauaucuaccgaaacgaggccuugaauaaccgcuuucaaauuaagggggugcagcuaaagagcggauauaaagacuggauccuguggauuucuuucgcuaucucauguuuucuccugugcgucgugcuucuggguuucauaaugugggccugucagaagggcaauaucagaugcaacauuuguaucuga

SEQ ID NO: 135954 - RNA, 1701 nt, Artificial Sequence
  derived and/or modified sequence opt3 from hemagglutinin__InfluenzaA__EPI465400
augaagaccaucauugccuucagcugcauacugugucucaucuuugcucagaaacuucccggcuccgacaacucuauggcaacacugugcuuggggcaccaugccgugccuaauggaacuuuagucaagacgauuaccgaugaccaaaucgagguuacaaacgcgacugaacuggugcagucaaguagcaccgguagaauuuguaauuccccacaccagauccuagauggcaaaaacugcacacucauagacgcucugcuuggggauccgcauugugacgauuuccagaauaaggagugggaccuguuuguagaaaggucuaccgccuacucgaacugcuaucccuacuaugugccugauuacgcaacuuugcggucacucgucgccagcaguggaaaucuggaguucacacaagaauccuuuaacuggaccggcguggcucaggacgguucuagcuaugcaugucgccgaggguccguuaauucauucuuuagucgucugaacuggcucuacaauuuaaacuauaaauacccagagcagaaugugacgaugcccaacaaugauaaguucgacaagcuguacaucuggggaguccaccauccuggcacugauaaagaccagaccaaacuuuaugugcaagccagcggcagaguaauuguuucuacaaagaggucccagcagacugugaucccaaacauugggucacggcccuggguccgcggagugagcaguaucauaucuauuuacuggaccaucgugaagccuggugacauuuugcugaucaacuccacaggcaaucuaaucgcuccaagaggguauuuuaaaauucagagcggaaagucgucuauaaugagguccgaugcccacaucgacgagugcaacucagaauguauuaccccgaauggcaguauccccaacgauaagccuuuccaaaaugucaacaaaauaacguacggugcgugcccacgguauguuaagcagaauacucucaaacuggcaacagggaugcgcaacgugcccgagaagcagacccgaggaauuuuuggcgccaucgcuggcuucaucgaaaaugggugggagggaaugguagacgguugguacggcuuuagacaccaaaacagcgaggggacuggacaggccgcagaucuuaaauccacacaggcugccauuaaucagaucaccggcaagcugaacagggugauuaaaaagacgaaugaaaaguuccaucaaauagagaaagaguucucugaagucgaaggucggauccaggacuuggagaaguauguggaggauaccaaaauugaccucuggagcuacaacgcggaacuguuaguugcccuggagaaucagcacacaaucgaucucacugacucagaaaugaguaaacuuuuugagcguacccgcagacagcugagggaaaacgcagaggauauggggaacggcuguuucaagaucuaccauaagugcgacaaugcuugcauuggauccauacggaacggcacauaugaccacgauaucuaccgaaaugaggccuugaacaaucgcuuucaaauuaagggggugcagcuaaaaagcggauauaaggacuggauccuguggauuucuuucgcuaucucauguuuucuccugugcgucgugcuucuggguuucauaaugugggccugucagaaaggcaacaucagaugcaauauuuguaucuga

SEQ ID NO: 135955 - RNA, 1701 nt, Artificial Sequence
  derived and/or modified sequence opt3 from hemagglutinin__InfluenzaA__EPI328898
augaagaccaucauugccuucagcugcauacugugucucaucuuugcucagaaacuucccggcuccgacaacucuauggcaacacugugcuuggggcaccaugccgugccuaauggaacuuuagucaagacgauuaccgaugaccaaaucgagguuacaaacgcgacugaacuggugcagucaaguagcaccgguagaauuuguaauuccccacaccagauccuagauggcaaaaacugcacacucauagacgcucugcuuggggauccgcauugugacgauuuccagaauaaggagugggaccuguuuguagaaaggucuaccgccuacucgaacugcuaucccuacuaugugccugauuacgcaacuuugcggucacucgucgccagcaguggaaaucuggaguucacacaagaauccuuuaacuggaccggcguggcucaggacgguucuagcuaugcaugucgccgaggguccguuaauucauucuuuagucgucugaacuggcucuacaauuuaaacuauaaauacccagagcagaaugugacgaugcccaacaaugauaaguucgacaagcuguacaucuggggaguccaccauccuggcacugauaaagaccagaccaagauuuaugugcaagccagcggcagaguaaucguuucuacaaaaaggucccagcagacugugauuccaaacaucgggucacggcccuggguccgcggagugagcaguauaauuucuaucuacuggaccauugugaagccuggugacauccuuuugaucaacuccacaggcaaucugauugcuccaagaggguauuuuaaaauacagagcggaaagucgucuaucaugagguccgaugcccacauugacgagugcaacucagaauguaucaccccgaauggcaguauacccaacgauaagccuuuccaaaaugucaacaaaauuacguacggugcgugcccacgguauguuaagcagaauacucuaaaacucgcaacagggaugcgcaacgugcccgagaagcagacccgaggaaucuuuggcgccaucgcuggcuucauugaaaaugggugggagggaaugguagacgguugguacggcuuuagacaccaaaacagcgaggggacuggacaggccgcagaucugaaauccacacaggcugccaucaaucagauuaccggcaaacuuaacagggugauaaagaagacgaaugaaaaguuccaucaaaucgagaaagaguucucugaagucgaaggucggauucaggaccuggagaaguauguggaggauaccaaaaucgacuuguggagcuacaacgcggaacuccugguugccuuagagaaucagcacacaaucgaucugacugacucagaaaugaguaagcucuuugagcguacccgcagacagcuuagggaaaacgcagaggauauggggaacggcuguuucaaaauuuaccauaagugcgacaaugcuugcauaggauccauccggaacggcacauaugaccacgauauuuaccgaaaugaggcccugaacaaucgcuuucaaaucaagggggugcaguugaaaagcggauauaaggacuggauucuauggaucucuuucgcuauaucauguuuucugcucugcgucgugcugcuugguuucaucaugugggccugucagaaaggcaacauuagaugcaauaucuguauuuga

SEQ ID NO: 135956 - RNA, 1701 nt, Artificial Sequence; identical to SEQ ID NO: 135955
  derived and/or modified sequence opt3 from hemagglutinin__InfluenzaA__EPI328900

SEQ ID NO: 135957 - RNA, 1701 nt, Artificial Sequence
  derived and/or modified sequence opt3 from hemagglutinin__InfluenzaA__EPI574644
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcaaaaacuguacacucaucgacgcucugcuuggggauccgcagugcgacggauuucagaauaagaggugggaucuguucguggaacggagcaaagccuauuccaacuguuaccccuaugacgucccugauuacgcaucuuugcgcucgcucguggccucaagcggcacccuggaguuuaaugacgaaaguuucaacugggcugguguuacucaaaaugggacauccucugcaugcauucgaggaagcaacuccucauuuuucagucgucugaauuggcucacccauagcaacuuuaaguauccagccuuaaaugugacgaugcccaacaacgagcaguucgauaagcuguacaucuggggcguccaccauccuggcacugacaaagaucagauuuuucuuuaugcucacucuuccgggagaaucaccgugucaacaaagaggagccagcaagccguaauaccaaauauuggaagucggccccgcaucagaaacauuccuucuaggaucuccaucuacuggacuauuguuaaaccaggugacauauugcugaucaauagcaccggcaaccuaauugcgccgcggggguacuucaagauccagucgggaaaaucuuccauaaugcgcucagacgcacccauuggcaaguguaagagugagugcaucacaccuaaugguagcaucccaaacgauaaacccuuucagaaugugaaccgaauuaccuauggggccuguccuagauacgucaagcaguccacgcucaaacuggcuacuggaaugaggaaugugccagaaaagcaaacacggggcaucuucggcgccauugcaggguuuauagagaacggaugggaagguaugaaagacggcugguauggguuccgucaccaaaauucugagggacgcggccaggcugccgaucuuaagagcacccaggcggccaucgaccagauuaacgguaaacugaauagauugaucgggaagacuaacgagaaguuccaucagaucgaaaaagaguuuucagaaguggagggcaggauucaggaucucgaaaaguacgucgaggacacaaaaauagaucuguggaguuauaaugcagaguuacugguugcucucgaaaaccaacacaccaucgaccuuacggauuccgagaugaacaagcuguucgagaaaaccaagaagcaguugcgggaaaaugccgaagacaugggaaacggcugcuuuaaaauuuaccauaagugugauaaugcuugcaucgggagcauucgaaacggaacauaugaccacgacguguaccgcgaugaggcccuaaauaacagauuccagaucaaagguguagagcugaagucuggcuacaaagacuggauacucuggaucucauuugcaauuaguugcuuccugcuuuguguggcccuguugggguuuaucaugugggcuugccagaagggaaauauuagguguaacaucugcauauga

SEQ ID NO: 135958 - RNA, 1701 nt, Artificial Sequence
  derived and/or modified sequence opt3 from hemagglutinin__InfluenzaA__EPI563212
augaagaccaucauugcccugagcuacauacucugccuuguguucgcucagaaaauccccggcaacgacaauaacacagcaacucuguguuuggggcaccaugccgucccuaauggaacgauuguuaagaccaucacaaacgauagaauugaggugacuaaugcgaccgaauuaguacaaaacuccucuaucggugagauaugcgacucaccacaccagauccuggauggcgaaaauuguacacuaauugacgcucuccugggggauccgcagugcgacggauuucagaacaaaaagugggaucuuuucguggagaggaguaaagccuauagcaauuguuaccccuaugacgucccugauuacgcaucccugcggucuuugguggccucgucaggcacccucgaauuuaacaaugagagcuucaacuggacugguguuacacaaaaugggaccaguuccgcuugcauccgccgaucuagcuccucauuuuucagucgucugaacuggcugacgcaucucaauuauaaguacccagcauuaaacgugacuaugcccaacaaugagcaguuugacaagcuguauauuuggggaguccaccauccuggcaccgauaaagaccagaucuucccauacgcccagagcucuggcagaauaacaguguccacuaagaggucacaacaggcuguaauucccaacaucgggagccggccucgcauuagaggaaucccaaguaggaucucuauuuacuggaccauaguuaaaccgggugauauccuuuugauuaauuccacaggcaaccugaucgcgccccggggguauuuuaagauacgcagcggaaaaucgucuauuaugcgauccgacgccccuaucggcaaguguaagucagaaugcaucaccccaaaugguaguauucccaacgacaaaccuuuccagaaugugaacagaaucacguacggggcauguccaagguaugucaagcacagcacucuaaaacucgccacaggaaugcggaaugugcccgagaagcagacccguggcauuuuuggcgcuauagccggguucaucgaaaacggaugggaggguaugguggauggcugguacggguuucgccaccaaaauuccgagggaagaggccaggcagcugaccugaaaucuacucaggccgcgauugaucaaaucaacgguaaacuuaauaggcugaucgggaaaacaaacgaaaaguuccaucagauugagaaggaguucagcgaagucgaaggccggauacaggacuuggagaaauauguugaggauaccaagaucgaccucuggucauacaaugccgaacuguuaguggcacuggagaaccagcacacgauugaucucaccgacagugaaaugaacaaacuuuuugagaagacaaagaagcaacugcgagaaaaugcugaggauaugggaaacggcugcuucaagaucuaucauaaaugugacaaugccugcauuggguccauccgcaacggaacuuacgaucacaauguauacagagacgaggcuuugaacaauagguuucagauaaaggguguggaacuaaaaagcggcuauaaggacuggauccuguggauuucuuucgccaucucaugcuuucuccugugugucgcacuucugggguucauuaugugggccugccagaaaggaaacauccgguguaauauaugcauuuga

SEQ ID NO: 135959 - RNA, 1701 nt, Artificial Sequence; identical to SEQ ID NO: 135958
  derived and/or modified sequence opt3 from hemagglutinin__InfluenzaA__EPI553999

SEQ ID NO: 135960 - RNA, 1701 nt, Artificial Sequence
  derived and/or modified sequence opt3 from hemagglutinin__InfluenzaA__EPI551570
augaagaccaucauugcccugagcuacauacucugccuuguguucgcucagaaaauccccggcaacgacaauaacacagcaacucuguguuuggggcaccaugccgucccuaauggaacgauuguuaagaccaucacaaacgauagaauugaggugacuaaugcgaccgaauuaguacaaaacuccucuaucggugagauaugcgacucaccacaccagauccuggauggcgaaaauuguacacuaauugacgcucuccugggggauccgcagugcgacggauuucagaacaaaaagugggaucuuuucguggagaggaguaaagccuauagcaauuguuaccccuaugacgucccugauuacgcaucccugcggucuuugguggccucgucaggcacccucgaauuuaacaaugagagcuucaacuggacugguguuacacaaaaugggaccaguuccgcuugcauccgccgaucuagcuccucauuuuucagucgucugaacuggcugacgcaucucaauuauacuuacccagcauuaaacgugaccaugcccaacaaugagcaguuugacaagcuguauauuuggggaguccaccauccuggcacagauaaggaccagaucuuccuuuacgcccagagcucuggcagaauaacuguguccaccaaaaggucacaacaggcuguaauuccaaacaucgggagccggccccgcauuagagauaucccuaguaggaucucuauuuacuggacaauaguuaagccaggagacaucuugcugauuaauuccaccgguaaccuaaucgccccgcggggcuauuuuaaaauacgcagcgggaagucgucuauuaugcgauccgacgcgcccaucggaaaauguaagucagaaugcaucacgccuaauggcaguauuccaaacgauaagcccuuccagaaugugaacagaaucacuuacggugcauguccuagguaugucaaacacagcacacucaagcuggccaccgggaugcggaaugugccagagaaacagacucguggaauuuuuggcgcuauagccggcuucaucgaaaacgggugggagggaaugguggacgguugguacggcuuucgccaccaaaauuccgaggggagaggacaggcagcugaucuuaagucuacacaggccgcgauugaccaaaucaacggcaaacugaauagguugaucgguaagaccaacgaaaaauuccaucagauugagaaggaguucagcgaagucgaagggcggauacaggaucucgagaaguauguugaggacacgaaaaucgaucuguggucauacaaugccgaauuacugguggcacucgagaaccagcacaccauugaccuuacagauagugaaaugaacaagcuguuugagaaaacuaagaaacaauugcgagaaaaugcugaggacaugggcaacggaugcuucaagaucuaucauaagugugauaaugccugcauuggcuccauccgcaacgggaccuacgaccacaauguauacagagacgaggcucuaaacaauagguuucagauaaaaggaguggaacucaagagcgguuauaaagauuggauccuguggauuucuuucgccaucucaugcuuucugcuuugugucgcacuguugggcuucauuaugugggccugccagaaggggaacauccgguguaauauaugcauuuga

SEQ ID NO: 135961 - RNA, 1701 nt, Artificial Sequence
  derived and/or modified sequence opt3 from hemagglutinin__InfluenzaA__EPI629738
augaagaccaucauugcccugagcuacauacucugccuuguguucgcucagaaaauccccggcaacgacaauaacacagcaacucuguguuuggggcaccaugccgucccuaauggaacgauuguuaagaccaucacaaacgauagaauugaggugacuaaugcgaccgaauuaguacaaaacuccucuaucggugagauaugcgacucaccacaccagauccuggauggcgaaaauuguacacuaauugacgcucuccugggggauccgcagugcgacggauuucagaacaaaaagugggaucuuuucguggagaggaguaaagccuauagcaauuguuaccccuaugacgucccugauuacgcaucccugcggucuuugguggccucgucaggcacccucgaauuuaacaaugagagcuucaacuggacugguguuacacaaaaugggaccaguuccgcuugcauccgccgaucuagcuccucauuuuucagucgucugaacuggcugacgcaucucaauuauaaguacccagcauuaaacgugacuaugcccaacaaugagcaguuugacaagcuguauauuuggggaguccaccauccuggcaccgauaaagaccagaucuucccauacgcccagagcucuggcagaauaauuguguccacaaagaggucacaacaggcuguaauccccaacauugggagccggccucgcaucagagauaucccaaguaggauuucuauauacuggacuaucguuaaaccgggagacauucuuuugaucaauuccaccgguaaccugauagcgccccggggcuauuuuaagauucgcagcgggaaaucgucuaucaugcgauccgacgccccuaucggaaaguguaagucagaaugcauuacaccaaauggcaguauccccaacgauaaaccuuuccagaaugugaacagaauuaccuacggugcauguccaagguaugucaagcacagcacgcuaaaacucgccacugggaugcggaaugugcccgagaagcagacacguggaauauuuggcgcuaucgccggcuucauugaaaacgggugggagggaaugguggacgguugguacggcuuucgccaccaaaauuccgaggggagaggacaggcagcugaucugaaaucuacccaggccgcgaucgaccaaaucaacggcaaacuuaauaggcugauugguaagacuaacgaaaaguuccaucagauagagaaggaguucagcgaagucgaagggcggauccaggauuuggagaaauauguugaggacacaaagauugaucucuggucauacaaugccgaacuguuaguggcacuggagaaccagcacaccaucgaccucacggauagugaaaugaacaaacuuuuugagaagaccaaaaagcaacugcgagaaaaugcugaggacaugggcaacggaugcuucaagauuuaucauaaaugugauaaugccugcaucggcuccauacgcaacgggacauacgaccacaauguauacagagacgaggcuuugaacaauagguuucagaucaagggaguggaacuaaaaagcgguuauaaggauuggauucuguggaucucuuucgccauuucaugcuuucuccugugugucgcacuucugggcuucaucaugugggccugccagaaagggaacauacgguguaauauuugcaucuga

SEQ ID NO: 135962 - RNA, 1701 nt, Artificial Sequence
  derived and/or modified sequence opt3 from hemagglutinin__InfluenzaA__EPI631887
augaagaccaucauugcccugagcuacauacucugccuuguguucgcucagaaaauccccggcaacgacaauaacacagcaacucuguguuuggggcaccaugccgucccuaauggaacgauuguuaagaccaucacaaacgauagaauugaggugacuaaugcgaccgaauuaguacaaaacuccucuaucggugagauaugcgacucaccacaccagauccuggauggcgaaaauuguacacuaauugacgcucuccugggggauccgcagugcgacggauuucagaacaaaaagugggaucuuuucguggagaggaguaaagccuauagcaauuguuaccccuaugacgucccugauuacgcaucccugcggucuuugguggccucgucaggcacccucgaauuuaacaaugagagcuucaacuggacugguguuacacaaaaugggaccaguuccgcuugcauccgccgaucuagcuccucauuuuucagucgucugaacuggcugacgcaucucaauuauaaguacccagcauuaaacgugacuaugcccaacaaugagcaguuugacaagcuguauauuuggggaguccaccauccuggcaccgauaaagaccagaucuucccauacgcccagagcucuggcagaauaauuguguccacaaagaggucacaacaggcuguaauccccaacauugggagccggccucgcaucagagauaguccaucuaggaucuccauuuacuggacuauaguuaaaccgggagacauccuuuugauuaauagcaccgguaaccugaucgcgccccggggcuauuuuaagauacgcucggggaaaucuuccauuaugcgaucagacgccccuaucggaaaguguaagagugaaugcaucacaccaaauggcagcauucccaacgauaaaccuuuccagaaugugaacagaaucaccuacggugcauguccaagguaugucaagcacuccacgcuaaaacucgccacugggaugcggaaugugcccgagaagcagacacguggaauuuuuggcgcuauagccggcuucaucgaaaacgggugggagggaaugguggacgguugguacggcuuucgccaccaaaauucugaggggagaggacaggcagcugaucugaaaagcacccaggccgcgauugaccaaaucaacggcaaacuuaauaggcugaucgguaagacuaacgaaaaguuccaucagauugagaaggaguucucagaagucgaagggcggauacaggauuuggagaaauauguugaggacacaaagaucgaucucuggaguuacaaugccgaacuguuaguggcacuggagaaccagcacaccauugaccucacggauuccgaaaugaacaaacuuuuugagaagaccaaaaagcaacugcgagaaaaugcugaggacaugggcaacggaugcuucaagaucuaucauaaaugugauaaugccugcauuggcagcauccgcaacgggacauacgaccacaauguauacagagacgaggcuuugaacaauagguuucagauaaagggaguggaacuaaaaucugguuauaaggauuggauccuguggauuucauucgccaucaguugcuuucuccugugugucgcacuucugggcuucauuaugugggccugccagaaagggaacauccgguguaauauaugcauuuga

SEQ ID NO: 135963 - RNA, 1701 nt, Artificial Sequence
  derived and/or modified sequence opt3 from hemagglutinin__InfluenzaA__EPI577026
augaagaccaucauugcccugagcuacauacucugccuuguguucgcucagaaaauccccggcaacgacaauaacacagcaacucuguguuuggggcaccaugccgucccuaauggaacgauuguuaagaccaucacaaacgauagaauugaggugacuaaugcgaccgaauuaguacaaaacuccucuaucggugagauaugcgacucaccacaccagauccuggauggcgaaaauuguacacuaauugacgcucuccugggggauccgcagugcgacggauuucagaacaaaaagugggaucuuuucguggagaggaguaaagccuauagcaauuguuaccccuaugacgucccugauuacgcaucccugcggucuuugguggccucgucaggcacccucgaauuuaacaaugagagcuucaacuggacugguguuacacaaaaugggaccaguuccgcuugcauccgccgaucuagcuccucauuuuucagucgucugaacuggcugacgcaucucaauuauaaguacccagcauuaaacgugacuaugcccaacaaugagcaguuugacaagcuguauauuuggggaguccaccauccuggcaccgauaaagaccagaucuucccauacgcccagagcucuggcagaauaacaguguccacuaagaggucacaacaggcuguaauucccaacaucgggagccggccucgcauuagaggaaucccaaguaggaucucuauuuacuggaccauaguuaaaccgggugauauccuuuugauuaauuccacaggcaaccugaucgcuccccggggguauuuuaagauacgcagcggaaaaucgucuauuaugcgauccgacgcgccuaucggcaaguguaagucagaaugcaucaccccaaaugguaguauucccaacgacaaaccuuuccagaaugugaacagaaucacguacggggcauguccaagguaugucaagcacagcacucuaaaacucgccacaggaaugcggaaugugcccgagaagcagacccguggcauuuuuggcgcuauagccggguucaucgaaaacggaugggaggguaugguggauggcugguacggguuucgccaccaaaauuccgagggaagaggccaggcagcugaccugaaaucuacucaggccgcgauugaucaaaucaacgguaaacuuaauaggcugaucgggaaaacaaacgaaaaguuccaucagauugagaaggaguucagcgaagucgaaggccggauacaggacuuggagaaauauguugaggauaccaagaucgaccucuggucauacaaugccgaacuguuaguggcacuggagaaccagcacacgauugaucucaccgacagugaaaugaacaaacuuuuugagaagacaaagaagcaacugcgagaaaaugcugaggauaugggaaacggcugcuucaagaucuaucauaaaugugacaaugccugcauugaguccauccgcaacgggacuuacgaucacaauguauacagagacgaagccuugaacaauagguuucagauaaagggaguggagcuaaaaagcgguuauaaggacuggauccuguggauuucuuucgccaucucaugcuuucuccugugugucgcacuucugggcuucauuaugugggccugccagaaagggaacauccgguguaauauaugcauuuga

SEQ ID NO: 135964 - RNA, 1701 nt, Artificial Sequence; identical to SEQ ID NO: 132010
  derived and/or modified sequence opt3 from hemagglutinin__InfluenzaA__EPI404927

SEQ ID NO: 135965 - RNA, 1701 nt, Artificial Sequence
  derived and/or modified sequence opt3 from hemagglutinin__InfluenzaA__EPI489319
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcaagcgcggaagcaauuccucauuuuucagucgacugaacuggcucacccauuuaaauuuuaaguauccagcccugaacgugacgaugcccaacaaugagcaguucgacaaacuuuacauuuggggcguccaccauccuggcacugauaaggaccagaucuuuccauaugcucagagcucugggcguauuaccguguccacaaaaagaucacaacaggccguaauccccaacauaggaagcaggccucggauucgcaauaucccaaguagaauuucuaucuacuggacuaucguuaagccgggugauauuuugcugauaaacuccaccggcaaucuaaucgcgcccaggggguacuucaaaauucggagcggaaagucgucuaucaugcgcuccgacgcaccuauaggcaaguguaaaucagaaugcauuacaccaaacgguaguauccccaaugacaagccuuuucagaacgugaaucgaaucaccuauggggccuguccaagauacgucaaacagagcacgcucaagcuggcuacuggaaugaggaacgugcccgagaaacaaacacggggcauuuucggcgccaucgcaggguuuauugaaaauggaugggaggguaugguggauggcugguauggguuccgucaccagaacuccgagggacgcggccaggcugccgaccuuaagucuacccaagcggccauagaucagaucaaugguaaacugaacagauugauugggaagacuaaugaaaaguuccaccagaucgagaaagaauuuagcgaggucgaaggcaggauccaggaccucgagaaguacguugaggauacaaaaauugaccuguggucauauaacgcagaauuacugguggcucucgagaaccaacauaccauagaucuuacggacagugaaaugaauaagcuguucgagaaaaccaagaagcaguugcgggaaaacgccgaggauaugggaaauggcugcuuuaaaaucuaccacaagugugacaacgcuugcauuggguccauccgaaauggaacauaugaucaugacguauaccgcgacgaggcccuaaacaauagauuccagauuaaagguguggaacucaagagcggcuacaaagauuggauccuguggauaucuuuugcaaucucaugcuuccugcuuugugucgcccuguugggguuuauuaugugggcuugccagaagggaaacaucagguguaauauuugcaucuga

SEQ ID NO: 135966 - RNA, 1701 nt, Artificial Sequence; identical to SEQ ID NO: 134443
  derived and/or modified sequence opt3 from hemagglutinin__InfluenzaA__EPI530647

SEQ ID NO: 135967 - RNA, 1701 nt, Artificial Sequence; identical to SEQ ID NO: 134457
  derived and/or modified sequence opt3 from hemagglutinin__InfluenzaA__EPI541083

SEQ ID NO: 135968 - RNA, 1701 nt, Artificial Sequence
  derived and/or modified sequence opt3 from hemagglutinin__InfluenzaA__EPI684315
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcuccucaaguuucuucagccgucugaauuggcugacgcaucucaacuauaaguacccagcauuaaaugugacuaugcccaacaacgagcaguuugacaagcuguauauuuggggaguccaccauccuggcaccgauaaagaccagaucuucccauacgcccagucuuccggcagaauaauugugucaacaaagaggagccaacaggcuguaauccccaauauugggagucggccucgcaucagagauaucccaucuaggauuuccauauacuggacuaucguuaaaccgggagacauucuuuugaucaacagcaccgguaaucugauagcgccccggggcuauuuuaagauucgcucggggaaaucuuccaucaugcgaucagacgccccuaucggaaaguguaagagugaaugcauuacaccaaacggcagcauccccaaugauaaaccuuuccagaacgugaauagaauuaccuacggugcauguccaagguaugucaagcacuccacgcuaaaacucgccacugggaugcggaacgugcccgagaagcagacacguggaauauuuggcgcuaucgccggcuucauugaaaaugggugggagggaaugguggacgguugguacggcuuucgccaccaaaacucugaggggagaggacaggcagcugaucugaaaagcacccaggccgcgaucgaccaaaucaauggcaaacuuaacaggcugauugguaagacuaaugaaaaguuccaucagauagagaaggaauuuucagaggucgaagggcggauccaggauuuggagaaauauguugaggacacaaagauugaucucuggaguuacaacgccgaacuguuaguggcacuggagaaucagcacaccaucgaccucacggauuccgaaaugaacaaacuuuuugagaagaccaaaaagcaacugcgagaaaacgcugaggacaugggcaauggaugcuucaagauuuaucauaaaugugauaacgccugcaucggcagcauacgcaaugggacauacgaccacaacguauacagagacgaggcuuugaauaacagguuucagaucaagggaguggaacuaaaaucugguuauaaggauuggauucuguggaucucauucgccauuaguugcuuucuccugugugucgcacuucugggcuucaucaugugggccugccagaaagggaauauacgguguaacauuugcaucuga

SEQ ID NO: 135969 - RNA, 1701 nt, Artificial Sequence
  derived and/or modified sequence opt3 from hemagglutinin__InfluenzaA__EPI614462
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucuagcugcauucgcggauccaauucaaguuucuucagccgacugaacuggcucacccauuuaaauucuaaguauccagcacugaacgugacgaugcccaacaaugagcaguuugacaaacuuuacaucuggggcguccaccauccuggcacugauaaggaccagauuuucuuguaugcccaguccucagggcguaucaccgugagcacaagaaggagucaacaggcuguaauaccaaacauuggaucucggccccgcaucagagauauuccuuccaggaucagcaucuacuggacuauuguuaagccaggugacauacugcuaaucaauucgaccggcaaccucauugccccgcggggguacuuuaaaauccgcucuggaaaguccucaauaaugcgaagugacgcgcccauuggcaaauguaagagcgaaugcaucacaccuaaugguuccaucccaaacgauaagcccuuccagaaugugaacagaauuaccuauggggcauguccuagguacgucaaacagucuacgcugaaacuugccacuggaaugcggaaugugccagagcgucaaacacgcggcaucuuuggcgcuauugccggguucauagaaaacggaugggaggguaugguggacggcugguauggguuuagacaccagaauagcgagggaaggggccaggcagcugaucugaagucaacccaagccgcgaucgaccagauuaacgguaaguugaaucggcucaucgggaaaacuaacgaaaaguuccaccagaucgagaaagaauuuagugaggucgaaggccgcauucaggaucuggagaaguacguugaggacacaaagauagauuuaugguccuauaaugccgaacugcucguggcacuugagaaccaacauaccaucgaccugacggauagcgaaaugaacaaauuguuugagaagaccaaaaagcagcuacgagaaaaugcugaggacaugggaaacggcugcuucaaaauuuaccacaagugugauaaugccugcaucgggucuauuagaaacggaacauaugaccaugacguauacagggaugaggcucugaauaaccgguuucagaucaaggguguggaacucaaaucaggcuacaaggacuggauacuguggaucaguuucgccauuagcugcuuucuucugugugucgcauugcucggguucaucaugugggccugccagaaaggaaauauucgcuguaacaucugcauauga

SEQ ID NO: 135970 - RNA, 1701 nt, Artificial Sequence
  derived and/or modified sequence opt3 from hemagglutinin__InfluenzaA__EPI541465
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucuagcugcauucgcggauccaauaacucauuuuucagucgacugaauuggcucacccauuuaaacagcaaguauccagcacugaacgugacgaugcccaauaacgagcaguuugacaaacuuuacaucuggggcguccaccauccuggcacugauaaggaccagauuuucuuguaugcccagucuuccgggcguaucaccgugucaacaagaaggagccaacaggcuguaauaccaaauauuggaagucggccccgcaucagagguauuccuucuaggaucuccaucuacuggacuauuguuaagccaggcgauauacugcuaaucaacagcaccgggaaucucauugccccgcggggauacuuuaaaauccgcucgggcaagucuuccauaaugcgaucagacgcgcccauugguaaauguaagagugaaugcaucacaccuaacgggagcaucccaaaugacaagcccuuccagaacgugaauagaauuaccuauggagcauguccuagguacgucaaacaguccacgcugaagcuggccacuggcaugcggaacgugccagagcgucaaacacgcggcaucuuuggggcuauugccggauucauagaaaaugguugggagggcaugguggaugggugguauggauuuagacaccagaacucugagggcaggggucaggcagcugaccuuaaaagcacccaagccgcgaucgaucagauuaaugggaaguugaaccggcucaucggcaaaacuaaugaaaaguuccaccagaucgagaaagaguucucagaagucgaaggacgcauucaggaccuggagaaguacguugaggauacaaagauagacuuauggaguuauaacgccgaacugcucguggcacuugagaaccaacauaccaucgaucugacggacuccgaaaugaauaaauuguuugagaagaccaaaaagcagcuacgagaaaacgcugaggauaugggcaaugggugcuucaaaauuuaccacaagugugacaacgccugcaucggaagcauuagaaaugguacauaugaucaugacguauacagggacgaggcucugaacaaucgguuucagaucaagggcguggaacucaaaucuggguacaaggauuggauacuguggaucucauucgccauuaguugcuuucuucugugugucgcauugcucggauucaucaugugggccugccagaaaggcaacauucgcuguaauaucugcauauga

SEQ ID NO: 135971 - RNA, 1701 nt, Artificial Sequence
  derived and/or modified sequence opt3 from hemagglutinin__InfluenzaA__EPI696967
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucuagcugcauucgcggauccaauucaaguuucuuuagccgacugaacuggcucacccguuuaaauucuaaguauccagcacugaacgugacgaugcccaacaaugagcaguuugacaaacuuuacaucuggggcguccaucacccugaaacugauaaggaccagauuuucuuguaugcccaguccucaggcagaaucaccgugagcacaaggcggagucaacaggcuguaauaccaaacauugggucucgccccagaaucagggguauuccuucccggaucagcaucuacuggacuauuguuaagccaggagauauacugcuaaucaauucgaccggcaaccucauugccccgcgcggguacuuuaaaauccgaucuggaaaguccucaauaaugagaagugacgcgcccauuggcaaauguaagagcgagugcaucacaccuaaugguuccaucccaaacgacaagcccuuccagaaugugaacaggauuaccuauggggcauguccucgguacgucaaacagucuacgcugaaacuugccacuggaaugcguaaugugccagaacgccaaacaagaggcaucuuuggcgcuauugccggguucauagagaacggaugggaggguaugguggauggcugguauggguuuaggcaucagaauagcgaaggacggggccaggcagcugaccugaagucaacccaagccgcgaucgaucagauuaacgguaaguugaaucgacucaucgggaaaacuaacgagaaguuccaccagaucgaaaaagaguucagugaagucgagggccgcauucaggaccuggagaaguacguugaagauacaaagauagacuuaugguccuauaaugccgagcugcucguggcacuugaaaaccaacacaccaucgaucugacggacagcgagaugaacaaauuguuugaaaagaccaaaaagcagcuaagagagaaugcugaggauaugggaaacggcugcuucaaaauuuaccauaagugugacaaugccugcaucgggucuauuaggaacggaacauaugaucacgacguauaccgggacgaagcucugaauaaccgcuuucagaucaaggguguggagcucaaaucaggcuacaaggauuggauacuguggaucaguuucgccauuagcugcuuucuucugugugucgcauugcucggguucaucaugugggccugccagaaaggaaauauuagauguaacaucugcauauga

SEQ ID NO: 135972 - RNA, 1701 nt, Artificial Sequence
  derived and/or modified sequence opt3 from hemagglutinin__InfluenzaA__EPI674597
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucuagcugcauucgcggauccaauaacucauuuuucagucgacugaauuggcucacccauuuaaacagcaaguauccagcacugaacgugacgaugcccaauaacgagcaguuugacaaacuuuacaucuggggcguccaccauccugugacugauaaggaccagauuuucuuguaugcccagucuuccggccguaucaccguaucaacaagaaggagccaacaggcuguuauaccaaauauugggagucggccccgcaucagagguauuccuucuaggaucuccaucuacuggacuauugugaagccaggagauauacugcuaaucaacagcaccggcaaucucauugccccgcggggguacuuuaaaauccgcucgggaaagucuuccauaaugcgaucagacgcgcccauuggcaaauguaagagugaaugcaucacaccuaacgguagcaucccaaaugacaagcccuuccagaacgucaauagaauuaccuauggggcauguccuagguacgugaaacaguccacgcugaagcuggccacuggaaugcggaacgugccagagcgucaaacacgcggcaucuuuggcgcuauugccggguucauagaaaauggaugggaggguauggucgauggcugguauggguuuagacaccagaacucugagggaaggggccaggcagcugaccuuaaaagcacccaagccgcgaucgaucagauuaaugguaaguugaaccggcucaucgggaaaacuaaugaaaaguuccaccagaucgagaaagaguucucagaaguugaaggccgcauucaggaccuggagaaguacguggaggauacaaagauagacuuauggaguuauaacgccgaacugcucguagcacuugagaaccaacauaccaucgaucugacggacuccgaaaugaauaaauuguuugagaagaccaaaaagcagcuacgagaaaacgcugaggauaugggaaauggcugcuucaaaauuuaccacaagugugacaacgccugcaucgggagcauuagaaauggaacauaugaucaugacguguacagggacgaggcucugaacaaucgguuucagaucaagggugucgaacucaaaucuggcuacaaggauuggauacuguggaucucauucgccauuaguugcuuucuucuguguguggcauugcucggguucaucaugugggccugccagaaaggaaacauucgcuguaauaucugcauauga

SEQ ID NO: 135973 - RNA, 1701 nt, Artificial Sequence
  derived and/or modified sequence opt3 from hemagglutinin__InfluenzaA__EPI530677
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucuagcugcauucgcggauccaauucaaguuucuucagccgacugaacuggcucacccauuuaaauucuaaguauccagcacugaacgugacgaugcccaacaaugagcaguuugacaaacuuuacaucuggggcguccaccauccuggcacugauaaggaccagauuuucuuguaugcccaguccucagggcguaucaccgugagcacaaagagaagucaacaggcuguaauaccaaacauuggaucuaggccccggauccgcgauauuccuuccagaaucagcaucuacuggacuauuguuaaaccaggugacauacugcuaaucaauucgaccggcaaccucauugccccgaggggguacuuuaagauccggucuggaaaauccucaauaaugcgcagugacgcgcccauuggcaaguguaagagcgaaugcaucacaccuaaugguuccaucccaaacgauaaacccuuccagaaugugaaccgaauuaccuauggggcauguccuagauacgucaagcagucuacgcugaaacuugccacuggaaugaggaaugugccagagaagcaaacacggggcaucuuuggcgcuauugccggguucauagaaaacggaugggaggguaugguggacggcugguauggguuucgucaccagaauagcgagggacgcggccaggcagcugaucugaaaucaacccaagccgcgaucgaccagauuaacgguaaguugaauagacucaucgggaaaacuaacgaaaaguuccaccagaucgagaaggaauuuagugaggucgaaggcaggauucaggaucuggagaaauacguugaggacacaaagauagauuuaugguccuauaaugccgaacugcucguggcacuugagaaccaacauaccaucgaccugacggauagcgaaaugaacaaauuguuugagaagaccaaaaagcagcuacgggaaaaugcugaggacaugggaaacggcugcuucaagauuuaccacaaaugugauaaugccugcaucgggucuauucgaaacggaacauaugaccaugacguauaccgcgaugaggcucugaauaacagauuucagaucaaggguguggaacucaaaucaggcuacaaggacuggauacuguggaucaguuucgccauuagcugcuuucuucugugugucgcauugcucggguucaucaugugggccugccagaaaggaaauauuagguguaacaucugcauauga

SEQ ID NO: 135974 - RNA, 1701 nt, Artificial Sequence
  derived and/or modified sequence opt3 from hemagglutinin__InfluenzaA__EPI530679
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucuagcugcauucgcggauccaauucaaguuucuuuagccgacugaacuggcucacccauuuaaauuuuaaguauccagcacugaacgugacgaugcccaacaaugagcaguucgacaaguuguacaucuggggcguccaccauccuggcacugauaaagaccagauuuuucuuuaugcccagucuuccgggcguaucaccgugucaacaaagagaagccaacaggcuguaauaccaaacauuggaaguaggccccggauccgcgauauuccuucuagaaucuccaucuacuggacuauuguuaaaccaggugacauacugcuaaucaauagcaccggcaaccucauugccccgaggggguacuucaagauccggucgggaaaaucuuccauaaugcgcucagacgcgcccauuggcaaguguaagagugaaugcaucacaccuaaugguagcaucccaaacgauaaacccuuucagaaugugaaccgaauuaccuauggggcauguccuagauacgucaagcaguccacgcugaaacuugccacuggaaugaggaaugugccagagaagcaaacacggggcaucuucggcgcuauugccggguuuauagaaaacggaugggaggguaugguggacggcugguauggguuccgucaccaaaauucugagggacgcggccaggcagcugaucugaaaagcacccaggccgcgaucgaccagauuaacgguaaguugaauagacucaucgggaaaacuaacgaaaaguuccaccagaucgagaaggaauuuucagaggucgaaggcaggauucaggaucuggagaaauacguugaggacacaaagauagauuuauggaguuauaaugccgaacugcucguggcacuugagaaccaacauaccaucgaccugacggauuccgaaaugaacaaauuguucgagaagaccaaaaagcagcuacgggaaaaugcugaggacaugggaaacggcugcuuuaagauuuaccacaaaugugauaaugccugcaucgggagcauucgaaacggaacauaugaccaugacguauaccgcgaugaggcucugaauaacagauuccagaucaaggguguggaacucaaaucuggcuacaaggacuggauacuguggaucucauuugccauuaguugcuuccuucugugugucgcauugcucggguuuaucaugugggccugccagaaaggaaauauuagguguaacaucugcauauga

SEQ ID NO: 135975 - RNA, 1701 nt, Artificial Sequence; identical to SEQ ID NO: 122038
  derived and/or modified sequence opt3 from hemagglutinin__InfluenzaA__AAG01785

SEQ ID NO: 135976 - RNA, 1701 nt, Artificial Sequence; identical to SEQ ID NO: 134443
  derived and/or modified sequence opt3 from hemagglutinin__InfluenzaA__EPI814528

SEQ ID NO: 135977 - RNA, 1701 nt, Artificial Sequence
  derived and/or modified sequence opt3 from hemagglutinin__InfluenzaA__EPI674736
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucuagcugccgccgaggauccaauucaaguuucuucagccgucugaacuggcucacccauuuaaauucuaaguauccagcacugaacgugacgaugcccaacaaugagcaguuugacaaacuuuacauuuggggcguccaccauccugugacugauaaggaccagaucuucuuguaugcccaguccucaggcagaauuaccguaagcacaaagaggagucaacaggcuguuaucccaaacauagggucucggccccgcauuagagauaucccuuccaggauuagcaucuacuggacuaucgugaaaccaggagacauucugcuaauaaauucgaccgguaaccucaucgccccgcggggcuacuuuaagauucgcucugggaaauccucaaucaugcgaagugacgcgcccauaggaaaguguaagagcgaaugcauuacaccuaauggcuccaucccaaacgauaaacccuuccagaaugucaacagaaucaccuauggugcauguccuagguacgugaagcagucuacgcugaaacuugccacugggaugcggaaugugccagagcgucaaacacgcggaauuuuuggcgcuaucgccggcuucauugaaaacgggugggagggaauggucgacgguugguauggcuuuagacaccagaauagcgaggggaggggacaggcagcugaucugaagucaacccaagccgcgauagaccagaucaacggcaaauugaaucggcucauugguaagacuaacgaaaaauuccaccagaucgagaaggaauuuagugagguugaagggcgaauccaggaucuggagaaguacguggaggacacaaaaauugauuuaugguccuauaaugccgaacugcucguagcacuugagaaccaacauaccauagaccugacggauagcgaaaugaacaaguuguuugagaaaaccaagaaacagcuacgcgaaaaugcugaggacaugggcaacggaugcuucaagaucuaccacaagugugauaaugccugcauuggcucuaucagaaacgggacauaugaccaugacguguacagggaugaggcucugaauaaccgguuucagauuaaaggagucgaacucaagucagguuacaaagacuggauccuguggauaaguuucgccaucagcugcuuucuucuguguguggcauugcucggcuucauuaugugggccugccagaaggggaauauccgcuguaacauuugcaucuga

SEQ ID NO: 135978 - RNA, 1701 nt, Artificial Sequence; identical to SEQ ID NO: 134443
  derived and/or modified sequence opt3 from hemagglutinin__InfluenzaA__EPI614444

SEQ ID NO: 135979 - RNA, 1701 nt, Artificial Sequence
  derived and/or modified sequence opt3 from hemagglutinin__InfluenzaA__EPI551814
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucuagcugccgccgaggauccaauucaaguuucuucagccgucugaacuggcucaccagauuaaauucuaaguauccagcacugaacgugacgaugcccaacaaugagcaguuugacaaacuuuacauuuggggcguccaucacccugugacugauaaggaccagaucuucuuguaugcccaguccucaggcaggauuaccguaagcacaaagcggagucaacaggcuguuaucccaaacauagggucucgccccagaauuagggauaucccuucccggauuagcaucuacuggacuaucgugaaaccaggagacauucugcuaauaaauucgaccgguaaccucaucgccccgcgcggcuacuuuaagauucgaucugggaaauccucaaucaugagaagugacgcgcccauaggaaaguguaagagcgaaugcauuacaccuaauggcuccaucccaaacgauaaacccuuccagaaugucaacaggaucaccuauggugcauguccucgguacgugaagcagucuacgcugaaacuugccacugggaugcguaaugugccagagcgccaaacaagaggaauuuuuggcgcuaucgccggcuucauugaaaacgggugggagggaauggucgacgguugguauggcuuuaggcaucagaauagcgaggggcggggacaggcagcugaucugaagucaacccaagccgcgauagaccagaucaacggcaaauugaaucgacucauugguaagacuaacgaaaaauuccaccagaucgagaaggaauuuagugagguugaagggcgcauccaggaucuggagaaguacguggaggacacaaaaauugauuuaugguccuauaaugccgaacugcucguagcacuugagaaccaacacaccauagaccugacggauagcgaaaugaacaaguuguuugagaaaaccaagaaacagcuaagagaaaaugcugaggacaugggcaacggaugcuucaagaucuaccauaagugugauaaugccugcauuggcucuaucaggaacgggacauaugaccacgacguguaccgggaugaggcucugaauaaccgcuuucagauuaaaggagucgaacucaagucagguuacaaagacuggauccuguggauaaguuucgccaucagcugcuuucuucuguguguggcauugcucggcuucauuaugugggccugccagaaggggaauaucagauguaacauuugcaucuga

SEQ ID NO: 135980 - RNA, 1701 nt, Artificial Sequence
  derived and/or modified sequence opt3 from hemagglutinin__InfluenzaA__EPI696955
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucuagcugccgccgaggauccaauucaaguuucuucagccgucugaacuggcucacccauuuaaauucuaaguauccagcacugaacgugacgaugcccaacaaugagcaguuugacaagcuguacauuuggggcguccaccauccugugacugauaaagaccagaucuucuuguaugcccaguccucaggcagaauuaccguaagcacaaagaggagucaacaggcuguuaucccaaacauaggguaccggccccgcauuagagauaucccuucuaggauuuccaucuacuggacuaucgugaaaccaggagacauucugcuaauaaauagcaccgguaaccucaucgccccgcggggcuauuuuaagauucgcucggggaaaucuuccaucaugcgaucagacgcgcccauaggaaaguguaagagugaaugcauuacaccuaauggcagcaucccaaacgauaaacccuuccagaaugucaacagaaucaccuacggugcauguccuagguaugugaagcaguccacgcugaaacuugccacugggaugcggaaugugccagagcgucaaacacgcggaauuuuuggcgcuaucgccggcuucauugaaaacgggugggagggaauggucgacgguugguacggcuuuagacaccaaaauucugaggggaggggacaggcagcugaucuuaagagcacccaggccgcgauagaccagaucaacggcaaauugaaucggcucauugguaagacuaacgaaaaauuccaccagaucgagaaggaauuuucagagguugaagggcgaauccaggaucuggagaaguauguggaggacacaaaaauugauuuauggaguuacaaugccgaacugcucguagcacuugagaaccaacauaccauagaccugacggauuccgaaaugaacaaguuguuugagaaaaccaagaaacagcuacgcgaaaaugcugaggacaugggcaacggaugcuucaagaucuaucacaagugugauaaugccugcauuggcagcaucagaaacgggacauacgaccaugacguguacagggaugaggcucugaauaaccgguuucagauuaaaggagucgaacucaagucugguuauaaagacuggauccuguggauaucauucgccaucaguugcuuucuucuguguguggcauugcucggcuucauuaugugggccugccagaaggggaauauccgcuguaacauuugcaucuga

SEQ ID NO: 135981 - RNA, 1701 nt, Artificial Sequence
  derived and/or modified sequence opt3 from hemagglutinin__InfluenzaA__EPI740790
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucuagcugccgccgaggauccaauucaaguuucuuuagccgucugaacuggcucacccauuuaaauucuaaguauccagcacugaacgugacgaugcccaacaaugagcaguuugacaagcuguacauuuggggcguccaccauccugugacugauaaagaccagaucuucuuguaugcccaguccucaggcagaauuaccguaagcacaaagaggagucaacaggcuguuaucccaaacauaggguuucggccccgcauuagagauaucccuucuaggauuuccaucuacuggacuaucgugaaaccaggagacauucugcuaauaaauagcaccgguaaccucaucgccccgcggggcuacuucaagauucgcucggggaaaucuuccaucaugcgaucagacgcgcccauaggaaaguguaagagugaaugcauuacaccuaauggcagcaucccaaacgauaaacccuuucagaaugucaacagaaucaccuauggugcauguccuagguacgugaagcaguccacgcugaaacuugccacugggaugcggaaugugccagagcgucaaacacgcggaauuuucggcgcuaucgccggcuuuauugaaaacgggugggagggaauggucgacgguugguauggcuucagacaccaaaauucugaggggaggggacaggcagcugaucuuaagagcacccaggccgcgauagaccagaucaacggcaaauugaaucggcucauugguaagacuaacgaaaaauuccaccagaucgagaaggaauuuucagagguugaagggcgaauccaggaucuggagaaguacguggaggacacaaaaauugauuuauggaguuauaaugccgaacugcucguagcacuugagaaccaacauaccauagaccugacggauuccgaaaugaacaaguuguucgagaaaaccaagaaacagcuacgcgaaaaugcugaggacaugggcaacggaugcuuuaagaucuaccacaagugugauaaugccugcauuggcagcaucagaaacgggacauaugaccaugacguguacagggaugaggcucugaauaaccgguuccagauuaaaggagucgaacucaagucugguuacaaagacuggauccuguggauaucauuugccaucaguugcuuccuucuguguguggcauugcucggcuuuauuaugugggccugccagaaggggaauauccgcuguaacauuugcaucuga

SEQ ID NO: 135982 - RNA, 1701 nt, Artificial Sequence; identical to SEQ ID NO: 130725
  derived and/or modified sequence opt3 from hemagglutinin__InfluenzaA__EPI377499

SEQ ID NO: 135983 - RNA, 1701 nt, Artificial Sequence
  derived and/or modified sequence opt3 from hemagglutinin__InfluenzaA__EPI391247
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggaacgguguuacucaaaaugggacauccucugcuugcauucgccgaagcaacaauuccuuuuucucacgucugaacuggcucacccauuuaaacuuuaaguauccagcacugaaugugacgaugcccaacaaugagcaguucgacaaguuguacaucuggggaguccaccauccugugacugauaaagaccagauuuuucuuuaugcccagccaaguggcagaaucaccguaagcacaaagaggucucaacaggcuguuauacccaacauuggcuuccggccucgcaucagaaauauuccauccaggaucucaaucuacuggacuauugugaaaccgggggauauacugcuaaucaacagcaccggaaaucucauugcgccccgggguuacuuuaagauccgcaguggcaaaucuuccauaaugcgaagcgacgccccuauugggaaguguaagucggaaugcaucacaccaaacggaucuauccccaaugacaaaccuuuccagaacgucaauagaauuaccuauggcgcauguccaagguacgugaagcaguccacgcugaaacuugccacugguaugcggaacgugcccgagaagcaaacacgugggaucuuuggagcuauugccggcuucauagaaaauggcugggaggggauggucgauggaugguaugguuuccgccaccagaacucagagggcagagggcaggcagcugaccugaaaaguacccaagccgcgaucgaucagauuaauggaaaguugaacaggcucaucggcaaaacuaacgaaaaguuucaccagaucgagaaggaguucagcgaaguugaaggucggauucaggaccuggagaaauacguggaggauacaaagauagacuuaugguccuauaaugccgaacugcucguagcacuugagaaccaacauaccaucgaucugacggacucugaaaugaauaaauuguuugagaagaccaaaaagcagcuacgagaaaacgcugaggauauggggaauggcugcuucaagauuuaccacaaaugugacaacgccugcaucggaagcauucgcaauggcacauaugaucaugacguguacagagacgaggcucugaacaauagguuucagaucaagggggucgaacucaaaucaggauacaaggauuggauacuguggaucaguuucgccauuuccugcuuucuucuguguguggcauugcucgguuucaucaugugggccugccagaaaggcaacauucgguguaauaucugcauauga

SEQ ID NO: 135984 - RNA, 1701 nt, Artificial Sequence
  derived and/or modified sequence opt3 from hemagglutinin__InfluenzaA__EPI407123
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggaacgguguuacucaaaaugggacauccucugcuugcauucgccgaagcaacaauuccuuuuucucacgucugaacuggcucacccauuuaaacuuuaaguauccagcacugaaugugacgaugcccaacaaugagcaguucgacaaacuuuacaucuggggaguccaccauccugugacugauaaagaccagaucuuuuuguaugcccagccaaguggcagaauuaccguaagcacaaagaggucucaacaggcuguuauacccaacauuggcuuccggccucgcaucagaaauaacccauccaggauuucaaucuacuggacuaucgugaaaccgggggauauucugcuaauaaauagcaccggaaaccucaucgcgccccgggguuacuuuaagauucgcaguggcaaaucuuccaucaugcgaagcgacgccccuauagggaaguguaagucggaaugcauuacaccaaauggaucuauccccaacgacaaaccuuuccagaaugucaacagaaucaccuauggcgcauguccaagguacgugaagcaguccacgcugaaacuugccacugguaugcggaaugugcccgagaagcaaacacgugggauuuuuggagcuaucgccggcuucauugaaaacggcugggaggggauggucgauggaugguaugguuuccgccaccaaaauucagagggcagagggcaggcagcugaccugaaaaguacccaggccgcgauagaucagaucaacggaaaguugaacaggcucauuggcgaaacuaaugagaaauuucaccagaucgaaaaggaguucagcgaaguugagggucggauccaggaccuggagaaguacguggaagauacaaaaauugacuuaugguccuauaacgccgagcugcucguagcacuugaaaaucaacauaccauagaucugacggacucugagaugaacaaguuguuugaaaagaccaagaaacagcuacgagagaaugcugaggauauggggaacggcugcuucaagaucuaccacaagugugacaaugccugcauuggaagcauccgcaacggcacauaugaucaugacguguacagagacgaagcucugaauaacagguuucagauuaaaggggucgagcucaagucaggauacaaagauuggauccuguggauaaguuucgccaucuccugcuuucuucuguguguggcauugcucgguuucauuaugugggccugccagaagggcaauauccgguguaacauuugcaucuga

SEQ ID NO: 135985 - RNA, 1701 nt, Artificial Sequence
  derived and/or modified sequence opt3 from hemagglutinin__InfluenzaA__EPI407126
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggaacgguguuacucaaaaugggacauccucugcuugcauucgccgaagcaacaauuccuuuuucucacgucugaacuggcucacccauuuaaacuuuaaguauccagcacugaaugugacgaugcccaacaaugagcaguucgacaaguuguacaucuggggaguccaccauccugugacugauaaagaccagauuuuucuuuaugcccagccaaguggcagaaucaccguaagcacaaagaggucucaacaggcuguuauacccaacauuggcuuccggccucgcaucagaaauaacccauccaggauuucaaucuacuggacuaucgugaaaccgggggauauucugcuaauaaauagcaccggaaaccucaucgcgccccgggguuacuuuaagauucgcaguggcaaaucuuccaucaugcgaagcgacgccccuauagggaaguguaagucggaaugcauuacaccaaauggaucuauccccaacgacaaaccuuuccagaaugucaacagaaucaccuauggcgcauguccaagguacgugaagcaguccacgcugaaacuugccacugguaugcggaaugugcccgagaagcaaacacgugggauuuuuggagcuaucgccggcuucauugaaaacggcugggaggggauggucgauggaugguaugguuuccgccaccaaaauucagagggcagagggcaggcagcugaccugaaaaguacccaggccgcgauagaucagaucaacggaaaguugaacaggcucauuggcaaaacuaaugaaaaguuucaccagaucgagaaggaguucagcgaaguugaaggucggauccaggaccuggagaaauacguggaggauacaaagauugacuuaugguccuauaacgccgaacugcucguagcacuugagaaucaacauaccauagaucugacggacucugaaaugaacaaauuguuugagaagaccaaaaagcagcuacgagaaaaugcugaggauauggggaacggcugcuucaagaucuaccacaaaugugacaaugccugcauuggaagcauccgcaacggcacauaugaucaugacguguacagagacgaggcucugaauaacagguuucagauuaagggggucgaacucaaaucaggauacaaggauuggauccuguggauaaguuucgccaucuccugcuuucuucuguguguggcauugcucgguuucauuaugugggccugccagaaaggcaauauccgguguaacauuugcaucuga

SEQ ID NO: 135986 - RNA, 1701 nt, Artificial Sequence; identical to SEQ ID NO: 135871
  derived and/or modified sequence opt3 from hemagglutinin__InfluenzaA__EPI562037

SEQ ID NO: 135987 - RNA, 1701 nt, Artificial Sequence; identical to SEQ ID NO: 134457
  derived and/or modified sequence opt3 from hemagglutinin__InfluenzaA__EPI562034

SEQ ID NO: 135988 - RNA, 1701 nt, Artificial Sequence
  derived and/or modified sequence opt3 from hemagglutinin__InfluenzaA__EPI653140
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccucuuguuaccccuaugacgucccugauuacgcaucgcugcggucauugguggccagcaguggcacccucgaauuuaacaaugaguccuucaacuggacugguguuacacaaaaugggaccucuagcgcuugcauccgccgauccucaaguagcuuuuucucucgucugaacuggcugacgcaucucaauuauaaguacccagcauuaaacgugacuaugcccaauaacgagcaguuugacaagcuguauauuuggggaguccaccauccuggcaccgauaaagaccagaucuucccauacgcccaguccucaggcagaauaacagugagcacuaagaggagucaacaggcuguaauucccaacaucgggucucggccucgcauuagaggaaucccauccaggaucagcauuuacuggaccauaguuaaaccgggugauauccuuuugauuaauucgacaggcaaccugaucgcgccccggggguauuuuaagauacgcucuggaaaauccucaauuaugcgaagugacgccccuaucggcaaguguaagagcgaaugcaucaccccaaaugguuccauucccaacgacaaaccuuuccagaaugugaacagaaucacguacggggcauguccaagguaugucaagcacucuacucuaaaacucgccacaggaaugcggaaugugcccgagaagcagacccguggcauuuuuggcgcuauagccggguucaucgaaaacggaugggaggguaugguggauggcugguacggguuucgccaccaaaauagcgagggaagaggccaggcagcugaccugaaaucaacucaggccgcgauugaucaaaucaacgguaaacuuaauaggcugaucgggaaaacaaacgaaaaguuccaucagauugagaaggaguucagugaagucgaaggccggauacaggacuuggagaaauauguugaggauaccaagaucgaccucugguccuacaaugccgaacuguuaguggcacuggagaaccagcacacgauugaucucaccgacagcgaaaugaauaaacuuuuugagaagacaaagaagcaacugcgagaaaacgcugaggauaugggaaacggcugcuucaagaucuaucauaaaugugacaaugccugcauugggucuauccgcaacggaacuuacgaucacaauguauacagagacgaggcuuugaacaauagguuucagauaaaggguguggaacuaaaaucaggcuauaaggacuggauccuguggauuaguuucgccaucagcugcuuucuccugugugucgcacuucugggguucauuaugugggccugccagaaaggaaacauccgguguaauauaugcauuuga

SEQ ID NO: 135989 - RNA, 1707 nt, Artificial Sequence
  derived and/or modified sequence opt3 from hemagglutinin__InfluenzaA__ACR48873/m
auggagaagaucgugcuucucuucgccauugucagccuuguuaaauccgaccagauaugcaucggcuaccacgcuaacaauucuaccgaacaaguggauacaauuauggagaagaacguaacugugacgcaugcacaggacauccuggagaaaacccacaaugggaaguugugugauuuagacggagucaaaccccugauucuaagagauugcucaguggccgguuggcuccugggcaacccuaugugugacgaguuuaucaauguuccagaauggaguuauauaguggagaaggcgaacccggucaaugaucuuugcuaccccggggacuucaacgauuaugaggaacugaagcauuugcucagcaggaucaaucacuuugagaaaauucagaucauuccuaaguccucuuggucgucacaugaagcuagccugggagugaguuccgccuguccauaccagggcaaaucuagcuucuuucggaacguaguuuggcugaucgagaaaaauuccacauaucccacuauaaagcgcucauacaacaauaccaaccaagaggaccucuuagugcugugggguauucaccacccuaaugaugcagccgaacagacaaagcuguaucagaacccaaccacuuacaucagugucgggacaagcaccuugaaccagcgacuggugccccguauugcuacgagaucuaaggugaauggacaauccggcaggauggaguucuuuuggacuauccuaaaaccuaacgacgcaaucaauuucgaaucaaacggcaauuuuauugccccagaguacgcuuauaagauagucaaaaagggggauagcaccaucaugaaaagugaacucgaguacggaaacugcaauacaaagugucagacuccgaugggugccauuaacucuuccaugcccuuccauaauauccacccucugaccauaggcgagugcccaaaauauguuaagagcaaccggcuugugcuggcgacaggguugcgcaauucgccccagagagaaaggcggcgcaagaaacgaggacucuuuggcgcaauugccgguuucaucgaagggggauggcagggcaugguagacggcugguacggguaucaucacucuaacgaacaaggauccgguuacgcugccgacaaggagucaacccagaaagcaaucgauggcgugacgaauaaggucaacaguauuaucgacaaaaugaauacucaguuugaagcuguggggagagaguucaacaaccuggagaggcggauugaaaauuuaaacaagaagauggaggauggauuccuggacguuuggacauauaaugccgaacuccuugugcugauggagaacgaacguaccuuggauuuucacgacagcaaugucaaaaaccuauacgauaaggugcgccugcaacucagagacaaugcgaaagagcugggcaacgguuguuucgaguuuuaccauaagugcgauaaugaauguauggaguccguaaggaacgggacuuaugacuacccucaguauucugaagaggcccggcuuaaacgagaggaaauaagcggcguuaagcuggagucaaucggaauuuaccagaucuugaguaucuauuccacaguggcaagcucucucgcucuggccauuauggucgcuggcuuaucacuguggaugugcaguaaugggagccuacagugccgcauauguaucuga

SEQ ID NO: 135990 - RNA, 1707 nt, Artificial Sequence
  derived and/or modified sequence opt3 from hemagglutinin__InfluenzaA__ACR48874/m
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggagaaaacccacaaugggaaguugugugauuuagacggagucaaaccccugauucuaagagauugcucaguggccgguuggcuccugggcaacccuaugugugacgaauuuaucaauguuccagaauggaguuauauaguggagaaggcgaacccggucaaugaucuuugcuaccccggggacuucaacgauuaugaggaacugaagcauuugcucagcaggaucaaucacuuugagaaaauucagaucauuccuaaguccucuuggucgucacaugaagcuagccugggagugaguuccgccuguccauaccagggcaaaucuagcuucuuucggaacguaguuuggcugaucaagaaaaauuccacauaucccacuauaaagcgcucauacaacaauaccaaccaagaggaccucuuagugcugugggguauucaccacccuaaggaugcagccgagcagacaaaacuuuaucagaauccaaccacuuacaucagugucgggacaagcaccuugaaccagcgacuggugccccguauugcuacgagaucuaaggugaacggacaauccggcaggauggaguucuuuuggacuauccuaaaaccuaaugacgcaaucaacuucgaaucaaauggcaacuuuauugccccagaauacgcuuauaagauagucaaaaagggggauagcaccaucaugaaaagugagcucgaauacggaaauugcaacacaaagugucagacuccgaugggugccauuaauucuuccaugcccuuccauaacauccacccucugaccauaggcgagugcccaaaguauguuaaaagcaaucggcuugugcuggcgacaggguugcgcaacucgccccagagagagaggcggcgcaagaaacgaggacucuuuggcgcaauugccgguuucaucgaagggggauggcagggcaugguagacggcugguacggguaucaucacucuaaugagcaaggauccgguuacgcugccgacaaggaaucaacccagaaagcaaucgauggcgugacgaacaaggucaauaguauuaucgacaagaugaacacucaguuugaggcuguggggagagaguucaauaaccuggaaaggcggauugagaacuuaaauaaaaagauggaagauggauuccuggacguuuggacauauaacgccgagcuccuugugcugauggaaaaugagcguaccuuggauuuucacgacagcaacgucaaaaaucuauacgauaaggugcgccugcaacucagagacaacgcgaaagaacugggcaaugguuguuucgaguuuuaccauaagugcgauaacgaguguauggaauccguaaggaaugggacuuaugacuacccucaguauucugaggaagcccggcuuaagcgagaggagauaagcggcguuaaacuggaaucaaucggaauuuaccagaucuugaguaucuauuccacaguggcaagcucucucgcucuggccauuauggucgcuggcuuaucacuguggaugugcaguaacgggagccuacagugccgcauauguaucuga

SEQ ID NO: 135991 - RNA, 1701 nt, Artificial Sequence; identical to SEQ ID NO: 131162
  derived and/or modified sequence opt3 from hemagglutinin__InfluenzaA__ACD47234

SEQ ID NO: 135992 - RNA, 1707 nt, Artificial Sequence
  derived and/or modified sequence opt3 from hemagglutinin__InfluenzaA__ACZ36881
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguuccugaauguuccagaauggaguuauaucguggagaagauaaacccggcgaaugauuugugcuaccccgggaacuuuaaugacuaugaggaacucaagcaucugcugagcaggaucaaccacuucgagaaaauucagaucauuccuaaguccucuuggucggaucaugaagcuaguagcggagucaguuccgccuguccauaccagggccggucuagcuuuuuccgcaaugugguauggcucaucaaaaaggacaacgcauaucccacaauaaaacgauccuacaauaacacuaaucaagaggauuuacugguucuuugggguauucaccacccuaacgacgccgcugagcagacccguuuguaucagaacccaacaaccuacaucucaguggggacuucaacacugaaucagaggcuaguccccaagauugcaaccagaagcaaggugaacggacaaucuggccggauggaauuuuucuggacgauccucaaaccuaaugaugccaucaacuuugaguccaauggcaacuucauugcuccagaaaaugccuacaagauagugaaaaagggggacucaacuaucaugaaaagcgagcuggaauauggaaacugcaauaccaagugucagacaccgauuggugcgaucaacaguucuaugcccuuucauaauauacacccucuuacuauuggcgagugcccaaaauacgucaaguccaaccgccugguuuuggcaaccgggcucagaaauagcccccagggagagaggcggcgccgaaagagaggccuguucggugccaucgcuggguuuaucgaaggaggcuggcagggcaugguggacgggugguauggauaccaucacucgaacgagcaagguucuggcuaugccgcagauaaagaauccacacagaaggcuauugacgggguaaccaauaaagugaacucaaucauugauaagaugaacacgcaguucgaggccgucggaagggaauuuaauaacuuagagcggcguauagagaaucugaacaaaaagauggaagacggcuuccucgauguguggacuuacaaugcggagcuucugguuuugauggaaaacgagcgcacacuagacuuccacgauaguaaugugaagaaccuguaugacaaagucagacuccaacugagggauaaugccaaggaacuugguaacggguguuuugaguucuaccaucggugcgacaaugaguguauggaaagcgugcgaaacggcaccuacgauuauccucaguacuccgaggaagcacgccugaaaagagaggagaucucuggaguaaaguuggaaagcauuggcacuuaucagauccucucaaucuacaguacaguugcuuccagccuggccuuagcuauuaugguggccgggcugucucuauggaugugcucaaauggaagucuccagugcaggauauguaucuga

SEQ ID NO: 135993 - RNA, 1704 nt, Artificial Sequence
  derived and/or modified sequence opt3 from hemagglutinin__InfluenzaA__EPI500771
auggagaagaucgugcuccuguucgccaccauuagccuugucaaauccgaccacauaugcaucggcuaccaugcuaacaauucuacagaacagguugauacuauuauggagaagaacgugacgguaacccacgcacaagacauccuggagaaaacacauaaugggaaguugugugauuuaaacggagugaaaccccugauucuaaaggacugcucagucgccgguuggcuccugggcaauccucuuugugaugaauuuacuaacgugccagaauggaguuauaucguugagaaggcgaauccggcuaacgaccugugcuaccccgggaauuucaacgauuaugaggaauugaaacaccuccugagcagaauaaaucauuuugagaagauccagauuaucccuaaagacuccuggucugaucacgaagccucgcugggagugucagcagccuguagcuaccagggcaacaguuccuucuuuaggaaugucguguggcucauuaagaaagacaacgcuuauccaaccaucaagaaggguuacaauaacacaaaccgggaggauuuacugauacuuugggggauucaccaucccaaugacgaggcagaacagaccaaauuguaucaaaacccuacuacauacaucucuauuggaaccagcacgcugaaucagcgccuaguaccaaagaucgccacucgauccaaaaucaaccgucagucaggcagaauugauuucuuuuggaccauacucaagcccaaugacgcuauccacuucgagaguaacggcaauuuuauugccccugaauacgcguauaaaaucguuaagaaaggggacagcacaauaaugaggucugagguggaauacggaaacugcaauacucggugucagaccccaauuggugcaaucaacuccucaaugccguuccauaauauccacccccugacaauuggcgagugcccuaaguaugucaagagcaacaaacuugugcuggccaccggguugcgcaauaguccacaaagagagaggcggcgcaagcgaggacucuuuggcgcuaucgccgguuucauugaagggggauggcagggcaugguggauggcugguacggguaucaccauucuaacgagcagggauccgguuacgcagcugacaaagaaagcacgcagaaggccauagauggcgucacuaauaaaguuaacucgaucauugacaagaugaacacacaauuugaggcgguggggagagaguucaauaaccuggaaaggcggaucgagaauuuaaacaagaaaauggaagauggauuccuggacguauggaccuauaaugccgagcuccuugugcugauggaaaacgagcguacuuuggauuuucacgacucuaaugucaagaaccuauacgauaaagugcgccugcagcucaaggacaaugcaaaagaacugggcaacgguuguuucgaguuuuaccauaagugcaauaacgaguguauggaauccguuagaaaugggacauaugauuacccccaguauucagaggaagcuaggcuuaagcgggaggagaucaguggcgugaaacuggaaagcauuggaauauaccaaaucuuguccauuuauucuaccgucgccagcucacucgugcuggcuaucaugauggccggcuuaagucuguggaugugcuccaacgggagccuacagugccgaauuuguaucuga

SEQ ID NO: 135994 - RNA, 1695 nt, Artificial Sequence
  derived and/or modified sequence opt3 from hemagglutinin__InfluenzaA__ABF93441
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguuccugaauguuccagaauggaguuauaucguggagaagauaaacccggcgaaugauuugugcuaccccgggaacuuuaaugacuaugaggaacucaagcaucugcugagcaggaucaaccacuucgagaaaauucagaucauuccuaaguccucuuggucggaucaugaagcuaguagcggagucaguuccgccuguccauaccagggccggucuagcuuuuuccgcaaugugguauggcucaucaaaaagaacaaugcauaucccacaauaaaacgauccuacaacaauacuaaccaagaggacuuacugguucuuugggguauucaccacccuaacgaugccgcugagcagacccguuuguaucagaauccaacaaccuacaucucaguggggacuucaacacugaaccagaggcuaguccccaagauugcaaccagaagcaaggugaauggacaaucuggccggauggaauuuuucuggacgauccucaaaccuaacgacgccaucaauuuugaguccaacggcaauuucauugcuccagaaaacgccuacaagauagugaaaaagggggauucaacuaucaugaaaagcgagcuggaauauggaaauugcaacaccaagugucagacaccgauuggugcgaucaauaguucuaugcccuuucauaacauacacccucuuacuauuggcgagugcccaaaauacgucaaguccaaucgccugguuuuggcaaccgggcucagaaacagcccccagaucgagacaaggggacuguucggcgccaucgcugguuuuauugaagggggauggcagggcaugguggacggcugguauggguaccaucacucgaaugagcaaggaucugguuaugccgcagacaaggaauccacccagaaagcuaucgauggcguaacgaacaaggugaacucaauuauagacaaaaugaauacucaguucgaggccgucgggcgggaauuuaacaauuuagagcgccgaaucgagaaccugaauaagaaaauggaagauggauuccucgacguguggacauacaacgcggagcuucugguuuugauggaaaaugagagaacccuagauuuccacgacaguaacgugaagaaucuguaugauaaggucaggcuccaacugcgggacaacgccaaagaacuuggcaaugguuguuuugaguucuaccaucguugcgauaacgaguguauggaaagcgugcgcaaugggacuuacgacuauccucaguacuccgaggaagcaagacugaagagggaggagauuucuggcguaaaauuggaaagcaucggaacauaucagauccucucaauuuacaguaccguugcuuccagccuggccuuagcuauaaugguggccggccugucucuauggaugugcucaaacgggagucuccagugccggaucuguauuuga

SEQ ID NO: 135995 - RNA, 1707 nt, Artificial Sequence
  derived and/or modified sequence opt3 from hemagglutinin__InfluenzaA__AGG12577
auggagaagaucgugcuacucuucgccauuauaagccuugucaaauccgaccacaucugcauuggcuaccaugcuaacaauucuaccgaacagguugauacaaucauggagaagaacgugacuguaacgcacgcacaagacauucuggaaaagacccauaaugggaaguugugugauuuaaacggagugaaaccccugauccuaaaggacugcucagucgccgguuggcuccugggcaauccuaugugugaugaguuuauagacgugccagaauggaguuauaucguugagaaggcgaacccggcuaaugaucuuugcuaccccgggaacuucaaugacuaugaggaacugaaacacuugcucagcagaauuaaccauuuugagaagaucaggauuaucccuaaagauuccuggccagaccacgaagccucucugggagugucggcagccuguucauaccagggcaauagcaguuucuuucggaacgucguguggcugcucaagaaagauaaugcuuaucccauaauuaagaaguccuacaacaauacaaacaaagaggacuuacugguacuuugggguauccaccauccuaacgaugaggcagaacagacucgcuuguaucagaauccaaccacauacguuucuauugggaccagcacucugaaccaacgacuggugccccguaucgccacaagauccaaggucaauggacagucaggcaggaucgacuucuuuuggaccauucucaaaccuaacgacgcuauaaauuucgagaguaacggcaauuuuaucgccccagaauacgcguauaagauugugaaaaagggggauagcacgaucaugcggucugagguggaauacggaaacugcuccacucgcugucagaccccgaugggugcaauaaauucaagcaugcccuuccacaacauucauccucugacaaucggcgagugcccaaaauaugucaagaguaauaaacuuguucuggccacuggguugagaaacucuccccagaucgagaggcggcgccgaaaaagaggacucuuuggcgcuauugccgguuucaucgaagggggauggcaaggcaugguggacggcugguacggguaucaccacuccaaugagcagggaagcgguuacgcagcugauaaggaaucgacccagaaagccauugacggcguaacaaacaaggucaauucuauaaucgauaaaaugaacacccaguuugaggcgguggggagggaguucaacaaucuggaacggcguauugagaacuuaaauaagaagauggaagacggauuccuggauguguggacguauaacgccgagcuccuuguucugauggaaaaugagcgcacuuuggacuuucaugauuccaacgugaaaaaucuauacgacaaggucagacugcaacucagggauaacgcaaaagaacugggcaaugguuguuucgaguuuuaccacaagugcgacaacgaguguauggaaucagugcggaaugggacauaugacuacccucaguauagugaggaagcucgacuuaaacgcgaggagaucagcggcguaaagcuggaauccaucggaaccuaccagauuuugucuauauauagcacuguugccucaagucucgugcuggcuaucauggucgccggcuuaucccuguggaugugcagcaacgggucucuacaaugcagaauuuguaucuga

SEQ ID NO: 135996 - RNA, 1707 nt, Artificial Sequence; identical to SEQ ID NO: 135995
  derived and/or modified sequence opt3 from hemagglutinin__InfluenzaA__AGC13463

SEQ ID NO: 135997 - RNA, 1707 nt, Artificial Sequence; identical to SEQ ID NO: 127859
  derived and/or modified sequence opt3 from hemagglutinin__InfluenzaA__ACI06178/m1

SEQ ID NO: 135998 - RNA, 1707 nt, Artificial Sequence
  derived and/or modified sequence opt3 from hemagglutinin__InfluenzaA__AHF20402
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggagaaaacccacaaugggaaguugugugauuuagacggagucagaccccugauucuaagggauugcucaguggccgguuggcuccugggcaacccuaugugugacgaguuuaucaauguuccagaauggaguuauauaguggagaaagcgaacccggucaaugaucuuugcuaccccgggguguucaacgacuaugaggaacugaagcauuugcucagccggaucaaucacuuugagaagauucagaucauuccuaaaaacuccuggccaucucaugaggcuucgcugggaguaucagccgcaugucccuaccagggccaaagcaguuucuuucgcaauguuguguggcugaucaagaaaaacaauacauauccuacuauaaagcgauccuacaacaauaccaaccaggaagaucucuuagucaugugggguauucaccacccaaacgacgccguggagcagacaaaacuguaucagaaucccaccacuuacaucucuguggggacaagcacccuuaaccaacguuugacgccuagaauugcuacuagguccaaggucaagggacugucaggccggauggaguucuuuuggaccauccuaaaaccaaaugaugcaaucaacuucgaaaguaauggcaacuuuauugccccggaauacgcuuauaagauaguuaaaaagggggacagcacaaucaugcgcucugagcucgaauacggaaauugcaacacuaaaugucagacccccaugggugccauuaauuccucaaugccuuuccauaacauccacccacugacaauaggcgagugccccaaguaugugaaaagcaccagacuuguacuggcgacgggguugaggaauaguccucagcgggaggaacgccgaaagaagagaggacucuuuggcgcaauugccgguuucaucgaagggggauggcagggcaugguggauggcugguacggguaucaucacucuaacgaacaaggauccgguuacgcugccgacaaagagagcacucagaaggcaaucgacggcgucacaaauaaagugaacucgauuaucgauaagaugaauacccaguuugaagcuguugggagggaguucaacaaccuggagcggcguauugaaaauuuaaacaaaaagauggaggacggauuccuggauguguggacuuauaaugccgaacuccuuguccugauggagaacgaacgcacauuggacuuucacgauucuaaugugaagaaccuauacgacaaaguaagacugcaacucagggauaaugcgaaggagcugggcaacgguuguuucgaguuuuaccauaaaugcgacaauaaguguauggaauccguucggaacgggaccuaugauuacccacaguauucagaggaagcccgacuuaaacgcgaggagauaaguggcgugaagcuggaaagcaucggagucuaccagauuuuguccaucuauucuacgguggcaagcucacucgcucuggccaucauggucgcuggcuuaagucuguggaugugcuccaaugggagccuacagugcagaauuuguauauga

SEQ ID NO: 135999 - RNA, 1707 nt, Artificial Sequence
  derived and/or modified sequence opt3 from hemagglutinin__InfluenzaA__ABQ45850
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguuccugaauguuccagaauggaguuauaucguggagaagauaaacccggcgaaugauuugugcuaccccgggaacuuuaaugacuaugaggaacucaagcaucugcugagcaggaucaaccacuucgagaaaauucagaucauuccuaaguccucuuggucggaucaugaagcuaguagcggagucaguuccgccuguccauaccagggccggucuagcuuuuuccgcaaugugguauggcucaucaaaaagaacgacgcauaucccacaauaaaacgauccuacaauaacacuaaucaagaggauuuacugguucuuugggguauucaccacccuaacgacgccgcugagcagacccguuuguaucagaacccaacaaccuacaucucaguggggacuucaacacugaaucagaggcuaguccccaagauugcaaccagaagcaaggugaacggacaaucuggccggauggaauuuuucuggacgauccucaaaccuaaugaugccaucaacuuugaguccaauggcaacuucauugcuccagaaaaugccuacaagauagugaaaaagggggacucaacuaucaugaaaagcgagcuggaauauggaaacugcaauaccaagugucagacaccgauuggugcgaucaacaguucuaugcccuuucauaauauacacccucuuacuauuggcgagugcccaaaauacgucaaguccaaccgccugguuuuggcaaccgggcucagaaauagcccccagggagagaggcggcgcaagaaacgaggccuguucggugccaucgcuggguuuaucgaaggaggcuggcagggcaugguggacgggugguauggauaccaucacucgaacgagcaagguucuggcuaugccgcagauaaggaauccacacagaaagcuauugacgggguaaccaauaaggugaacucaaucauugauaaaaugaacacgcaguucgaggccgucggaagagaauuuaauaacuuagagaggcggauagagaaucugaacaagaagauggaagacggcuuccucgauguguggacuuacaaugcggagcuucugguuuugauggaaaacgagcguacacuagacuuccacgauaguaaugugaaaaaccuguaugacaagguccgccuccaacugagagauaaugccaaagaacuugguaacggguguuuugaguucuaccauaggugcgacaaugaguguauggaaagcgugcggaacggcaccuacgauuauccucaguacuccgaggaagcacgacugaagcgcgaggagaucucuggaguaaaauuggaaagcauuggcacuuaucagauccucucaaucuacaguacaguugcuuccagccuggccuuagcuauuaugguggccgggcugucucuauggaugugcucaaauggaagucuccagugcagaauauguaucuga

SEQ ID NO: 136000 - RNA, 1713 nt, Artificial Sequence
  derived and/or modified sequence opt3 from hemagglutinin__InfluenzaA__AKI82373
auggagaagaucgugccccugcucgccauuauaggccuugucaaaagcgaccagaucugcauuggguaccacgcuaacaauuccaccgaacaaguugauacaaucauggagaagaacgugacuguaacgcaugcacaggacauucuggagaaaacccacaauggaaaguuguguaacuuagauggugugaaaccucugauccuaaaggacugcucugucgccggcuggcuccuggggaauccaaugugugaugaguuccuuaacgugucagaauggaguuauauaguugagaaggcgagcccggcuaauggacugugcuaccccggcgacuuuaacgauuaugaggaauugaaacaucuccugaauagaaucacacaccugaagaaaauuaagaucauuccuaaauccuacuggucuaaccaugaggccucgucaggugugagcgcagccuguaguuauaugggggaaccauccuucuuuaggaaugucguguggcucaucaagaagaacaauacuuaucccccuauaaaaguaaacuacaccaauacaaaccaggaggacuuacugguucuuuggggcauucaccacccaaacaaugaggcugaacagauccaaauuuaccagaacuugaucacccauaucucugugggaacuagcacacugaaucagcggcuaauucccaagauagcaacccgcuccaaagucaacggccagucagggcgaauggaguucuuuuggacgauccucaagccuaaugauaguauuaacuucgacagcaauggaaacuuuaucgccccagaauacgcuuauauagugaaaaagggugauucugccauuaugaaauccgagcuggaauacggcaauugcaacacuaagugucaaaccccgaugggggcgaucaauucaagcaugcccuuccacaacauccauccucuuacaauuggagagugcccaaaguaugugaaaaguaaucgucuggucuuggcaacuggccucagaaacgcuccccagagggagcgggaaggugggcgcagaaggaagcggggacuguuuggcgccaucgccggcuucauugaagggggauggcaggguaugguugacggcugguacggguaucaccacucuaaugaacagggauccggcuacgcagcugauaaagagagcacccaaaaggccauagacgguaucacaaacaaagugaacucgauuaucgacaagaugaauacccaguuugaagcgguagggcgcgaguucaacaauuuagagcgaagaaucgaaaaccugaauaagaaaauggaggauggcuuucucgacguguggacguauaacgccgaacuucuggucuugauggagaaugaaaggacucuagauuuccaugacucuaacgugaagaaucuguacgagaaaguucggcuccagcugcgugauaacgcaaaggagcuuggaaauggcuguuucgaauuuuaccacaaaugcgacaacgaguguauggaauccgugcgcaaugggacauaugauuacucacaauauagugaggaggcuagacugagcagggaagagauuaacggagucaaguuggaauccauggugaccuaccagauacucucuaucuauagcacuguagccucaagucuggcuuuagccauuaugguugcaggucugucccuauggaugugcagcaauggcucucuccagugccggaucuguauuuga

SEQ ID NO: 136001 - RNA, 1713 nt, Artificial Sequence
  derived and/or modified sequence opt3 from hemagglutinin__InfluenzaA__EPI284473
auggagaagaucgugcugcuccuugccauuauaagccuggucaaauccgaccagaucugcauuggcuaccacgcuaacaauucuaccgaacaaguugauacaaucauggagaagaacgugacuguaacgcaugcacaggacauuuuggaaaagacccacaaugggaaauuauguaaccuggauggagugaaaccccuaauccucaaggacugcucagucgccgguuggcugcuuggcaauccuaugugugaugaguuccugaacgugagugaauggagcuauauaguugagaaggcguccccagcuaauggguugugcuacccgggagacuuuaacgauuaugaggaacucaaacaucugcugaauagaaucacacaccucaagaaaauuaagaucauucccaaaucuuacuggucgaaccaugaggccucaagcggcgugagugcagccuguuccuauaugggugaaccuucuuucuuuaggaaugucgugugguuaaucaagaagaacaauacuuacccacccauaaaaguaaacuauaccaauacaaaccaggaggaccugcuuguuuugugggggauucaccacccuaacaaugaggcugaacagauccaaauuuaccagaaccugaucacccauaucagcgugggaacuuccacacuaaaucagcggcucauuccaaagauagcaacccgcucaaaagucaacggccagaguggccgaauggaguucuuuuggacgauccugaagcccaaugauagcauuaacuucgacucuaaugggaacuuuaucgccccugaauacgcuuauauagugaaaaagggagauuccgccauuaugaaaucagagcuugaauacgguaauugcaacacuaagugucaaaccccaaugggcgcgaucaauagcaguaugccguuccacaacauccauccccugacaauuggggagugcccuaaguaugugaaaucuaaucguuugguccucgcaacuggacugagaaacgccccacagagggagcgggaaggcggucgcagaaggaagcggggguuauuuggagcuaucgccggcuucauugagggcggguggcagggaaugguugacgguugguacggcuaucaccacuccaaugaacaggggagcggauacgcagcugauaaagagucgacccaaaaggccauagacggcaucacaaacaaagugaacucuauuaucgacaagaugaauacccaguuugaagcgguaggucgcgaguucaacaaucuggagcgaagaaucgaaaaccucaauaagaaaauggaggauggguuucuugacguguggacguauaacgccgaacuguugguccuaauggagaaugaaaggacucuggauuuccaugacuccaacgugaagaaucucuacgagaaaguucggcugcagcuucgugauaacgcaaaggagcugggcaauggauguuucgaauuuuaccacaaaugcgacaacgaguguauggaaucagugcgcaauggcacauaugauuacagucaauauagcgaggaggcuagauuguccagggaagagauuaacggggucaagcucgaaucuauggugaccuaccagauacugagcaucuauucaacuguagccaguuccuuagcucuggccauuaugguugcaggacuaagccucuggaugugcucuaaugguucacugcagugccggaucuguauuuga

SEQ ID NO: 136002 - RNA, 1710 nt, Artificial Sequence
  derived and/or modified sequence opt3 from hemagglutinin__InfluenzaA__ACO07033
auggagaagaucgugcugcuccuugccaugauuggccuggucaaaagcgaccagauaugcaucggguaccacgcuaacaauuccaccgaacaaguugauacaauuauggagaagaacgugacuguaacgcaugcacaggacaucuuggaaaagacccacaauggaaaauuauguaaccuggauggugugaaaccccuaauucucaaggacugcucugucgccggcuggcugcuugggaauccuaugugugaugaguuccugaacgugucagaauggaguuauaucguugagaaggcgagcccagcuaauggauugugcuacccgggcgacuuuaacgauuaugaggaacucaaacaucugcuguccagaauaaaucaccucaagaaaaucaagauuauccccaaaucuuacuggucgaaccaugaggccucaagcggugugagugcagccuguuccuauuuaggggaaccuucuuucuuuaggaaugucguguggcugauuaagaagaacaauacauacccacccaucaaaguaaacuauacuaauaccaaccaggaggaccuuuugguucuguggggaauacaccacccuaacgaugagaaggaacagauucggaucuaccaaaauccaaacacaagcauuuccgugggcaccucaacucuaaaucagcgccucguccccaaaaucgcuacacgaccuaaggugaacggccagagugggcguauggaguucuuuuggaccauccugaaaccaaaugacagcauuaacuucgauucuaauggaaacuuuauagcaccggaauacgccuauaagaucgcuaaaaagggugacuccgugauuaugaagucagagcuugaauacggcaauugcaacacgaaaugucagacucccaugggggccaucaauagcaguaugccuuuccauaacauacacccacugaccauuggagagugccccaaguaugucaaaucuaauagauugguucucgcgacaggccugaggaacgcaccucaacgggagggugggcgcagaaggaagcggggauuauuuggcgccaucgcuggcuucaucgaagggggauggcaggguaugguggauggcugguacggguaucaucacuccaaugagcagggaagcggcuacgccgcagacaaagaaucgacucagaaggcuauugacgguaucaccaacaagguaaacucuauuauagauaaaaugaauacacaauuugagaucguggggcgcgaguucaacaaucuggaacgaagaauugagaaccucaauaagaaaauggaagacggcuuucuugaugucuggaccuauaacgccgagcuguuggugcuaauggaaaaugagaggacgcuggacuuccacgauuccaacguuaagaaucucuacgaaaaagugcggcugcagcuucgugacaacgcgaaggagcugggaaauggcuguuucgaguuuuaccauaagugcgauaacgaauguauggagucaguccgcaaugggacuuaugacuacccacaguauagugaagaggccagauugagcagggaggaaaucuccggagugaaaauggagucuaugguaacauaccaaauccucagcauuuauucaaccguugcaaguucccuggcuuuagccauaaugguggcuggucugagccuauggaugugcucuaacggcucacuccagugccggaucuguauuuga

SEQ ID NO: 136003 - RNA, 1695 nt, Artificial Sequence
  derived and/or modified sequence opt3 from hemagglutinin__InfluenzaA__EPI174803
auggagaagaucgugcugcuccuugccaugauuggccuggucaaaagcgaccagauaugcaucggguaccacgcuaacaauuccaccgaacaaguugauacaauuauggagaagaacgugacuguaacgcaugcacaggacaucuuggaaaagacccacaauggaaaauuauguaaccuggauggugugaaaccccuaauucucaaggacugcucugucgccggcuggcugcuugggaauccuaugugugaugaguuccugaacgugucagaauggaguuauaucguugagaaggcgagcccagcuaauggauugugcuacccgggcgacuuuaacgauuaugaggaacucaaacaucugcuguccagaauaaaucaccucaagaaaaucaagauuauccccaaaucuuacuggucgaaccaugaggccucaagcggugugagugcagccuguuccuauuuaggggaaccuucuuucuuuaggaaugucguguggcugauuaagaagaacaauacauacccacccaucaaaguaaacuauacuaauaccaaccaggaggaccuuuugguucuguggggaauacaccacccuaacgaugagaaggaacagauucggaucuaccaaaauccaaacacaagcauuuccgugggcaccucaacucuaaaucagcgccucguccccaaaaucgcuacacgaccuaaggugaacggccagagugggcguauggaguucuuuuggaccauccugaaaccaaaugacagcauuaacuucgauucuaauggaaacuuuauagcaccggaauacgccuauaagaucgcuaaaaagggugacuccgugauuaugaagucagagcuugaauacggcaauugcaacacgaaaugucagacucccaugggggccaucaauagcaguaugccuuuccauaacauacacccacugaccauuggagagugccccaaguaugucaaaucuaauagauugguucucgcgacaggccugaggaacgcaccucaaacugagacccgggguuuauuuggggccaucgcuggauucaucgaaggcggcuggcaggggaugguggauggaugguacgguuaucaucacuccaaugagcagggcagcggguacgccgcagacaaggaaucgacacagaaagcuauugacggaaucaccaacaagguaaacucuauuauagauaagaugaauacgcaauuugagaucgugggccgcgaguucaacaaucuggaaagaaggauugagaaccucaauaaaaagauggaagacgguuuucuugaugucuggacuuauaacgccgagcuguuggugcuaauggaaaaugagcggacacuggacuuccacgauuccaacguuaaaaaucucuacgaaaaggugcgccugcagcuucgagacaacgcgaaagagcuggggaauggcuguuucgaguuuuaccauaagugcgauaacgaauguauggagucagucagaaauggaaccuaugacuacccacaguauagugaagaggccagguugagccgggaggaaaucuccggcgugaagauggagucuaugguaacuuaccaaauccucagcauuuauucaacaguugcaaguucccuggcuuuagccauaaugguggcugggcugagccuauggaugugcucuaacggaucacuccagugccguaucuguauuuga

SEQ ID NO: 136004 - RNA, 1704 nt, Artificial Sequence
  derived and/or modified sequence opt3 from hemagglutinin__InfluenzaA__AGZ62382
auggagaagaucgugcuccuguucgccgcuauuagccuugucaaauccgaccacauaugcaucggcuaccaugcaaacaauucuaccaagcagguugauacaauuauggaaaagaacgugacuguaacgcacgcccaagacauccuggagaagacccauaaugggaaauugugugauuuaaacggagugaagccccugauucuaaaggacugcucagucgcggguuggcuccugggcaauccuaugugugaugaauuuaucaacgugccagaguggaguuauauaguugaaaaagcuaauccggccaacgggcuuugcuaccccggaaauuucaacgacuaugaggagcugaagcacuugcucagcagaaucaaucauuuugagaaaauuaggaucauuccuaaggauuccuggucugaccacgaagcaucgcugggcgugucagccgcuuguccauaccaggguaacagcaguuucuuucggaaugucguguggcugaucaaaaaggauaacacauaucccacuauaaagaaauccuacaauaacaccaaccaggaagaccucuuaauucugugggggauccaccauccuaaugaugaggcagagcagacacgccuuuaucaaaacccaaccacuuacauuucuaucggaacaagcaccuugaaucagcgacugguacccaagaucgccacgcguuccaaaauuaacggccagucaggcagaauagacuucuuuuggacuauccuaaagccuaaugaugcuauucacuucgaaaguaacgggaauuuuaucgccccagaguacgcguauaaaauaguuaagaaaggagacagcaccauuaugaagucugaaguggaguacgguaacugcaauacaaggugucagacuccgaucggcgcaaucaacuccucaaugcccuuccauaauauucacccucucaccaucggggaaugcccaaaguaugucaaaagcaacaagcuggugcuugccacaggacugcggaauaguccccaacgcgagagaaggcggaaacgcggcuuguuuggugcuauugccggguucauagagggaggcuggcagggcaugguggacgggugguacggauaucaccauucuaacgaacaggguuccggcuacgcagcugauaaggagagcacccagaaagccaucgacggggucacgaauaagguuaacucgauuaucgauaagaugaacacucaauuugaagcggugggacgagaguucaauaaccucgaaagaaggaucgagaaucugaacaaaaagauggaggacggcuucuuagauguauggacauauaaugccgaacugcucgugcuuauggagaacgaacggacccuggacuuucacgauucuaauguccguaacuuguacgacaaagugcgccuacagcugaaggauaaugcaaaagagcucgguaacggguguuucgaauuuuaccauaagugcaauaacgaguguauggaguccguuagaaauggcacuuaugacuacccucaguauucagaagaggcuaggcugcggcgagaagagauuaguggagugaaacuugagagcauaggcaucuaccaaauucuguccaucuauucuacagucgccagcucauuggugcucgcuauuaugauggccgggcugaguuuauggaugugcuccaacggaagccugcagugccgcaucuguauauga

SEQ ID NO: 136005 - RNA, 1704 nt, Artificial Sequence
  derived and/or modified sequence opt3 from hemagglutinin__InfluenzaA__ABG67978/m
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucagagauugcucaguggccgguuggcugcuuggcaacccuaugugugacgaguucaucaauguuccagaauggaguuauauaguggagaaggcgaacccggcuaaugaucugugcuaccccgggaacuuuaaugacuaugaggaauugaagcaucuccugagcaggaucaaccacuucgagaaaauucagaucauuccuaaguccucuuggucggaucaugaagccucaagcggagucaguuccgcauguccauaccagggcacacccagcuuuuuccggaaugugguauggcugaucaaaaagaacaauacuuauccuaccauaaaacgcucuuacaacaauacaaaccaagaggaccucuuaauucugugggguauccaccacuccaacgaugccgcugagcagaccaaacuuuaucagaauccaacuacauacauuucaguugggaccaguacguugaaccagcgacuggugcccaagaucgcaacucguagcaaagucaauggacaaucuggcagaauggacuuuuucuggaccauccuaaagccuaacgaugccauuaauuuugaauccaacggcaauuucauagcuccagaguacgccuauaaaaucgugaagaaaggggacucagcgauuaucaagagcgaaguggaguacggaaacugcaauacaaaaugucagacuccgauaggugcaauuaacaguucuaugcccuuucauaauauccacccucucaccaucggcgaaugcccaaaguaugucaaguccaacaaacugguucuugccacagggcugaggaauagccccuugcgggagcgcagaaggaagcggggacucuucggcgcuauugccgguuuuaucgaagggggauggcagggcaugguggacggcugguacggguaucaucacucgaacgaacagggaucugguuacgcagcugauaaagaguccacccaaaaggccauugacggcguaacgaauaaagugaacucaauaaucgauaagaugaacacucaguucgaagcggucgggcgcgaguuuaauaaccuggaacgaagaauugagaauuuaaacaagaaaauggaggacggauuccuggauguguggacauauaaugccgaacuccuuguucugauggagaacgaaaggaccuuggacuuccacgauaguaaugugaagaaccuauacgacaaaguccggcugcagcuccgugauaaugcaaaggagcugggcaacgguuguuuugaguucuaccauaaaugcgacaaugaguguauggagagcgugcgcaacgggacuuaugauuacccucaauauuccgaagaggcuagacuuaagagggaagagaucucuggcguaaagcuggagagcaucggaacauaccagauuuugucaauauauaguaccguugccuccagccucgcucuggccaucaugguggcaggcuuaucucuguggaugugcucaaaugggagucuacagugccggauuuguaucuga

SEQ ID NO: 136006 - RNA, 1695 nt, Artificial Sequence
  derived and/or modified sequence opt3 from hemagglutinin__InfluenzaA__EPI827075
auggagaagaucgugcuacucuucgccaccauuagccuugucaaauccgaccacauaugcaucggcuaccaugcuaacaauucuacagaacagguugauacuauuauggagaagaacgugacgguaacccacgcacaagacauccuggaaaagacacauaaugggaaguugugugauuuaaacggagugaaaccccugauucuaaaggacugcucagucgccgguuggcuccugggcaauccucuuugugaugaguuuacuaacgugccagaauggaguuauaucguugagaaggcgaauccggcuaacgaccugugcuaccccgggaauuucaacgauuaugaggaauugaaacaccuccugagcagaauaaaucauuuugagaagauccagauuaucccuaaagacuccuggucugaucacgaagccucgcugggagugucagcagccuguagcuaccagggcaacaguuccuucuuuaggaaugucguguggcucauuaagaaagacaacgcuuauccaaccaucaagaaggguuacaauaacacaaaccgggaggauuuacugauacuuugggggauucaccaucccaaugacgaggcagaacagacccgcuuguaucaaaacccuacuacauacaucucuauuggaaccagcacgcugaaucagcgacugguaccaaaaaucgccacucguuccaagaucaacggccagucaggcagaauugauuucuuuuggaccauacucaaacccaaugacgcuauccacuucgagaguaacgggaauuuuauugccccugaauacgcguauaagaucguuaaaaagggagacagcacaauaaugaggucugagguggaauacgguaacugcaauacucggugucagaccccaauuggcgcaaucaacuccucaaugccguuccauaauauccacccccugacaauuggggagugcccuaaauaugucaagagcaacaaacuugugcuggccaccggauugcgcaauaguccacaaagagagacgaggggccucuuuggugcuaucgccggguucauugaaggaggcuggcagggcaugguggaugggugguacggauaucaccauucuaacgagcaggguuccggcuacgcagcugacaaagaaagcacucagaaggccauagauggggucacaaauaaaguuaacucgaucauugacaagaugaacacccaauuugaggcggugggacgggaguucaauaaccuggaacgccgaaucgagaauuuaaacaaaaagauggaagauggcuuccuggacguauggacuuauaaugccgagcuccuugugcugauggaaaacgagagaacauuggauuuucacgacucuaaugucaagaaccuauacgauaaagugaggcugcagcucaaggacaaugcaaaagaacuggguaacggguguuucgaguuuuaccauaagugcaauaacgaguguauggaauccguucggaauggcaccuaugauuacccccaguauucagaggaagcucgucuuaaacgcgaggagaucaguggagugaagcuggaaagcauuggcauauaccaaaucuuguccauuuauucuacggucgccagcucacucgugcuggcuaucaugauggccggguuaagucuguggaugugcuccaacggaagccuacagugcagaauuuguaucuga

SEQ ID NO: 136007 - RNA, 1707 nt, Artificial Sequence
  derived and/or modified sequence opt3 from hemagglutinin__InfluenzaA__ABP96850
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguuccugaauguuccagaauggaguuauaucguggagaagauaaacccggcgaaugauuugugcuaccccggggacuuuaacgauuaugaggaacucaagcaucugcugagcaggaucaaucacuucgagaaaauucagaucauuccuaaguccucuuggucggacuacgaggcuucaagcggagucaguuccgccuguccauaucagggccggucuagcuuuuuccgcaacgugguauggcucaucaaaaagaauaacgcauaccccacaauaaaacgauccuauaauaacacuaaucaagaagauuuacugguucuuugggguauucaucacccuaacgacgccgcugagcagauccguuuguaccagaacccaaccacauacauuucaguggggaccaguacucugaaucagaggcuaguccccaagaucgcaacaagaagcaaggugaacggacaaucuggccggauggaauuuuucuggaccauccucaaauccaaugaugccauuaacuuugagucaaauggcaacuucauagcuccugaauaugccuacaagaucgugaaaaagggggacagcacgauuaugaaaagugagcuggaauauggaaauugcaacacuaagugucagaccccaaucggugcgauaaauucuuccaugccguuucacaacauucauccccuuacaaucggcgagugcccuaaauacgucaagagcaaucgccugguuuuggcaacugggcucagaaacucgccacagggagagaggcggcgccgaaagagaggccuguucggugccaucgcuggguuuauugaaggaggcuggcagggcaugguggacgggugguauggauaccaccauucuaaugagcaagguuccggcuaugccgcagauaaagaaucaacccagaaggcuaucgacgggguaacaaacaaagugaauaguauuauaaacaagaugaacacccaguucgaggccgucggaagggaauuuaauaacuuagagcggcguaucgagaaucugaacaaaaagauggaagauggcuuccucgacguguggacguacaaugcggagcuucugguuuugauggaaaacgagcgcacucuagauuuccacgacagcaaugugaagaaccuguacgauaaagucagacuccaacugagggacaaugccaaggaacuugguaacggguguuuugaguucuaucaccggugcgauaaugaguguauggaauccgugcgaaacggcacauacgacuauccccaguacucugaggaagcacgccugaaaagagaggagauuagcggaguaaaguuggaaucaaucggcaucuaucagauucucaguauauacuccaccguugcuagcucucuggccuuagcuaucaugguggccgggcuguuucuauggaugugcucaaauggaagucuccagugcaggauuuguaucuga

SEQ ID NO: 136008 - RNA, 1692 nt, Artificial Sequence
  derived and/or modified sequence opt3 from hemagglutinin__InfluenzaA__EPI827077
auggagaagaucgugcugcuccuugccauugucagcauaguuaaauccgaccagaucugcauuggcuaccacgcuaacaauucuaccgaacaaguggauacaaucauggagaagaacguaacugugacgcaugcacaggacauucuggaaaagacccacaaugggaaauuguguaacuuagauggagucaaaccccugauccuaagagacugcucaguggccgguuggcuccugggcaauccuaugugugaugaguuccuuaacguuccagaauggaguuauauaguggagaagaucaauccggcgaacgaccugugcuaccccgggaauuuuaacgauuaugaggaauugaagcaucuccugagcaggauuaaucacuucgagaaaauccagauuaucccuaaggacuccuggucugaucaugaggcuucgggagucucaagcgccuguccauaccagggccggaguuccuuuuuccgcaacgugguauggcugacuaaaaagaaugacgcauaucccacaauuaaaaagucuuacaacaauaccaaccaagaagaucucuuaguucugugggguauacaccacccuaacgacgccgcugagcagacacgacuuuaucagaauccaaccacuuacaucagcguggggacauccaccuugaaccagcgucugguccccaagauugcaacgagaucaaaagugaauggacaaaguggcaggauggaauuuuucuggacuauccuaaagagcaacgaugccaucaauuuugagucuaacggcaauuucauugcuccugaaaacgccuacaaaauagugaagaaaggggacuccaccaucaugaagucagagcucgaauauagcaauugcaacacaaaaugucagacuccaauuggagcgaucaauaguucuaugccguuucauaacauacacccccugaccauuggugagugcccuaaguacgucaaguccaaucggcuuguucuggcaacaggcuugcgcaacagcccacagagagagaccaggggacucuucggggccaucgcuggcuuuaucgaagguggguggcagggaaugguggacggcugguauggcuaccaucacucgaaugagcaagggucuggauaugccgcagauaaagaauccacgcagcgggcuauugacgguguaacuaacaaggugaacucaaucauugauaaaaugaauacacaguucgaggccgucggccgcgaauuuaacaaucuggagcgaagaauagagaacuuaaauaagaaaauggaagacggguuccuggauguguggaccuacaacgcggagcuccuuguucugauggaaaaugagaggacuuuggacuuccacgauaguaacgugaagaaucuauaugacaagguccggcugcaacuccgugauaacgccaaagaacugggaaauggcuguuuugaguucuaccaucgcugcgacaacgaguguauggaaagcgugagaaaugguacauacgauuauccccaguacuccgaggaagcaaggcuuaagcgggaggagaucucugggguaaaacuggaaagcauuggcaccuaucagaucuugucaaucuacaguacgguugcuuccagccucgcccuggcuauuaugguggccggauuaucucuguggaugugcucaaacggcagucuacagugccgaauauguaucuga

SEQ ID NO: 136009 - RNA, 1704 nt, Artificial Sequence
  derived and/or modified sequence opt3 from hemagglutinin__InfluenzaA__EPI594523
auggagaagaucauucugcuccuugccauaaucggccuggugaaaagcgaccagauuugcgucggguaccacgcuaacaauuccaccgaaagaguugauacaaucauggagaagaacgugacuguaacgcaugcacaagacauuuuggagaaaacccacaauggaaaguuauguaaccugaauggugugaaaccccuaauccucgaagauugcucugucgccggcuggcugcuugggaacccuaugugugacaaguuccugaaugugucagaauggaguuauauaguugagaaggcgggaccagcuaacggcuugugcuacccgggugauuuuaaugacuaugaggaacucaaacaucugcugagcaggaucaaccacuucgagaagauugaaaucauucccaaaaaucauugguccaaccacaauacaucuggggugucgucagccuguagcuaccucgagaacccuuccuuuuuccggaaugucgugugguuaacuaagaaaaacaacaccuauccaacaaucaagguaaauuacaccaacgcaaaucagaaggaucugcuuguuuuguggggaauacaccaucccaacaaugaggccgaacagaaaaugauuuaucagaacaguaauacuuacgugucugucggcacaagcacccugaaccaacgccuagugccuaagaucgcuacgcgauccaaagugaauggccagucagggcguauugacuuuuucuggacuauccucaagccaaacgauaccaucaauuuugacaguaacggaaauuucauugcacccaaauacgccuauaagauagucaaaaagggugauagcgcuaucaugaagucugagcugaaauacgacaacugcaauacaaagugucagacuccuauuggcgccaucaacuccucaaugccauuucacaacauacauccgcuuaccauuggggaaugccccaaauauguuaagagcaauagacugguguuggcgacaggacucaggaacgcaccucagaucgagggccggcgcagaaaaaggggucuguucggggccaucgcuggauuuauugaaggcggcuggcaagggaugguagauggaugguacgguuaucaccacaguaaugagcagggcucuggguacgccgcagacaaggaguccacccagaaggcuguggacggaaucacgaacaaaauuaauagcauaaucgauaagaugaacaaucaguucgaagccgucggccgggaguuuaacaauuuagaacgccgaauugagaaccugaauaaaaagauggaagacgguuuccucgauguguggacuuauaacgcggagcuucugguuuugauggagaaugaaagaacacuagacuuccaugauucgaacgugaaaaaucuguacgagaaggucaggcuccaacugcgggacaacgccaaggaacuugggaacggcuguuuugaguucuaccacaaaugcgauaaugaauguauggagucugugaagaacggaaccuaugacuacccacaguauuccgaggaagcacgucugaaucgcgaggaaaucucaggcguaaaauuggagaguacuguuacauaccagauccucagcauuuauuccaccguggcuucuagccuggucuuagccauaaugguggcugggcugucacuauggaugugcaguaacggaucccuccaaugcagaaucuguauuuga

SEQ ID NO: 136010 - RNA, 1707 nt, Artificial Sequence
  derived and/or modified sequence opt3 from hemagglutinin__InfluenzaA__AAD37782
auggagagaaucgugcugcuccuugccauugucagccugguuaaguccgaccagauaugcaucggcuaccacgcuaacaauucuaccgaacaaguggauacaauuauggagaaaaacguaacugugacgcaugcacaggacaucuuggaaaagacccacaaugggaaauuaugugaucugaacggagucaagccccuaauucucagggacugcucaguggccgguuggcugcuuggcaauccuaugugugaugaguucaucaacguuccagaauggaguuauauaguggagaaagcgagcccggcuaaugaccugugcuaccccggggauuuuaacgacuaugaggaauugaagcaucuccugucccggacaaaucacuucgagaagauccagauuaucccuccaucuucguggucaaaccaugaugccagcaguggagucuccucugcaugucccuaccacggccgcagcuccuuuuuccgaaaugugguauggcugauuaaaaagaacucagccuauccuacuaucaaacguaguuacaauaacaccaaucaggaagaccucuuaguucugugggguauacaccauccaaacgaugcugcagagcaaacaaaacuuuaucagaaccccaccacuuacauuagcguggggacaucuaccuugaaucagagacuggucccugagaucgccacgaggccaaaagugaacggacaguccggccggauggaauuuuucuggacuauucuaaagccgaaugacgcuaucaacuuugagucaaauggcaacuucaucgcccccgaauacgcguauaagauugugaaaaagggggauagcgcaauaaugaaaagugagcucgaauacggaaauugcaacaccaagugucaaacaccuaugggugccaucaauucuuccaugccauuucacaacauucauccccugacuaucggcgagugcccuaaauaugucaagagcaaucgccuuguucuggcuaccggguugagaaacacaccacagagggagcggcgccgaaagaagagaggacucuucggcgccauagcagguuuuauugaagggggauggcagggcauggugaauggcugguacggguaucaccacucgaacgagcagggaucugguuacgcugccgacaaggaauccacccaaaaagcgaucgacggcguaacgaauaaggugaacucaaucauugauaaaaugaacacucaguucgaggccgucgggagggaauuuaauaaccuggagcggcguaucgagaauuuaaacaagcagauggaagacggauuccuggauguguggacauauaaugcagagcuccuuguucugauggaaaacgagcgcaccuuggacuuccaugauaguaaugugaaacaccuauacgacaaggucagacugcaacucagggauaacgcuaaggaacugggcaaugguuguuuugaguucuaccauaaaugcgacaacgaguguauggaaagcgugaagaaugggacuuaugauuacccccaguauuccgaggaagcccggcuuaaccgagaggagauuucuggcguaaaacuggaaagcaugggaacauaccagauauugucaaucuauaguaccguugcuuccagccucgcccuggcaauuaugguggccggcuuaucucuguggaugugcucaaaugggagucuacagugccgcaucuguaucuga

SEQ ID NO: 136011 - RNA, 1707 nt, Artificial Sequence
  derived and/or modified sequence opt3 from hemagglutinin__InfluenzaA__AAD51927
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucugaacggagucaaaccccuaauucucagagacugcucaguggccgguuggcugcuuggcaauccuaugugugaugaguucaucaacguuccagaauggaguuauauaguggagaaggcgagcccggcuaaugaccugugcuaccccggggauuuuaacgacuaugaggaauugaagcaucuccuguccaggacaaaucacuucgagaaaauccagauuaucccuaagucuucguggucaaaccaugaugccagcaguggagucuccucugcauguccauaccacggccggagcuccuuuuuccgcaaugugguauggcugauuaaaaagaacucagccuaucccacuaucaaacgaaguuacaauaacaccaaucaggaagaccucuuaguucugugggguauacaccauccuaacgaugcugcagagcaaacaaaacuuuaucagaacccaaccacuuacauuagcguggggacaucuaccuugaaucagcgucugguccccgagaucgccacgagaccuaaggugaacggacaguccggcaggauggaauuuuucuggacuauucuaaaaccaaaugacgcuaucaacuuugagucaaauggcaacuucaucgccccggaauacgcguauaagauugugaaaaagggggauagcgcaauaaugaaaagugagcucgaauacggaaauugcaacaccaagugucaaacacccaugggugccaucaauucuuccaugccuuuucacaacauucauccacugacuaucggcgagugccccaaauaugucaagagcaaucggcuuguucuggcuaccggguugcgcaacacaccucagagagagaggcggcgcaagaaacgaggacucuucggcgccauagcagguuuuauugaagggggauggcagggcaugguggacggcugguacggguaucaccacucgaaugagcagggaucugguuacgcugccgacaaggaauccacccaaaaagcgaucgauggcguaacgaacaaggucaauucaaucauugacaaaaugaacacucaguucgaggccguggggagagaauuuaacaaucuggagaggcggaucgagaacuuaaauaagcagauggaagauggauuccuggacguguggacauauaacgcagagcuccuuguucugauggaaaaugagcguaccuuggauuuccaugacaguaacgugaagaaucuauacgauaaaguccgccugcaacucagagacaacgcuaaggaacugggcaaugguuguuuugaguucuaccacaaaugcgauaacgaguguauggaaagcgugaagaaugggacuuaugacuacccacaguauuccgaggaagccaggcuuaaccgggaggagauuucuggcguaaaacuggaaagcaugggaacauaccagauauugucaaucuauaguaccguugcuuccagccucgcccuggcaauuaugguggccggcuuaucucuguggaugugcucaaaugggagucuacagugccgaaucuguaucuga

SEQ ID NO: 136012 - RNA, 1704 nt, Artificial Sequence; identical to SEQ ID NO: 129733
  derived and/or modified sequence opt3 from hemagglutinin__InfluenzaA__AEO89181

SEQ ID NO: 136013 - RNA, 1707 nt, Artificial Sequence; identical to SEQ ID NO: 131187
  derived and/or modified sequence opt3 from hemagglutinin__InfluenzaA__AFM78567

SEQ ID NO: 136014 - RNA, 1707 nt, Artificial Sequence
  derived and/or modified sequence opt3 from hemagglutinin__InfluenzaA__ACR48872
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguucaucaauguuccagaauggaguuauauaguggagaaggcgaacccgacaaaugaucugugcuaccccgggagcuuuaacgacuaugaggaauugaagcaucuccuguccaggaucaaucacuucgagaaaauucagaucauuccuaagucuucguggucagaucaugaagcuagcaguggagucuccucugccuguccauaccugggcagccccuccuuuuuccggaacgugguauggcucaucaaaaagaacucaacuuauccuaccauuaaaaagaguuacaauaauacaaaccaggaggacuuacugguucuuugggguauacaccacccaaaugaugcagccgagcaaaccauguuguaucagaaccccacuacauacaucagcauugggaccucuacgcugaaccagcgccuagugccuaagaucgcuacucgauccaaagucaauggacagucaggccguauggaauuuuucuggaccauccucaagccaaacgacgcaauuaauuuugagagcaacggcaauuucauagccccggaauacgcuuauaaaaucgugaagaaaggggauagugccauuaugaagucugagcuggaauacggaaacugcaauacaaaaugucaaacucccaugggugcgaucaacuccagcaugccuuuucauaauauacacccacuuaccauuggcgagugccccaaguaugugaagucgaacagacuggucuuggcaacagggcucagaaauucuccucagcgggagucccgcaggaaaaagaggggacuguucggcgccaucgcugguuuuaucgaagggggauggcagggcaugguugacggcugguacggguaucaucacucaaacgagcagggaagugguuacgccgcagacaaagaaagcacccaaaaggcuauugauggcgugacgaauaaaguaaacuccaucauugacaagaugaauacucaguucgaggccguggggcgggaauuuaacaacuuagagcgccgaauagagaaucugaacaagaaaauggaagauggauuccucgacgucuggacauauaaugcggagcuucugguguugauggaaaacgagagaacccuagauuuccacgacucuaauguuaagaaccuguacgauaaagugaggcuccagcugcgggacaaugccaaggaacuuggcaacgguuguuuugaguucuaccauaaaugcgauaaugaguguauggaaagcauccguaacgggacuuauaauuacccacaauauucagaggaagcacgccugaagagagaggagauuaguggcgucaaguuggaauccaucggaacauaccagauccucagcauuuauucuaccguggcuucaagucuggccuuagcuauaaugauggccggccugagccuauggaugugcuccaacgggucucuccagugcaggaucuguauuuga

SEQ ID NO: 136015 - RNA, 1707 nt, Artificial Sequence; identical to SEQ ID NO: 131187
  derived and/or modified sequence opt3 from hemagglutinin__InfluenzaA__ABW06108

SEQ ID NO: 136016 - RNA, 1707 nt, Artificial Sequence
  derived and/or modified sequence opt3 from hemagglutinin__InfluenzaA__EPI341633
auggagaagaucacccugcuccuuagcauugugucccuggucaaaucugaccagauaugcaucggcuaccacgccaacaauucaacagaacaaguugauacuauuauggagaagaacgugacgguaacccaugcucaggacaucuuggaaaagacacacaaugggaaauuaugugaucuggacggagugaaaccccuaauucucaaggauugcagugucgcagguuggcugcuuggcaacccuaugugugacgaguucaucaaugugccagaauggagcuauauaguugagaaggccaacccgacuaaugaucugugcuaccccggguccuuuaacgacuaugaggaauugaaacaucuccugucuagaaucaaucacuucgagaagauucagaucauuccuaaaucgucauggagcgaucaugaagcgaguuccggagugucuagcgcuuguccauaccugggcucccccucauuuuucaggaacgucguguggcucaucaagaaaaauaguaccuauccuacaauaaagaagaccuacaacaauacuaaccaggaggacuuacugauucuuugggguauccaccacccaaauaacggggccgagcaaacaauguuguaucagaaccccaccacguacauuagcaucggaacuucuacccugaaucagcggcuaguaccuaaaaucgcaacacgcuccaagguuaacggccagucaggccgaauggaauuuuucuggacuauucucaaaccaaaugaugccauaaacuuugagagcaaugggaacuucaucgcuccggaauacgcauauaagauugugaaaaagggagacagugccaucaugaaaucugagcuggaauacgguaauugcaacaccaagugucaaacacccaugggcgcuauaaauuccagcaugccuuuucauaacauucacccaaucaccaucggggagugccccaaguaugucaaaucgaaucgucuugugcuggccacgggauugagaaacucuccucagagggagucccggcgcaagaaaagaggccucuucggugcgauugcaggguuuaucgaaggaggcuggcagggcaugguggaugggugguacggauaucaucacucaaaugagcaggguaguggcuacgccgcugacaaggaaagcacucaaaaagccauugacggggucacaaacaagguuaauuccauaaucgauaagaugaacacccaguucgaggcagugggaagggaauuuucuaaccuggagcggcgcauugagaauuuaaacaaaaagauggaagacggcuuccuggauguauggacuuauaaugcugagcuccuugugcugauggaaaacgagcgaacauuggacuuccacgauagcaaugucaaaaaccuauacgacaaggugagacugcagcucagggauaaugccaaagaacuggguaacggguguuuugaguucuaccauaagugcgacaaugaguguauggaaucaauccggaacggcaccuauaauuacccacaauauagugaggaagcgcgucuuaagcgcgaggagaucuccggaguuaaacuggaaagcauuggcacguaccagauauugucuaucuauucaaccguggccaguagccucgcacuggcuauuaugaucgccggguuaucccuguggaugugcucuaacggaucgcuacagugcagaauuuguaucuga

SEQ ID NO: 136017 - RNA, 1707 nt, Artificial Sequence
  derived and/or modified sequence opt3 from hemagglutinin__InfluenzaA__ABD95991
auggagaagaucaugcugcuccuugccauugugagccuggucaaauccgaccagauaugcaucggcuaccacgcuaacaauucuaccgaacaaguugauacaauuauggagaagaacgugacuguaacgcaugcacaggacaucuuggaaaagacccacaaugggaaauuaugugaucuggacggagugaaaccccuaauucucagagauugcucagucgccgguuggcugcuuggcaacccuaugugugacgaguuccugaaugugccagaauggaguuauaucguugagaagauaaacccggcgaaugauuugugcuaccccgggaacuuuaaugacuaugaggaacucaagcaucugcugagcaggaucaaccacuucgagaaaauucagaucauuccuaaguccucuuggucggaucaugaagcuaguagcggagugaguuccgccuguccauaccagggccggucuagcuuuuuccgcaaugucguguggcucaucaaaaaggacaacgcauaucccacaauaaaacgauccuacaauaacacuaaucaagaggauuuacugguacuuugggguauucaccacccuaacgacgccgcugagcagacccguuuguaucagaacccaacaaccuacaucucaguugggacuucaacacugaaucagaggcuagugcccaagauugcaaccagaagcaaggucaacggacaaucuggccggauggaauuuuucuggacgauccucaaaccuaaugaugccaucaacuuugaguccaauggcaacuucauugcuccagaaaaugccuacaagauagugaaaaagggggacucaacuaucaugaaaagcgagcuggaauauggaaacugcaauaccaagugucagacaccgauuggugcgaucaacaguucuaugcccuuucauaauauacacccucuuacuauuggcgagugcccaaaauacgugaaguccaaccgccuggucuuggcaaccgggcucagaaauagcccccagggagagaggcggcgcaagaaacgaggccuguucggugccaucgcuggguuuaucgaaggaggcuggcagggcaugguugacgggugguauggauaccaucacucgaacgagcaagguucuggcuaugccgcagauaaggaauccacacagaaagcuauugacggggugaccaauaagguaaacucaaucauugauaaaaugaacacgcaguucgaggccgugggaagagaauuuaauaacuuagagaggcggauagagaaucugaacaagaagauggaagacggcuuccucgaugucuggacuuacaaugcggagcuucugguguugauggaaaacgagcguacacuagacuuccacgauaguaauguuaaaaaccuguaugacaaggugcgccuccaacugagagauaaugccaaagaacuugguaacggguguuuugaguucuaccauaggugcgacaaugaguguauggaaagcguccggaacggcaccuacgauuauccucaguacuccgaggaagcacgacugaagcgcgaggagaucucuggagugaaauuggaaagcauuggcacuuaucagauccucucaaucuacaguacaguagcuuccagccuggccuuagcuauuaugguugccgggcugucucuauggaugugcucaaauggaagucuccagugcagaauauguaucuga

SEQ ID NO: 136018 - RNA, 1707 nt, Artificial Sequence
  derived and/or modified sequence opt3 from hemagglutinin__InfluenzaA__AGN69453
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucagagauugcucaguggccgguuggcugcuuggcaacccuaugugugacgaguuccugaauguuccagaauggaguuauaucguggagaagauaaacccggcgaaugauuugugcuaccccgggaacuuuaaugacuaugaggaacucaagcaucugcugagcaggaucaaccacuucgagaaaauucagaucauuccuaaguccucuuggucggaucaugaagcuagugccggagucagcagugcauguccauaccagggcauguccagcuuuuuccggaaugugguauggcucaucaaaaaggacaacgccuaucccacaauaaaacgcucuuacaauaacacuaaucaagaggauuuacugguucuuugggguauucaccacccuaacgacgcugcagagcagaccaaguuguaucagaacuccacaaccuacaucucaguggggacuucaacacugaaucagcgucuagucccaaagauugccacccgaagcaaagugaacggacaaucuggcagaaucgaauuuuucuggacgauccucaagcccaaugauacuauuaacuuugaguccaauggcaacuucauagcuccugaaaaugccuacaaaaucgugaagaaaggggacucaaccauuaugaaaagcgagcuggaauauggaaacugcaauacaaaaugucagacuccaaucggugcgauaaacaguucuaugccguuucauaauauucacccccuuaccaucggcgagugcccuaaguacgucaaguccagcaggcugguuuuggcaacagggcuccggaacucgccacagggagagcgcagaaggaaaaagcggggccuguucggugccaucgcuggguuuauugaaggaggcuggcagggcaugguggacgggugguauggauaccaucacucuaaugagcaagguuccggcuaugccgcagauaaagaaucaacccagaaggcuaucgacgggguaacgaacaaagugaauaguauuauagauaagaugaacacucaguucgaggccgucggacgcgaauuuaacaauuuagagcgaagaaucgagaaccugaauaagaaaauggaagacggcuuccucgauguguggacauacaacgcggagcuucugguuuugauggaaaaugagaggacccuagacuuccacgauagcaacgugaagaaucuguaugacaaaguccggcuccaacugcgugauaacgccaaggaacuugguaauggguguuuugaguucuaccaucgcugcgacaacgaguguauggaauccgugagaaauggcacuuacgauuauccccaguacucugaggaagcaaggcugaaacgggaggagauuagcggaguaaaguuggaaucaaucggcacauaucagauccucaguauuuacuccaccguugcuagcucucuggccuuagcuauaaugguggccgggcugucacuauggaugugcaguaacggaagccuccagugccgaaucuguauuuga

SEQ ID NO: 136019 - RNA, 1707 nt, Artificial Sequence
  derived and/or modified sequence opt3 from hemagglutinin__InfluenzaA__AGN69452
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguuccugaauguuccagaauggaguuauaucguggagaagauaaacccggcgaaugauuugugcuaccccgggaacuuuaaugacuaugaggaacucaagcaucugcugagcaggaucaaccacuucgagaaaauucagaucauuccuaaguccucuuggucggaucaugaagcuagugccggagucagcagugcauguccauaccagggccgguccagcuuuuuccgcaaugugguauggcucaucaaaaaggacaacgccuaucccacaauaaaacgaucuuacaauaacacuaaucaagaggauuuacugguucuuugggguauucaccacccuaacgacgcugcagagcagacccguuuguaucagaacuccacaaccuacaucucaguggggacuucaacacugaaucagaggcuagucccaaagauugccaccagaagcaaggugaacggacaaucuggccggaucgaauuuuucuggacgauccucaaacccaaugauacuauuaacuuugaguccaauggcaacuucauagcuccugaaaaugccuacaagaucgugaaaaagggggacucaaccauuaugaaaagcgagcuggaauauggaaacugcaauacaaagugucagacuccaaucggugcgauaaacaguucuaugccguuucauaauauucacccccuuaccaucggcgagugcccuaaauacgucaaguccagccgccugguuuuggcaacagggcucagaaacucgccacagggagagaggcggcgcaagaaacgaggccuguucggugccaucgcuggguuuauugaaggaggcuggcagggcaugguggacgggugguauggauaccaucacucuaaugagcaagguuccggcuaugccgcagauaaggaaucaacccagaaagcuaucgacgggguaacgaacaaggugaauaguauuauagauaaaaugaacacucaguucgaggccgucggaagagaauuuaacaauuuagagaggcggaucgagaaccugaauaagaagauggaagacggcuuccucgauguguggacauacaacgcggagcuucugguuuugauggaaaaugagcguacccuagacuuccacgauagcaacgugaaaaaucuguaugacaagguccgccuccaacugagagauaacgccaaagaacuugguaauggguguuuugaguucuaccauaggugcgacaacgaguguauggaauccgugcggaauggcacuuacgauuauccccaguacucugaggaagcacgacugaagcgcgaggagauuagcggaguaaaauuggaaucaaucggcacauaucagauccucaguauuuacuccaccguugcuagcucucuggccuuagcuauaaugguggccgggcugucacuauggaugugcaguaacggaagccuccagugcagaaucuguauuuga

SEQ ID NO: 136020 - RNA, 1707 nt, Artificial Sequence
  derived and/or modified sequence opt3 from hemagglutinin__InfluenzaA__ABD73284
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguuccugaauguuccagaauggaguuauaucguggagaagauaaacccggcgaaugauuugugcuaccccgggaacuuuaaugacuaugaggaacucaagcaucugcugagcaggaucaaccacuucgagaaaauucagaucauuccuaaguccucuuggucggaucaugaggcuucagccggagucagcagugcauguccauaccagggccgguccagcuuuuuccgcaaugugguauggcucaucaaaaaggacaacgccuaucccacaauaaaacgaucuuacaauaacacuaaucaagaagauuuacugguucuuugggguauucaccacccuaacgacgcugcagagcagacccguuuguaucagaacccaacaaccuacaucuccguggggacuucaacacugaaucagaggcuaguccccaagauugccaccagaaguaaggugaacggacaaagcggccggauggaauuuuucuggacgauccucaaaccuaaugaugcuaucaacuuugagucuaauggcaacuucauugccccagaaaaugcguacaagauagugaaaaagggggacuccacuaucaugaaaucagagcuggaauauggaaacugcaauaccaagugucagacaccgauuggugcaaucaacagcaguaugcccuuucauaauauacacccucuuacuauuggcgagugcccaaaauacgucaagucuucccgccugguuuuggccaccgggcucagaaacagcccccagggagagaggcggcgcaagaaacgaggccuguucggugcuaucgccggguuuaucgaaggaggcuggcagggcaugguggacgggugguauggauaccaucacucgaaugagcaagguucuggcuaugcagcugauaaggaauccacacagaaagccauugacgggguaaccaacaaggucaauucaaucauugauaaaaugaacacgcaguucgaggcggugggaagagaauuuaacaauuuagagaggcggauagagaaccugaauaagaagauggaagacggcuuccucgauguguggacuuacaacgccgagcuucugguuuugauggaaaaugagcguacacuagacuuccacgauaguaacgugaaaaaucuguaugacaagguccgccuccaacugagagauaacgcaaaagaacuugguaauggguguuuugaguucuaccauaggugcgacaacgaguguauggaaagcgugcggaauggcaccuacgauuauccucaguacuccgaggaagcucgacugaagcgcgaggagaucucuggaguaaaauuggaaagcauuggcacuuaucagauccucucaaucuacaguacaguugccuccagccuggcuuuagccauuaugguggcagggcugucucuauggaugugcucaaacggaagucuccagugcagaauauguaucuga

SEQ ID NO: 136021 - RNA, 1695 nt, Artificial Sequence
  derived and/or modified sequence opt3 from hemagglutinin__InfluenzaA__ABF93440
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguuccugaauguuccagaauggaguuauaucguggagaagauaaacccggcgaaugauuugugcuaccccgggaacuuuaaugacuaugaggaacucaagcaucugcugagcaggaucaaccacuucgagaaaauucagaucauuccuaaguccucuuggucggaucaugaagcuaguagcggagucaguuccgccuguccauaccagggccggucuagcuuuuuccgcaaugugguauggcucaucaaaaaggacaacgcauaucccacaauaaaacgauccuacaauaacacuaaucaagaggauuuacugguucuuugggguauucaccacccuaacgacgccgcugagcagacccguuuguaucagaacccaacaaccuacaucucaguggggacuucaacacugaaucagaggcuaguccccaagauugcaaccagaagcaaggugaacggacaaucuggccggauggaauuuuucuggacgauccucaaaccuaaugaugccaucaacuuugaguccaauggcaacuucauugcuccagaaaaugccuacaagauagugaaaaagggggacucaacuaucaugaaaagcgagcuggaauauggaaacugcaauaccaagugucagacaccgauuggugcgaucaacaguucuaugcccuuucauaauauacacccucuuacuauuggcgagugcccaaaauacgucaaguccaaccgccugguuuuggcaaccgggcucagaaauagcccccagaucgagacaaggggacuguucggcgccaucgcugguuuuauugaagggggauggcagggcaugguggacggcugguauggguaccaucacucgaacgagcaaggaucugguuaugccgcagauaaggaauccacccagaaagcuaucgacggcguaacgaauaaggugaacucaauuauagauaaaaugaacacucaguucgaggccgucgggcgggaauuuaauaacuuagagcgccgaaucgagaaucugaacaagaaaauggaagacggauuccucgauguguggacauacaaugcggagcuucugguuuugauggaaaacgagagaacccuagacuuccacgauaguaaugugaagaaccuguaugacaaggucaggcuccaacugcgggauaaugccaaagaacuuggcaacgguuguuuugaguucuaccaucguugcgacaaugaguguauggaaagcgugcgcaacgggacuuacgauuauccucaguacuccgaggaagcaagacugaagagggaggagauuucuggcguaaaauuggaaagcaucggaacauaucagauccucucaauuuacaguaccguugcuuccagccuggccuuagcuauaaugguggccggccugucucuauggaugugcucaaaugggagucuccagugccggaucuguauuuga

SEQ ID NO: 136022 - RNA, 1701 nt, Artificial Sequence
  derived and/or modified sequence opt3 from hemagglutinin__InfluenzaA__AKC45369
auggagaagaucgugcugcuccuugccgucguuagccuggugaaauccgaccagauuugcauaggcuaccacgcuaacaauucuaccgaacaaguagauacaaucauggagaagaacgugacugucacgcaugcacaggacauuuuggagaaaacccacaaugggagauuaugugaucugaacggagugaagccccuaauccucaaagacugcucaguugccgguuggcugcuuggcaauccuaugugugaugaguucauuagggugccagaauggaguuauaucgucgagcgggcgaacccggcuaaugaccugugcuaccccgggaacuugaaugauuaugaggaacucaagcaucugcugagccgcauaaaccacuuugagaagacacucaucauuccuaaauccucuuggccaaaucauacuucgucaggagugagcgccgcaugucccuaccagggcaccccuaguuucuuucgaaacguaguuugguuaacaaagaaaaaugacgccuauccaaccaucaagauguccuacaacaauacuaaccgugaagaucugcuuauuuugugggguauccaccacucuaacaaugcugcagagcagacaaaccuguauaaaaaucccaccacguacgugagcgucgggacuuccacccuaaaccaaagacucgugccuaagauagccacaaggucacaggugaauggacagcggggccgcauggacuucuuuuggacuauucugaagccaaacgaugcuauccauuucgagaguaauggcaacuuuauugccccggaauacgcguauaaaaucgucaagaaaggggacagcaccaucaugaagucugagauggaauacggacacugcaauacaaaaugucagacccccauuggugcaauaaacuccucaaugccuuuccauaauauccacccacuuacgauuggcgagugccccaaguauguuaaaagcaacaagcugguguuggccacugggcucagaaauaguccucugagggaacggcgccgaaagagaggauuauuuggcgcuaucgccgguuucauagaagggggauggcaaggcaugguagauggcugguacggguaucaccauucuaacgagcagggauccgguuacgcagcugacagggaaagcacacagaaagccauugacggcgugaccaauaaggucaacucgaucaucgauaaaaugaacacucaguuugaggcgguggggcgggaguucaauaaccuggaacgucgcauugaaaaucucaacaagaaaauggaggacggauuucuugauguuuggacauauaaugccgagcuguuggugcuaauggaaaacgagagaacccuggacuuccacgauucuaaugucaagaaccucuacgacaaggugaggcugcaacuucgggauaaugcaaaagaacugggcaacgguuguuucgaguuuuaccauaagugcgacaaugaauguauggaguccguacgaaacgggacguaugauuacccacaguauucagaggaagcucgcuugaaaagagaggaaaucaguggcguuaagcucgagagcauuggaaccuaccagauacuguccaucuauucuacaguggccagcucauuagcucuggccauuaucgucgcaggccuaagucucuggaugugcuccaaugggagccugcaaugcaggaucuguauuuga

SEQ ID NO: 136023 - RNA, 1704 nt, Artificial Sequence; identical to SEQ ID NO: 134974
  derived and/or modified sequence opt3 from hemagglutinin__InfluenzaA__AJS18479

SEQ ID NO: 136024 - RNA, 1704 nt, Artificial Sequence
  derived and/or modified sequence opt3 from hemagglutinin__InfluenzaA__EPI691378
auggagaagaucgugcugcuccuugccgucguuagccuggugaaauccgaccagauuugcauaggcuaccacgcuaacaauucuaccgaacaaguagauacaaucauggagaagaacgugacugucacgcaugcacaggacauuuuggagaaaacccacaaugggagauuaugugaucugaacggagugaagccccuaauccucaaagacugcucaguugccgguuggcugcuuggcaauccuaugugugaugaguucauuagggugccagaauggaguuauaucgucgagcgggcgaacccggcuaaugaccugugcuaccccgggaacuugaaugauuaugaggaacucaagcaucugcugagccgcauaaaccacuuugagaagacacucaucauuccuaaauccucuuggccaaaucaugaaacuucguuaggagugucagccgcaugucccuaccagggcguaccuagcuucuuucgaaacguuguguggcugaccaagaaaaaugacgccuauccaacaaucaagaugaguuacaacaauaccaaccgugaggaucuuuugauucugugggguauccaccacuccaacaaugcugcagagcagacuaaccuauauaaaaaucccacaaccuacgucucuguggggacgagcacucucaaccaaagacuggugccuaagauagccaccaggucccaggucaauggacagcggggccgcauggacuucuuuuggacaauucuuaagccaaacgaugcuauccauuucgaaucaaauggcaacuuuauugccccggaguacgcguauaaaaucguuaagaaaggggacaguacuaucaugaaaagcgaaauggaguacggacacugcaauaccaagugucagacacccauuggugcaauaaacucuuccaugccuuuccauaauauccacccacugaccauuggcgaaugccccaaguaugugaaaucaaacaaguugguacucgccacggggcugagaaauagcccuuuaagggagcggcgccgaaagagaggacuguuuggcgcuaucgccgguuucauagaagggggauggcaaggcaugguggauggcugguacggguaucaccauaguaacgaacagggaucugguuacgcagcugacagggaguccacucagaaagccauugacggcgucacaaauaaggugaacagcaucaucgauaaaaugaacacccaguuugaagcgguugggcgggaguucaauaaccucgaacgucgcauugagaaucuuaacaagaaaauggaggacggauuucuggauguguggacuuauaaugccgaauugcuaguccugauggagaacgaaagaacacucgacuuccacgauucgaaugugaagaaccuguacgacaagguaaggcuucaacugcgggauaaugcaaaagaguugggcaacgguuguuucgaauuuuaccauaagugcgacaaugaguguauggagucuguucgaaacgggaccuaugauuacccacaguauuccgaagaggcucgccucaaaagagaagagaucucaggcgugaagcuggagaguauuggaacguaccagauauuaagcaucuauuccaccgucgccucuagccuggcucuagccauuaucguggcaggccucucacuguggaugugcaguaaugggucccuucaaugcaggaucuguauuuga

SEQ ID NO: 136025 - RNA, 1704 nt, Artificial Sequence
  derived and/or modified sequence opt3 from hemagglutinin__InfluenzaA__EPI533583
auggagaagaucgugcugcuccuugccauugucagccugguuaaaggcgaccagauaugcaucggguaccacgcuaacaauuccaccgaacaaguggauacaauuauggagaagaacguaacugugacgcaugcacaggacaucuuggaaaagacccacaauggaaaauuaugugaucugaacggugucaaaccccuaauucucaaggacugcucuguggccggcuggcugcuugggaauccuaugugugaugaguucaucagaguuccagaauggucauauauaguggagagggcgaacccggcuaaugaccugugcuaccccggaaacuugaaugauuaugaggaacucaagcaucugcugagucggaucaaccacuuugagaaaauucucaucauuccuaagagcuccuggacaaaucaugaaacuucuuuaggcgucucggccgcauguccauaccaggguacccccucauucuuucgcaacgugguauggcugaucaaaaagaaugacgccuauccuacaauaaaaauuagcuacaacaauaccaaccaggaggaucuuuugauccuguggggaguucaccacaguaacaaugcugcagagcaaacuaaccuauauaagaauccaacaaccuacauuuccguggggacgucuacucucaaccagcgacugguccccaagaucgccacccguagccaggugaauggccagagaggcaggauggacuucuuuuggacaauccuuaaaccuaacgaugcuauucauuucgaauccaaugggaacuuuauagccccagaguacgcguauaagaucgugaaaaagggagacucaacuauuaugaaaagugaaauggaguacggucacugcaauaccaagugucaaacaccgaucggcgcaauaaacagcucuaugcccuuccauaauauucacccucugaccaucggggaaugcccaaaauaugucaaguccaacaaguugguucucgccacgggacugcgcaauucacccuuacgggagaaaagaaggaagcggggccuguuuggugcuaucgccggguucauugagggaggcuggcagggcaugguggaugggugguacggauaucaccauagcaacgaacaggguaguggcuacgcagcugacaaagagucuacucagaaggccaucgacgggguaacaaauaaagugaacuccauuauagauaagaugaacacccaauuugaagcggucggacgcgaguucaauaaccucgaacgaagaaucgagaaucuuaacaagaaaauggaggacggcuuucuggauguguggacuuauaaugccgaauugcuaguucugauggagaacgaaaggacacucgacuuccacgauagcaaugugaagaaccuguacgacaaaguccggcuucagcugcgugauaaugcaaaggaguuggguaacggguguuucgaauuuuaccauaaaugcgacaauaaguguauggagucggugcgcaacggcaccuaugauuacccucaguauucugaggaagcuagacucaagagggaggaaauuuccggaguaaaacuggagucaaucggcacguaccaaaucuuaaguauuuauagcaccguugccuccucucuggcucuagccauaaucguggcagggcucagccuguggaugugcucaaauggaagucuucagugccggauuuguaucuga

SEQ ID NO: 136026 - RNA, 1701 nt, Artificial Sequence; identical to SEQ ID NO: 134987
  derived and/or modified sequence opt3 from hemagglutinin__InfluenzaA__AKS48023

SEQ ID NO: 136027 - RNA, 1701 nt, Artificial Sequence
  derived and/or modified sequence opt3 from hemagglutinin__InfluenzaA__EPI587621
auggagaagauggugcugcuccuugccgcugucagccugguuaaauccgaccagaucugcauuggcuaccacgcaaacaauucuaccgaacaaguggauacaauaauggagaagaacguaacugugacgcaugcccaggacaucuuggagaaaacccacaaugggagauuaugugaucugaacggagucaagccccuaauucucaaagacugcucaguggcggguuggcugcuuggcaauccuaugugugaugaguucaucaggguuccagaauggaguuauauuguggagcgggcuaacccggccaaugaccugugcuaccccgggaacuugaaugauuaugaggaacucaagcaucugcugagccgcaucaaccacuuugagaagacacucauaaucccuaaauccucuuggccaaaucauacuucgucaggagucagcgcagccugucccuaccagggcaugccuaguuucuuucgaaacgugguaugguuaaccaagaaaaaugacgcuuauccaacaauuaagauguccuacaacaauaccuaucgugaagaucugcuuaucuugugggguauucaccacucuaacaacgcagccgagcagacuaaucuguacaaaaaccccacaaccuacguuagcguggggacguccacucuaaaucaaagacucgagccuaagaucgcuaccaggucacaggucaacggacagcggggccgcauggacuucuuuuggacaauacugaagccaaaugaugccauucauuucgaaaguaacggcaauuuuaucgcgccggaguaugcauacaaaauugugaagaaaggggacagcacuaucaugaagucugaaauggaguauggacacugcaacaccaaaugucagacacccaucggugccauuaauuccucaaugccuuuccauaacauacacccacuuaccaucggcgaaugccccaaguacgugaaaagcaauaagcuggucuuggcuacggggcucagaaacaguccucugagggagcggcgccgaaagagaggauuauuuggcgccauugcagguuucaucgaagggggauggcaaggcaugguugauggcugguauggguaccaccauucuaaugaacagggauccgguuaugcugccgacagggagagcacucagaaagcgauagacggcgugacaaacaagguaaauucgauuaucgauaaaaugaacacccaguuugaagccguggggcgggaguucaacaaucuggaacgucgcaucgagaaccucaauaagaaaauggaggacggauuucuugaugucuggacuuacaacgcagaacuguuggugcuaauggagaaugaaagaacacuggacuuccacgauucuaacguuaagaaucucuacgacaaggugaggcugcaacuucgggauaacgcuaaagagcugggcaaugguuguuucgaauuuuaucauaagugcgacaacgaguguauggaguccguccgaaaugggaccuacgauuauccacaguacucagaagaggcccgcuugaaaagagaagagauuaguggcgugaagcucgagagcaucggaacguaucagauucuguccauauacucuaccguagcuagcucauuagcccuggcaaucauuguugccggccuaagucucuggaugugcuccaacgggagccugcaaugcaggaucuguaucuga

SEQ ID NO: 136028 - RNA, 1704 nt, Artificial Sequence
  derived and/or modified sequence opt3 from hemagglutinin__InfluenzaA__AJE30333
auggagaagaucgugcugcuccuugccgucauuagccugguuaaauccgaccagauaugcaucggcuaccacgcuaacaauucuaccaagcaaguggauacaauuauggagaaaaacguaacugugacgcaugcacaggacaucuuggagaagacccacaaugggaaauuaugugaucugaacggagucaagccccuaauucucaaggacugcucaguggccgguuggcugcuuggcaauccuaugugugaugaguucaucagaguuccagaauggaguuauauaguggaaagggcgaacccggcuaaugaccugugcuaccccgggacauugaacgauuaugaggagcucaaacaucugcugagccggaucaaucacuuugaaaagacucucauuaucccucgcuccucuuggccaaaccaugagaccucguuaggagucucagccgcaugucccuaccagggcgccagcaguuucuuucgaaaugugguauggcugauuaaaaagaacgacgcuuauccuacaaucaaaauauccuacaauaacaccaaucgugaagaucuuuugauucugugggguauccaccacucuaacaacgcagccgagcagacuaaucuauauaagaacccagacacauacguuagcguggggaccuccacgcucaaucaaagacugguccccaagauugcuacuaggucacaggugaacggacagaguggccggauggauuucuuuuggaccauccuuaaaccuaaugacgccauccauuucgagagcaacggcaauuuuauugcgccagaauacgcauauaagauagugaaaaagggggauucuacaaucaugaaauccgagauggaauacggacacugcaacacuaagugucagaccccgauuggugccaucaauucaagcaugcccuuccauaacauacacccucugacaauuggcgagugcccaaaauaugucaagaguaauaaguugguucucgcuaccgggcugcgcaacucucccuuaagagaaaggcggcgcaaacgaggacuguuuggcgccaucgcagguuucaucgaagggggauggcaaggcaugguggacggcugguacggguaucaccauuccaaugagcagggaagcgguuacgcugccgacaaggaaucgacgcagaaagcgauugauggcguaacuaacaaggucaauucuaucauugacaaaaugaacacacaguuugaggccguggggagagaguucaacaaucucgaaaggcggauagaaaaccuuaauaagaagauggaggauggauuucuggacguguggaccuauaacgcagaguugcuaguucugauggaaaaugagcguacucucgauuuccacgacuccaacgugaaaaaucuguacgauaagguccgccuucaacugagagacaacgcuaaagaauugggcaaugguuguuucgaguuuuaccauaagugcgauaacgaauguauggagucagugaggaaugggacauaugacuacccuaaauauagugaggaagccauccucaagcgggaggaaauuagcggcguaaagcuggaguccaucggaaccuaccagaucuuaucuauuuauagcacgguugcuucaagucuggcccuagcaauaaucguggccggccucucccuguggaugugcagcaacgggucucuucagugccgaauuuguaucuga

SEQ ID NO: 136029 - RNA, 1704 nt, Artificial Sequence
  derived and/or modified sequence opt3 from hemagglutinin__InfluenzaA__EPI459855
augaucgccauuguggucauagcuauccuggcaagcgccggcaaguccgacaagauuugcaucggguaccacgcgaacaauucuaccacacagguugauacucuccuugagaagaacgugacgguaacccauucaguggaacuguuggagaaucaaaaagaaaagagauucuguaaaauuaugaacaaggcucccuuagaccugaaggauugcacaaucgagggauggauacuagguaauccuaaaugugaccuccugcuuggcgaucagaguuggagcuauaucgucgaaaggccaaacgcccagaaugggauuugcuacccgggagugcugaacgaguuggaggaacucaaggcauuuaucggcuccggugagcggguugaacgcuucgagauguuucccaaaucuacuugggccgggguggacaccucgcgaggagucacaaaugcuuguccuucauauaccauugauagcaguuucuaccguaaccugguguggaucguaaagacugacuccgcaacauauccaguuauaaaaggcaccuacaauaacacgggcacucagcccauucuguauuuuuggggagugcaccauccucucgauaccacaguccaagacaauuuauacgggucuggugauaaguacgugagaaugggcacugagagcaugaacuucgccaaguccccagaaaucgcugccaggcccgcggugaaugggcagcggucacgcauugacuauuacuggaguguccugagaccuggagagacccuuaacguugaaagcaacggcaauuugaucgcaccaugguaugccuacaaauuugugucuacaaacaagaaaggugcuguauucaaguccgaucugccgaucgagaauugcgacgccaccugucagacgauuacuggggugcuaaggacaaacaaaaccuuucagaaugucucaccccucuggauaggagaaugcccuaaguaugugaaaagcgagagucugcggcuugcaacuggccugcgcaacguuccacaaaucgcuacacgaggcauuuucggggccaucgcgggauuuauagaggguggcuggaccgggaugauugacggaugguacggcuaucaccaugaaaauucucaggguuccggguacgccgcagauagagagagcacgcagaaggcuaucgacggcaucaccaacaaggucaauucgauuaucaacaaaaugaauacacaguucgaagccguggaucacgaguuuucuaacuuggaaaggcggauuggaaaucucaacaagcguauggaggacggcuuccuggauguguggacuuacaaugcugaguuacugguacuccuugaaaacgagcgcacccuggacuugcacgaugccaacguuaaaaaucuauaugaaaaggugaaaucccaacugagagacaacgcaaaugaucucgggaacggauguuucgaguuuuggcauaagugcgacaaugaauguauggagucagucaagaacgguacauacgauuaucccaaauaccagaaggagaguaaacugaauaggcagggcauagaaagcgugaaacuugagaaccugggggucuaucaaaucuuggccauuuacuccacugugucuagcucacucguucuggugggauuaaucauggcuaucggccuguggaugugcaguaaugguuccaugcagugccggauuuguauauga

SEQ ID NO: 136030 - RNA, 1704 nt, Artificial Sequence; identical to SEQ ID NO: 136029
  derived and/or modified sequence opt3 from hemagglutinin__InfluenzaA__EPI459855/m1

SEQ ID NO: 136031 - RNA, 1692 nt, Artificial Sequence
  derived and/or modified sequence opt3 from hemagglutinin__InfluenzaA__ACZ36872
augaacacccagauccugguguucgcccucgucgcuguuauucacacaaaugcagacaagauaugccuuggccaucacgccgugagcaacgggacuaaaguaaauacgcugaccgagagaggaguggaagucgugaacgcgacagagacuguugaaaggaccaauauccccaagauuuguuccaaagguaagcggacaguggauuugggccaaugcggguuacugggaaccaucacuggcccuccacagugugaccaguuucuagaguucucugcugaucucauuaucgaacgccgagacgguaacgaugucugcuacccggggaaauuugugaauggagaggcccugcgucagauacuuagaaagucaggcggcaucaacaaggagacaaugggguucaccuauaguggaauuaggacgaaugguacuaccagcgcaugucggcgcuccgggucuucguuuuacgccgaaaugaaauggcuguugucagacacagauaacgcugcauucccccaaaugacuaagagcuauaaaaauaccagaagggagccugcccucaucguauggggcauucaucacaguggauccacaaccgaacagacgaagcuguacggcucugguaacaaacugguuacuguggggagcuccaaguaucagcagucauuugucccaagucccggaacacggccucaagugaauggccagagcggccgcaucgacuuccauuggcucauauuagauucuaacgacaccgugacuuuuuccuucaauggggcuuuuauugccccagaucgagcgucauuccugaagggaaaaagcauggguauccagagugacguccagguugaugcaaacugcgagggcgaguguuaccacucugggggaacaauuaccuccagccuucccuuucaaaacaucaauucgagagccgugggcaagugcccuagguauguaaaacaggaaucuuugcugcuagcuacggguaugaagaacgugccagagcucccgaaaaagcggcguaaacgcgggcuguucggcgccaucgcaggauucauugaaaauggcugggaggggcuugucgacggaugguacgguuuuagacaccagaacgcucaaggcgaagggaccgccgcggacuacaaguccacacagucagccauagaucagaucacuggaaagcugaauagguugauugagaaaaccaaccagcaauucgagcucaucgacaaugaauuuacagagguggaaaagcagauaggcaacguuauuaauuggacucgggauaguaucaccgagguguggagcuauaacgcagaacuguuagucgcuauggagaaucagcauacaaucgaccuggccgauuccgagaugaacaaacucuacgaacgagugcgcaagcagcuuagagagaaugcugaagaggacgguaccggguguuucgaaauuuuucacaaaugcgaugacgauuguauggccucuaucaggaacaauacuuaugaccauagcaaguaccgggaggaggcaaugcaaaaccgcauucagauagaucccguaaagcugucaggcggauauaaagacguuaucuugugguucaguuuuggcgccuccugcuuccuacugcucgcuauugcgauggggcugguguuuaucugcgucaagaacggaaauaugagauguacgaucugcauuuga

SEQ ID NO: 136032 - RNA, 1692 nt, Artificial Sequence
  derived and/or modified sequence opt3 from hemagglutinin__InfluenzaA__AGB51388
augaacacccagauccugguguucgcccucgucgcuguuauucacacaaaugcagacaagauaugccuuggccaucacgccgugagcaacgggacuaaaguaaauacgcugaccgagagaggaguggaagucgugaacgcgacagagacuguugaaaggaccaauauccccaagauuuguuccaaagguaagcggacaguggauuugggccaaugcggguuacugggaaccaucacuggcccuccacagugugaccaguuucuagaguucucugcugaucucauuaucgaacgccgagacgguaacgaugucugcuacccggggaaauuugugaauggagaggcccugcgucagauacuuagaaagucaggcggcaucaacaaggagacaaugggguucaccuauaguggaauuaggacgaaugguacuaccagcgcaugucggcgcuccgggucuucguuuuacgccgaaaugaaauggcuguugucagacacagauaacgcugcauucccccaaaugacuaagagcuauaaaaauaccagaagggagccugcccucaucguauggggcauucaucacaguggauccacaaccgaacagacgaagcuguacggcucugguaacaaacugguuacuguggggagcuccaaguaucagcagucauuugucccaaaucccgagacacggccucaagugaacggacagaguggccgcaucgacuuccauuggcucauauuagauagcaaugacaccgugacuuuuucuuucaacggcgcuuuuauugccccagaucgagcguccuuccugaaggggaaaucaaugggaauccagagcgacguccagguugaugcaaacugcgagggugaauguuaccacaguggcgggacaauuaccucuucccuucccuuucaaaauaucaacagcagagccgugggaaagugcccuagguauguaaaacaggagucguugcugcuagcuacgggcaugaagaaugugccagaacucccgaaaaagcggcguaaacgcggucuguucggggccaucgcaggcuucauugagaacggaugggaaggccuugucgacgggugguacggauuuagacaccagaaugcucaaggugagggcaccgccgcggacuacaagucuacacaguccgccauagaucagaucacugggaagcugaacagguugauugagaaaaccaaucagcaauucgaacucaucgacaacgaguuuacagaaguggagaagcagacuggaaauguuauaaacuggacccgggauucaauuacagaaguguggaguuauaaugcagagcuguuagucgcuauggagaaccagcauaccaucgaccuggccgauagcgaaaugaauaaacucuacgagcgagugcgcaagcagcuuagagaaaacgcugaggaagacggcacugguuguuucgagaucuuucacaaaugcgaugacgauuguauggccuccauuaggaauaacacguaugaccauucuaaguaccgggaggaagcaaugcaaaaccgcauccagauugaucccguaaagcugagcgggggcuauaaagacguuauauugugguucucauuuggagccaguugcuuccuacugcucgcuaucgcgaugggccugguguuuauuugcgucaagaaugggaacaugagauguacaaucugcaucuga

SEQ ID NO: 136033 - RNA, 1683 nt, Artificial Sequence; identical to SEQ ID NO: 132004
  derived and/or modified sequence opt3 from hemagglutinin__InfluenzaA__EPI439507

SEQ ID NO: 136034 - RNA, 1704 nt, Artificial Sequence
  derived and/or modified sequence opt3 from hemagglutinin__InfluenzaA__EPI164216
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucagagauugcucaguggccgguuggcugcuuggcaacccuaugugugacgaguucaucaauguuccagaauggaguuauauaguggagaaggcgaacccggcuaaugaucugugcuaccccgggaacuuuaaugacuaugaggaauugaagcaucuccugagcaggaucaaccacuucgagaaaauucagaucauuccuaaguccucuuggucggaucaugaagccucaagcggagucaguuccgcauguccauaccagggcacacccagcuuuuuccggaaugugguauggcugaucaaaaagaacaauacuuauccuaccauaaaacgcagcuacaacaauacaaaccaagaggaccucuuaauucugugggguauccaccacuccaacgaugccgcugagcagaccaaacuuuaucagaauccaacuacauacauuucaguugggaccaguacguugaaccagcgacuggugcccaagaucgcaacucguagcaaagucaauggacaaucuggcagaauggacuuuuucuggaccauccuaaagccuaacgaugccauuaauuuugaauccaacggcaauuucauagcuccagaguacgccuauaaaaucgugaagaaaggggacucagcgauugugaagucugaagucgaguacggaaacugcaauacaaaaugucagacuccgaucggugcaauaaacaguucuaugcccuuucauaauauucacccucucaccaucggcgaaugcccaaaguauguuaaguccaacaaacuggugcuugccacagggcugaggaauagccccuugcgggagcgcagaaggaagcggggacucuucggcgcuaucgccgguuuuauugaagggggauggcagggcaugguagacggcugguacggguaucaucacucgaacgaacagggaucugguuacgcagcugauaaagaguccacccaaaaggccaucgacggcgugacgaauaaagucaacucaauuauagauaagaugaacacucaguucgaagcgguggggcgcgaguuuaauaaccuggaacgaagaaucgagaauuuaaacaagaaaauggaggacggauuccuggauguuuggacauauaaugccgaacuccuugugcugauggagaacgaaaggaccuuggacuuccacgauaguaaugucaagaaccuauacgacaaagugcggcugcagcuccgugauaaugcaaaggagcugggcaacgguuguuuugaguucuaccauaaaugcgacaaugaguguauggagagcguacgcaacgggacuuaugauuacccucaauauuccgaagaggcuagacuuaagagggaagagauuucuggcguuaagcuggagagcaucggaacauaccagaucuugucaauuuauaguaccguggccuccagccucgcucuggccauaauggucgcaggcuuaucucuguggaugugcucaaaugggagucuacagugccggaucuguauuuga

SEQ ID NO: 136035 - RNA, 1683 nt, Artificial Sequence; identical to SEQ ID NO: 134367
  derived and/or modified sequence opt3 from hemagglutinin__InfluenzaA__EPI486492

SEQ ID NO: 136036 - RNA, 1683 nt, Artificial Sequence
  derived and/or modified sequence opt3 from hemagglutinin__InfluenzaA__EPI740738
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaacgcacaguggauuugggccaaugcggguuacugggaaccaucacuggcccaccgcagugugaccaguuucuagaguucucugcugaucucauaaucgaacgacgugaggguucagacguuugcuaccccgggaaguuugugaacgaggaagcccugagacagauucuuagggagaguggaggcaucgauaaagaaacaaugggcuucaccuauagcgggauucggacgaauggagucacuuccgcauguaagcgcucugguucgucauuuuacgccgagaugaaguggcuguugagcaacaccgacaaugcugcauucccucaaaugacaaaaaguuauaagaacacuagaaaauccccagccaucauaguguggggcauucaccauucuguaagcaccgcugagcagacaaagcucuacggguccggaaauaaacugguuaccgugggcucaaguaacuaucagcagagcuuuguccccucuccuggugccaggccacaagugaaugggcuguccggacggaucgauuuccacuggcucauuuuaaaccccaaugacacggugacuuuuucauucaacggcgcguuuaucgcaccugaucgcgccagcuuccugcgaggcaagaguauggggauccagucuggaguccagguugacgcuaacugcgaaggugauuguuaccauuccggcgggacaauuauaagcaaucuuccauuucagaacaucgacucgagagccgugggaaagugcccgagguauguaaaacaacggucuuugcugcuagcaaccggcaugaagaaugugcccgagauuccuaaaggucguggccucuucggggcuaucgccggauucauagaaaacggcugggaggggcugauugauggaugguacgguuuucgccaccagaaugcgcagggcgaagggacugccgcagacuacaaguccacacaaucagcuaucgaccagaucaccggaaaacuuaacagacugauugccaagacgaaucagcaguucgaguugaucgauaacgaguuuaaugaagucgagaaacaaauuggcaacgugauaaauuggaccagggacaguaucacagaaguuuggagcuauaacgcugagcuccugauugccauggaaaaucagcacacuaucgauuuagcagacuccgagauggauaagcuguacgagcgggugaagcgacagcuccgcgaaaacgccgaggaagacgguaccggguguuucgagaucuuucauaaaugcgaugacgauuguauggcuucuauuagaaauaacacauaugaccacaggaaguaccgggaagaggcgaugcagaaccgcauacaaaucgauccagucaaacuuagcucaggcuauaaggacgugauucugugguucaguuuuggagcauccugcuucaucuugcuagccauuguaaugggccugguuuuuaucugcgugaaaaaugggaacaugagauguacuauaugcaucuga

SEQ ID NO: 136037 - RNA, 1683 nt, Artificial Sequence
  derived and/or modified sequence opt3 from hemagglutinin__InfluenzaA__EPI730495
augaacauccagauucugguguucgcccucauagcuaucauucccaccgacgcagauaagaucugccuuggccaccaugccgucagcaaugggacaaaaguuaacacucugacggagagaggaguggaaguagugaaugcgaccgagacagucgaaaggacuaacauuccucggaucuguuccaaggguaaacgcaccguggacuugggccaaugcggguuacugggaacaauaaccggcccaccgcagugugaucaguuucuagaguucucugcugaccucaucauugaacgacgugaggguucagauguuugcuaccccgggaaguuugugaaugaggaagcccugagacagauccuuaggaaaaguggaggcauugacaaggaggcaaugggcuucacuuauagcgggauccggacaaacggagccaccuccgcuugucgcagaucugguucgucauuuuacgcagaaaugaaguggcuguugagcaauacggauaacgccgcuuucccucaaaugacuaaaaguuauaagaauaccaggaaauccccagccauaauugucuggggcauccaccauucugugagcacagcggagcagacuaagcucuacggguccggaucaaaacugguaaccguuggcaguagcaacuaucagcagucuuuugugcccuccccuggugcacggccacaagucaaugggcugucaggacgcauugacuuccacuggcucaucuuaaaccccaaugauacagugaccuuuagcuucaacggcgccuuuaucgcuccugaccgagccaguuuccugagaggcaagucuauggggauucaguccggagugcaggucgaugcagacugcgagggugauuguuaccauagcggcgggacgauaaucucgaaucuuccauuucagaacauugacucuagggcuguuggaaagugcccgcgguaugugaaacaacguuccuugcugcuagccacuggcaugaagaacguacccgaaaucccuaaaggucgcggccucuucggggcgauagccggauucauugagaauggcugggaagggcugaucgacggaugguacgguuuuagacaccagaacgcacagggcgaggggacagcugccgauuacaagucaacccaaagugcuaucgaccagauuacuggaaaacuuaauaggcugaucgaaaagacaaaccagcaguucgaguugauugauaaugaguuuauagaaguggagaaacaaaucggcaacgucauuaauuggacccgggacagcaucacggaagugugguccuauaacgccgagcuccugguugcaauggaaaaucagcacaccaucgauuuagccgacucugagauggauaagcuguacgagcgagugaagcgccagcucagagaaaacgcugaggaagacgguacaggguguuucgagauuuuucauaaaugcgaugacgauuguauggcgagcauaaggaauaacacuuaugaccacucaaaguaccgggaagaggcaaugcagaaucgcauccaaauugacccagucaaacuuaguuccggcuauaaggaugugauccugugguucagcuuuggagccucuugcuucauuuugcccgcuaucguaaugggccuaguuuuuaugugcgugaaaaacgggaauaugagauguaccauaugcaucuga

SEQ ID NO: 136038 - RNA, 1683 nt, Artificial Sequence
  derived and/or modified sequence opt3 from hemagglutinin__InfluenzaA__EPI712926
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaacgcacaguggauuugggccaaugcggguuacugggaaccaucacuggcccaccgcagugugaccaguuucuagaguucucugcugaucucauaaucgaacgacgugaggguucagacguuugcuaccccgggaaguuugugaacgaggaagcccugagacagauucuuagggagaguggaggcaucgauaaagaaacaaugggcuucaccuauaaugggauucggaucaacggagucacgagcgcauguaagcgcuccgguucuucguuuuacgccgagaugaaguggcuguugucaaauacugacaacgcugcauucccucaaaugaccaaaagcuauaagaauacaagaaaaaguccagccauaauuguguggggcauccaccauuccguaucuacugcugagcagaccaagcucuacgggagcggaaacaaacugguuacagugggcuccucaaauuaucagcagaguuuuguccccagcccuggugccaggccacaagugaacgggcugucuggacggauugauuuccacuggcucaucuuaaaucccaacgacaccgugacguuuuccuucaacggcgcguuuaucgcaccugaucgcgccucauuccugcgaggcaagagcauugggauacagaguggaguccagguugacgcuaauugcgaaggugauuguuaccauucuggcgggacuaucauuuccaaccuuccauuucagaauaucgacagcagagccgugggaaagugcccgagguauguaaaacaacggucguugcugcuagcaacaggcaugaagaacgugcccgagauaccuaaaggucguggccucuucggggcuauugccggauucaucgaaaauggcugggaggggcugaucgauggaugguacgguuuucgccaccagaacgcgcagggcgaagggaccgccgcagacuacaagucuacucaauccgcuauugaccagaucacaggaaaacuuaauagacugauugccaagaccaaccagcaguucgaguugauagauaaugaguuuaacgaagucgagaaacaaaucggcaaugugauuaacuggacgagggacucaaucaccgaaguuuggaguuauaaugcugagcuccugaucgccauggaaaaccagcacacaauugauuuagcagacagcgagauggauaagcuguacgagcgggugaagcgacagcuccgcgaaaaugccgaggaagacgguacuggguguuucgagauauuucauaaaugcgaugacgauuguauggcuuccaucagaaacaacaccuaugaccacaggaaguaccgggaagaggcgaugcagaaucgcauucaaaucgauccagucaaacuuucuagcggcuauaaggacgugauucugugguucucauuuggagcaaguugcuucaucuugcuagccauaguaaugggccugguuuuuaucugcgugaaaaacgggaauaugagauguacaauuugcaucuga

SEQ ID NO: 136039 - RNA, 1683 nt, Artificial Sequence; identical to SEQ ID NO: 132004
  derived and/or modified sequence opt3 from hemagglutinin__InfluenzaA__AGL44438

SEQ ID NO: 136040 - RNA, 1683 nt, Artificial Sequence
  derived and/or modified sequence opt3 from hemagglutinin__InfluenzaA__EPI445996
auggagaccgugagccugaugacaauccuccuucuggucacuacguccaacgccgacaagauuugcauaggccaccagucuaccaauucaacagaaacuguugauaccuugacagagaccaacgugcccguaacucaugcuaaagaauuacugcacacagaccauaaugggaugcuaugugcaaccaaccucggacacccucugauccuugauacgugcaauguggagggucugauuuacggcaacccaaguugugacuugcuccuugggggaagagaauggagcuauaucgucgagaggccguccgccgugaauggcacuugcuaccccgguaacguugagaaucuggaggaacuccggaccuuauucucuucgucaagcaguuaucaacgcauucagaucuuuccugauacaauauggaacgugacuuacaccgggacauccaagucuuguagcgacuccuucuaucgaaauaugcguuggcugacccagaaaaacggacuuuacccaguccaggaugcgcaauuuacgaauaacagaggcaaggacaucuuguucguguggggcauucaucaucccccuacugauacagcucagaccaaucuguauacuaggacagacaccacgaccucaguaacaacugaaaaccuagaucggaccuuuaaaccacucaucgggccccgcccucugguuaacggacuuauugguagaaucaauuacuacuggagugugcugaagccaggccagacauugaggguccggagcaacgggaaucucauagccccgugguauggacacgugcugucuggcgagucccacggucgcauuuuaaagacuaaccucaauucagggaacugcgugguccagugucaaaccgagaaaggaggccugaauagcacacuucccuuccacaacaucaguaaguacgcauuuggcaauugcccuaaauauauugggguuaagucucugaaauuggccaucggacuacgaaacgugccagcuaaguccagcagaggucuguucggcgcaaucgccggguuuauugaaggaggcuggcccggucucguagcugggugguacggcuuccagcauucgaaugaccagggagugggcauagccgcggauagggucucuacccagaaggcaguggacaaaaucacuuccaagguuaacaauauuguggacaaaaugaacaagcaauaugagaucauagaucacgaauuuucagaggucgaaacgcggcugaauaugauuaacaacaaaaucgacgaucagauccaggacgugugggccuacaaugcugagcuucugguauugcucgagaaccaaaagacacuggaugaacacgacgccaauguuaacaauuuauauaacaaagugaagcgugcacuggggaguaaugcucuagaggauggaaaggguuguuucgaacucuaccauaaaugcgacgaucaguguauggagaccauucgcaacggcacuuacaauagaaggaaguaucaggaagagagccggcuggagcgacagaaaaucgaagggauuaagcuggaguccgaaggaaccuacaaaauauugacaaucuauucuaccgucgccagcucacuggugcucgcgaugggcuuugccgcauuccuguucugggcuaugaguaacgguuccugccgcugcaauauuuguaucuga

SEQ ID NO: 136041 - RNA, 1695 nt, Artificial Sequence
  derived and/or modified sequence opt3 from hemagglutinin__InfluenzaA__EPI433309
auggagaagaucgugcugcuccuugccauugcuagccuggucaaauccgaccagauaugcaucggcuaccacgcaaacaauucuaccgaacaaguugauacaauuauggagaagaacgugacuguaacgcaugcccaggacaucuuggaaaagacccacaaugggaaguuaugugaucuggacggagugaaaccccuaauucucagagauugcucagucgcggguuggcugcuuggcaacccuaugugugacaaguucaaugaugugccagaguggaguuauaucguugaaaaggcuaacccggccaaugaccugugcuaccccgggaacuugaaugauuaugaggagcucaaacaucugcugagcaggauaaaccacuuugaaaagauccagacauucccuaaauccucuuggucggaccaugaggcaucacucggagugagcgccgcuuguccauaccagggcaugcccuccuuuuuccggaaugucgugugguuaauuaagaaaaacaauacuuauccuaccaucaaguccucuuacaacaauacaaaccaagaagaucugcuuauuuugugggguauccaccacagcaacgacgaggcagagcagacccgccuguaucagaauaguaacacuuacauaucaguagggacaaguacccuaaaucagcgacucguuccaaagauugccacgcguagcaaagugaacggacaaucuggcagaauggauuucuucuggacuauccugaagcccaaugacgcuauuaacuuugaauccaauggcaacuucaucgccccugaguacgcguauaaaaucgucaagaaaggggacucagcaauuaugaaaagcgaagugggauacggugauugcaauaccaaaugucagacaccaauaggcgccaucaacaguucuaugccguuucauaauauucacccccuuacuaucggggagugcccuaaguaugugaaguccaacaaacuggucuuggcuaccggacucaggaauagcccacagauagaaacacggggccuguucggugccauugcaggguuuaucgagggaggcuggcagggcaugguugacgggugguacggauaucaucacucgaacgagcaagguucuggcuacgcugccgauaaggaauccacccagaaagcgaucgacggggugacgaauaagguaaacucaauuaucgauaaaaugaacacucaguucgaggccguggaacgcgaguuuaauaacuuagaaagaaggauugagaaucugaacaagaagauggaggacggauuccucgaugucuggacauauaaugcagaacuucugguguugauggagaacgaacggacccuagacuuccacgauaguaauguuaaaaaccuguacgacaaggugcgccuccaacugcgagauaaugcuaaagagcuuggcaacgguuguuuugaauuuuaccauaagugcgacaaugaguguauggagagcgucagaaacgggacuuaugacuacccccaguauuccgaagaggccaggcugaaacgggaagagauaucuggcgugaaguuggagagcaucggaacauaccagauucucucaaucuauaguaccguagcuuccagccuggccuuagcaaucaugguugccggccugucucuauggaugugcucaaaugggagucuccagugccguauuuguauauga

SEQ ID NO: 136042 - RNA, 1683 nt, Artificial Sequence
  derived and/or modified sequence opt3 from hemagglutinin__InfluenzaA__EPI470859
auggaggccaucccccugauuaccauacuccuuguggucacagcuagcaacgcagacaagaucugcauuggcuaccaguccacuaauucuacggaaaccguugauacacugacugagaacaaugugccuguaacccacgccaaagaauuguuacauacagagcacaacgggaugcugugugcgaccaaucuaggaagaccacucauccuggacacuugcacaauugaaggucuuaucuauggcaacccgucaugugaucuguugcucgggggaagggaguggaguuacauaguggagcggcccagcgcugucaauggcaugugcuauccugguaacguggaaaaucuggaggaacugcgcuccuucuuuucuucggccucaagcuaccaacgaauccagauuuucccagacaccaucuggaacguuaguuauuccgggacgucuaaggcauguagcgauuccuuuuaccguucaaugagauggcucacucagaaaaauaacgccuaucccauucaggacgcucaauacaccaauaacaggggaaagaguaucuuauucauguggggcauaaaucauccuccaacagauacugcacagaccaaccuguacacacggaccgacacgacuacaagcguggccaccgaggauauuaaccgcacuuuuaaacccgucaucggcccuagaccacuugugaauggguugcagggaaggauugacuauuacuggucuguacugaagccgggucagacacuacggguucgcuccaacggcaaucucaucgcucccugguaugggcacauccugucaggagagagccauggccgaauacuuaagaccgaucugaacagugguucuugcgugguccaaugucagacggaaagagggggauugaauaccacacucccuuuccacaacguguccaaauacgccuuuggcaauugcccaaaguaugugggcgucaaaagccugaaguuagcgguugggcugaggaacgugcccgcacggucgucucguggacucuucggugccauugcuggcuuuaucgaagggggaugguccggccuuguagccgguugguacggguuccagcacucaaaugaccagggcgugggaauugcagcugaucgcgacaguacucaaagagccaucgacaaaauaaccagcaaggucaacaauauuguggauaagaugaacaaacaguaugagaucaucgaccaugaguuuuccgaaguugagaauaggcugaacaugauuaauaacaagaucgaugaccagauucaagauauaugggcguacaacgccgaguugcuagugcugcucgaaaaucagaaaacacuggacgagcacgaugcaaacgucaauaaccuuuacaauaaggugaaacgggcucugggcucuaacgccauggaagacgggaagggauguuucgaguuguaucauaaaugcgaugaccaguguauggaaacuauccgaaaugguaccuacaaccgcagaaaguauaaggaggagagcaggcucgaacggcagaaaauugagggcguaaagcuggaaucagaggggacauacaaaaucuuaaccaucuauaguacuguugcuuccagccuggugauugccaugggauuugcagccuuccuauucugggcuaugucuaauggcucaugccgcugcaacauauguaucuga

SEQ ID NO: 136043 - RNA, 1683 nt, Artificial Sequence
  derived and/or modified sequence opt3 from hemagglutinin__InfluenzaA__EPI498037
auggagaccgugagccugaucacaauucuccuugucgccacuguuuccaacgcugacaagauaugcaucggcuaccagucuacuaauucaaccgaaacaguggauacucugaccgagaacaauguacccgugacacacgcaaaagaauuguuacauaccgagcacaacgggaugcugugugccacgagucuaggacaaccucucauucuggacacaugcaccaucgaaggucuuauuuauggcaauccaagcugugaucuguugcucgaggggagagagugguccuacaucgucgaaaggccgucugcggugaacggacugugcuaucccggcaauguugagaaccuggaggaacuccggucguuauucucaagcgcucgcaguuaccagcgaauacagaucuuuccugacacgauuuggaauguguccuauaacgguacuucuaaggccuguagcggguccuucuaccguucaaugagauggcugaccaggaaaaauggagauuauccaauccaggacguccaauacacaaacaaucagggcaagaacauucuuuuuauguggggcaucaaucaucccccuacugauaccacacagcgggacuuguacacccgcacggauacuacaaccaguguggcaacugaggaaauaaacagaauuuucaaaccacugaucgggcccaggccucuaguaaacggacucaugggucggauugacuauuacuggagcguucugaagccaggccagacacuucgcaucaagucugaugggaaucugaucgccccgugguauggacacauuuuguccggcgagucacauggucgaauacucaaaaccgaccugaagagagggagcugcacggugcaaugucagaccgaaaaaggaggcuuaaacacaacucugcccuuucagaaugucaguaaguacgcuuucggcaacugcucuaaauauaucgggauuaagucccucaaacuugcagugggacugaggaaugugccuagccggucgucucgugguuuguuuggcgccaucgcuggguucauagagggaggcugguccggucuagucgccgggugguacggcuuucagcacucaaacgaucaaggaguuggcauggcggcagaccgcgacaguacccagaaggccauugauaagaucacaagcaaagugaauaacaucguagacaagaugaauaaacaguaugaaauuaucgaucacgaguucuccgagguggaaacuagacugaacaugauuaauaacaagauagacgaucaaauccaggacauuugggcuuacaaugccgagcuccugguccuucuggaaaaccagaaaaccuuggaugagcaugacgcaaaugugaacaaccucuacaauaagguuaagagggcucuggggucuaacgccguggaagauggaaaagguuguuuugaguuauaucacaagugcgacaaucaguguauggagacaauccggaacggcaccuacaauaaacgaaaguaucaagaagagagcaaacuggaacgccagaagaucgagggggucaagcuagaaucagagggaacuuacaaaauucucacgauauauaguacaguggcguccagccugguaaucgccaugggcuucgcagcuuuucuuuucugggccaugucuaacgguucaugcagaugcaauauuuguaucuga

SEQ ID NO: 136044 - RNA, 1683 nt, Artificial Sequence
  derived and/or modified sequence opt3 from hemagglutinin__InfluenzaA__AGO17847
auggagaccaucagccugaugacaauucuccuuauaacuacggccuccaacgcugacaagaucugcauuggccaccagucuaccaauucaacagaaacuguggauacccugacagagaccaacguccccguuacucaugcaaaagaauuguuacaaacagagcacaaugggaugcugugugccaccaaccuaggacauccucucauccuggacacgugcacuauugaaggucuuaucuacggcaauccaaguugugaucuguugcucgaggggagagaguggagcuauauaguggaaaggccguccgcgguaaacggaaccugcuaccccggcaauguggagaaccuggaggaacugcggacacucuucucuucggcuucaagcuaucagcgcauccagauuuuuccugacacuaccuggaaugucacauacaccgguacgagucgauccuguucugggagcuucuaucguuccaugagaugguuaacucagaagucaggauuuuacccagugcaagaugccaaauauacaaacaauaggggcaagaacauccuguucguuuggggcauucaccauccccacaccuacacugaccagacaacccuuuacauccggaaugauacgaccacaagugugacuaccgaggaauugaaccgcauauuuaaaccugucauugugccaagacugcuaguaaaugggcagcagggaaggaucgacuauuacuggagcguucucaagcccggucaaacacugcgggugcgcucuaacggcaaccuuauugcaccuugguaugggcacguccuguccggaggcucacauggucgaaucuugaagacugaucucaaaagcgggaauugcguggugcagugucagaccgagaagggaggccugaacaguacauuaccauuccacaauaucucuaaauacgccuuugggaccugcccgaaguaugucaaaguuaacucccugaagcucgcuauuggccuuagaaaugugcccgcaaggagcaaccggggacuguucggugccauagcuggcuuuaucgaagggggauggccuggcuugguagccgguugguacggguuccagcauucgaaugaccaaggcgugggaauggcggcagaucgugacucuacucagaaggccgucgauaaaauuacguccaaggugaacaauaucguugacaaaaugaacaagcaguaugagauaauugaccacgaauuuucagagguggagacacgccuaaauaugaucaacaauaaaaucgaugaccaaauucaggaugucugggcuuacaacgccgaacugcucgugcugcuugagaaucagaagacccuggacgaacacgaugcaaacguaaacaauuuguacaacaaaguuaagagagcucucggcaguaaugccauggaggacgggaagggauguuucgaacuguaucauaaaugcgaugaccaguguauggagacuaucaggaacgguaccuacgaucggcgaaaguaucgcgaggaaagcagauuagagaggcaacggauugaaggcgugaaacuggaguccgaagggacauacaagauacuaaccaucuauucuacugucgcgagcucacucgugauugccaugggauuugcagcuuuccuguucugggccaugaguaauggcuccugccgcugcaacaucuguaucuga

SEQ ID NO: 136045 - RNA, 1683 nt, Artificial Sequence
  derived and/or modified sequence opt3 from hemagglutinin__InfluenzaA__ANZ03807
auggagaccgugagccugaucacaauucuccuugucgccacuguuuccaacgcugacaagauaugcaucggcuaccagucuacuaauucaaccgaaacaguggauacucugaccgagaacaauguacccgugacacacgcaaaagaauuguuacauaccgagcacaacgggaugcugugugccacgagucuaggacaaccucucauucuggacacaugcaccaucgaaggucuuauuuauggcaauccaagcugugaucuguccuuggaggggagagaguggucuuacaucgucgaaaggccgucggcggugaacggacucugcuaucccggcaauguugagaaccuggaggaacugcggucacucuucagcagugcucgcuccuaccagcgaauacagaucuuuccugacacgauuuggaaugugucuuaugaugguacuagcaccgccuguuccgggucauucuaccguaguaugagaugguuaacaaggaagaacggagacuauccaacucaggaugcacaauacaccaauaaccagggcaaaaauauccuguuuauguggggcauuaaccaucccccuacagacgauacccagcggaaucuuuacacgcgcacugacacaaccacuagcgucgccacagaggaaaucaacagaauauucaagccauugauugggcccaggccucuggugaacggacuaaugggucggaucgauuauuacuggucuguacucaaaccaggccagacccugcgcauuaaguccgacgggaaucuuaucgcuccgugguauggacacauccugucaggcgagagccauggucgaauuuugaagacggaucucaaaagagggaguugcaccguucaaugucagacagaaaagggaggccugaacacuaccuuacccuuucagaaugugucuaaauacgcauucggcaacugcuccaaguauauagggaucaaaagccugaagcucgccgucggacuuaggaaugugccuucgcggucuucccguggucuguuuggcgcuauugccggguucaucgagggaggcuggucagguuugguggcggggugguacggcuuucagcacaguaacgaccaaggagucggcauggcagccgaccgcgauagcacacagaaggcuauagacaaaauuacuuccaagguuaauaacaucguggauaaaaugaauaagcaguaugaaaucauugaccacgaguucucugagguagaaaccagacuaaacaugaucaauaacaaaauugaugaccaaauacaggauaucugggccuacaaugcagagcugcucgugcugcuugaaaaccagaagacacuggacgagcaugaugcuaaugucaacaacuuguacaauaaagugaagagggcccucgggagcaacgcgguugaagacggaaaggguuguuuugagcuguaucacaaaugcaaugaucaguguauggagaccauucggaacggcacuuacaaucgacgcaaguaucaagaagagucaaaauuagaaagacagaagaucgagggggugaaacuggaaagugagggaacguacaagauccuaacaauuuauuccaccgucgccagcucucucgugauagcaaugggcuucgcugccuuucuguucugggcuaugucaaacgguaguuguaggugcaauaucugcauuuga

SEQ ID NO: 136046 - RNA, 1683 nt, Artificial Sequence; identical to SEQ ID NO: 136045
  derived and/or modified sequence opt3 from hemagglutinin__InfluenzaA__EPI680526

SEQ ID NO: 136047 - RNA, 1683 nt, Artificial Sequence; identical to SEQ ID NO: 135701
  derived and/or modified sequence opt3 from hemagglutinin__InfluenzaA__ALT20080

SEQ ID NO: 136048 - RNA, 1410 nt, Artificial Sequence
  derived and/or modified sequence opt3 from neuraminidase__InfluenzaA__AAA43084
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgagguggucgaguauaggaacuggaguaaaccucagugccaaaucaccggguucgcgccauuuagcaaggauaauuccauacgguuaucugcuggaggugacauuugggugacucgcgaacccuacguuucgugugauccuggcaaaugcuaucaguucgcccuggggcagggaacaacccuagacaacaagcacucaaauggcacgauccaugaucguauuccacaccgaacucuccugaugaacgagcuuggugugcccuuucaucuggggaccaagcaggucuguguggcauggagcaguuccucuugccacgacggaaaagccugguugcacguauguguuacaggcgaugacagaaaugcuacugccagcuucaucuacgauggcaggcucguggacuccaucgggucauggagucaaaacauucugcggacccaggaaagcgagugcgucuguauaaauggaacaugcaccguggugaugacggaugguucugcauccggccgcgcugacacuagaauccuguuuauuaaggaggggaaaaucguccauauaucaccucucagcggaagugcccagcacauugaagagugcucuuguuauccaagguacccggauguucggugcaucugucgcgacaacuggaagggcuccaaucgacccgugaucgacauuaacauggaagauuauagcaucgacucggguuacguaugcucuggguuagugggagauacaccuagaaacgacgauuccucaaguaauagcaacuguagggacccaaauaacgagcggggcaaucccggcgucaaagggugggcguucgauaacggagacgauguguggaugggucguaccauuaauaaggaaucccgcucuggcuacgagacuuuuaagguuauagggggauggagcacaccuaacucaaaaagucaggugaauagacaagucaucguggacaacaauaacugguccggcuauagcgguauuuucucuguagaggggaagucaugcaucaauagguguuuuuacguugaacugauccggggccgaccacaggagacccgcgugugguggacgaguaacagcauugucguguucugcggaaccuccggcacauaugggacuggaucuuggcccgauggugcaaauauaaacuuuaugccgaucuga

SEQ ID NO: 136049 - RNA, 1362 nt, Artificial Sequence
  derived and/or modified sequence opt3 from neuraminidase__InfluenzaA__AAA43397
augaaccccaaucagaagaucauuaccauaggcagcaucugcaugguggucgggauuaucucccugauucuccaaaucggaaacauaaucucuauuuggaucucacacaguauucagacagguaaucagaaccauacuggcaucuguaaucaggggagcauaacguacaaaguuguggccggacaagacuccaccucuguaauucuuacaggcaacucgucacugugcccuaucagagguugggcuauucacagcaaggauaaugggaucaggaucggaaguaaaggcgacguguucgucauucgggagccauuuauauccuguucucauuuggaaugccgcacuuucuuuuuaacccagggcgcacugcuaaacgauaagcacagccgagggacauucaaagaccguuccccguauagagcccucaugucaugucccgugggagaggcgccuaguccauacaauagcagguuugaaucuguugcuugguccgccucagcaugccaugauggugugggcuggcugaccaucgggauuagcggacccgacgauggcgccgucgcugugcuuaaguauaaccggaucauaacugagacaauuaagaguuggcgcaaaaauauccugagaacccaggaaucugaguguacgugcguaaacgguuccuguuucacuaucaugaccgacgggccuagcgauggauuggcaucguacaagauuuuuaaaaucgagaagggcaaaguuacaaagucuauugaacucaaugccccaaacucccacuaugaggaaugcucauguuaccccgacacuggcaaggugaugugcgucugcagggauaauuggcacgggaguaaccggccuugggugagcuucgaccagaaccuggauuauaaaauaggauacaucuguuccgguguguuuggcgacaauccacgcccgaaggacgggaccggaucuugcggccccgucagcgcugauggugccaacgggguuaaaggcuucucauacaaguauggaaauggcguguggauugggcgaacaaaaagugacuccagcagacauggauuugagaugaucugggauccuaacgguuggaccgagacggacucuagguucucaaugcggcaagauguaguggcgaucacuaaucguaguggcuacagcggguccuuuguccagcacccagaacugacaggacucgacuguaugcgccccugcuucuggguggaguuaauuagaggccugccugaagaggaugcaauauggaccucugguucgaucauuagcuucugugggguuaacuccgacacuguggauuggucauggccagacggcgccgaacuucccuuuacaaucgauaaguga

SEQ ID NO: 136050 - RNA, 1365 nt, Artificial Sequence
  derived and/or modified sequence opt3 from neuraminidase__InfluenzaA__AAA43412
augaaccccaaucagaagaucauuaccauaggcagcaucugccugguggucgggcucauuucccuuauccugcaaauuggaaacaucauaucuaucuggauuucacacaguauccagacagguagccagaaucauacuggcauuuguaaccagaauaucauaacguacaaaaacuccaccuggguuaaggacacaacuucugugauuuugaccggaaauucgucauuaugcccuaucagagggugggccauuuauagcaaagauaacaguaucaggaucggcuccaagggugacguauucgugauucgggagccauuuauaucuuguagccaccuggaaugccgcacauucuuucuaacccaaggggcucuccugaaugaucgacauuccaacggaacugucaaagaccguucaccguacagagcacuuaugaguugucccgugggcgaggccccuagcccauauaauucuagguucgaauccguugcguggucagcuagcgccugccacgauggcaugggguggcugacaaucggaauuaguggucccgacaacggcgcaguggccgucuugaaguacaaugggaucauaaccgagacgauuaagucuuggcggaaaaagauccuccgcacucaggaauccgagugugcuugcgugaacggaagcuguuuuaccaucaugacagauggcccuucggacggucuggcaucuuauaaaauuuucaagaucgagaaagggaagguaacuaaguccauugaacugaaugccccaaacucacauuacgaggaaugcaguuguuaucccgauaccggaaaaguuaugugcgugugcagagacaacuggcacggcagcaauaggccuugggucuccuuugaucagaaccucgacuaccagauaggcuacaucuguucugggguguucggagauaauccacggccgaaggacgguacaggcagcugcgggcccguguaugucgacggagcuaacggcguuaaagguuuuucauaccgcuaugggaauggcguguggauuggacgaaccaagagucacuccagcagacauggcuucgagaugaucugggauccuaacggguggacggagacugacucuaaauuuucaguaaggcaagauguggucgccaugacagacuggaguggauacagcgguuccuucgugcagcacccagaauuaaccggccuggauuguauccggcccugcuuuuggguugagcuuauucgugggcgcccuaaggagaaaacuauauggacaucugcgucgagcaucuccuucuguggagucaauucagacaccguggauuggaguuggccagacggcgcagaauugcccuucacgauugauaaguga

SEQ ID NO: 136051 - RNA, 1410 nt, Artificial Sequence
  derived and/or modified sequence opt3 from neuraminidase__InfluenzaA__AAG01743
augaaccccaaucagaagaucauuacccugggcagcgugucccucacaauagccacuaucugcuuccuuaugcaaauugcuauccuggucacgaccguuacauugcacuuuaaacaguacgagugugacuauccugcaaacaaucaggccaugccaugcgaaccgauuaucauagagagaaacaucacugaaauuguguacuuaaccaauacaaccaucgagaaggaaguaugucccaaacugguggaguauaggaacuggucuaagccucagugcaaaauuacuggguucgcgccauuuucaaaggauaauaguauccggcuaagcgcuggaggugacauaugggucacacgcgagcccuacguguccugugauccuggcaagugcuaucaauucgcccucgggcagggaaccacgcuggacaacaaacauucuaaugauacuauucacgaccgaaccccacaucguacacuucugaugaacgaauugggcguucccuuucaccucgguacuagacagguguguaucgcauggucgucaagcaguugccaugaugggaaggccuggcugcacgucugugugaccggauacgacaaaaaugcuacagcauccuucauuuaugauggcaggcugguagacucuaucggcagcuggucccagaacauccuccggacccaagagucagaaugcguuuguauuaaugggacgugcacuguggucaugacagauggaagugccagcggucgcgcugacaccaagauauuauuuaucgaggagggcaaaauugugcacacuucuccucuguccgggucagcccagcauguggaagagugcagcuguuacccaagauacccgggagucaggugcaucugucgggauaacuggaagggcaguaaucgccccguuguggacauaaacguaaaggacuauucuauuaacuccagcuacgugugcucgggucuugucggggauacaccucgaaauaacgacagaucuuccucaaguuauugucagaauccaaacaaugaaaaaggaacccacggcgugaagggcugggcguucgaugacgggaacgauguuuggaugggaaggacgaucagcgaggacucccggucugguuacgaaaccuuuaaagugaucggcggguggagcacacccaauucaaaguugcagauuaaccgucaagucaucguggauagugacaaucgcuccggauauagcggcauuuucucuguagaggguaaaucaugcauaaacagauguuuuuacguugagcugaucagggggcgggaacaggagacucgagugugguggaccaguaauagcauugucguguucugcggcacauccggaacuuauggcaccgggucuuggccugauggagcagacaucaacaucaugccaauuuga

SEQ ID NO: 136052 - RNA, 1410 nt, Artificial Sequence
  derived and/or modified sequence opt3 from neuraminidase__InfluenzaA__AAG01759
augaaccccaaucagaagaucauuaccauaggcagcgugucccugacaaucgccacuaugugcuuccucaugcaaauugcuauccuugucacgaccguuacacugcacuuuaaacaguacgaguguaacucuccuccaaauaaccaggugauuuugugcgaaccgacuaucauagagagaaauaucaccgaaauuguauauuuaacaaacaccacuaucgagaaggaaauuugucccaaacuggcagaguacaagaauuggucaaaaccucagugcaagaucacaggguucgccccauuuaguaaggacaacagcauaaggcuauccgcgggaggugauauuugggugacccgggagcccuaugucucuugugacccugauaaaugcuaccaauucgcucucggccaggggacgacucugaauaaccgccauucgaaugacaccgugcacgaucgaacaccauaucguacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaagacugguagauagcaucggcuccuggucaaagaaaauccucaggacgcaggaaagugagugcguuuguauuaacggcacuugcacaguggucaugaccgacgggagcgcaucuggacgggccgauacuaagauauuauuuaucgaggaagguaagauugugcacaucuccccucugcuuggcucagcucaacauguggaggaaugcagcuguuauccacgcuacccgggggucagaugcguuuguagggacaauuggaaaggaaguaaccggcccauaguggauauuaacguaaaggacuacucuaucguguccagcuaugucugcucgggcuuggugggugacacaccucgcaaaaaugaucgaucuuccucaaguaacugucugaauccaaacaaugaggaagggggacacggcguuaagggcugggccuucgacgaugggaacgacguguggaugggaagaaccaucagcgagaaacuaagguccgguuacgagacguuuaaggucauugaaggcuggucuaaacccaauagcaagcuccagaucaaccgucaggugauuguagaucgggggaaucgcucaggauauaguggcauauucuccguugaggguaagagcugcaucaacagauguuuuuacguggaacugauuagggggcggaaacaggagaccgaagucugguggacaucuaauucaaucguggucuucugcggcaccaguggaacuuauggcacagggagcuggccugacggagcggauaucaaccuuaugccaauuuga

SEQ ID NO: 136053 - RNA, 1410 nt, Artificial Sequence
  derived and/or modified sequence opt3 from neuraminidase__InfluenzaA__AAG01777
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugaucuugugcgaaccgacuauaaucgagagaaauauuaccgaaaucguauauuuaacaaacaccacuauugagaaggaaaucugucccaaacuggcagaguacaagaauuggucaaaaccucagugcaagauaacaggguucgccccauuuaguaaggacaacagcauuaggcuauccgcgggaggugauaucugggugacccgggagcccuaugucucuugugacccugauaaaugcuaccaauucgcucucggccaggggacgacucugaauaaccgccauucgaaugacaccgugcacgaucgaacaccauaucguacucuucugaugaacgaauugggaguucccuuucaucucggcaccaaacagguguguauugccuggucaagcaguuccugccacgacgguaaggcauggcugcaugucugugugacagggcacgaugagaaugccaccgcuucuuucaucuacgacggaagacugguagauagcaucggcuccuggucaaagaaaauucucaggacgcaggaaagugagugcguuuguauaaacggcacuugcacaguggucaugaccgacgggagcgcaucuggacgggccgauacuaagaucuuauuuauugaggaagguaagaucgugcacauauccccucugcuuggcucagcucaacauguggaggaaugcagcuguuauccacgcuacccgggggucagaugcguuuguagggacaauuggaaaggaaguaaccggcccauuguggauaucaacguaaaggacuacucuaucguguccagcuaugucugcucgggcuuggugggugacacaccucgcaaaaaugaucgaucuuccucaaguaacugucugaauccaaacaaugaggaagggggacacggcguuaagggcugggccuucgacgaugggaacgacguguggaugggaagaaccauuagcgagaaacuaagguccgguuacgagacguuuaaggucaucgaaggcuggucuaaacccaauagcaagcuccagauuaaccggccugugauaguagaucguggggaccgcucaggauauaguggcaucuucuccguugaggguaagagcugcauuaauagauguuuuuacguggaacugaucagggggcggaaacaggagaccgaagucugguggacaucuaacucaaucguggucuucugcggcaccaguggaacuuauggcacagggagcuggccagauggagcggacauuaaucuuaugcccauauga

SEQ ID NO: 136054 - RNA, 1410 nt, Artificial Sequence
  derived and/or modified sequence opt3 from neuraminidase__InfluenzaA__AAG01786
augaaccccaaucagaagaucauuaccauaggcagcgugucccugacaaucgccacuaugugcuuccucaugcagauugcuauccuugucacgaccguuacacugcacuuuaaacaguacgaguguaacucuccuccaaauaaccaggugauuuugugcgaaccgacuaucauagagagaaauaucaccgaaauuguauauuuaacaaacaccacuaucgagaaggaaauuugucccaaacuggcagaguacaagaauuggucaaaaccucagugcaagaucacaggguucgccccauuuaguaaggacaacagcauaaggcuauccgcgggaggugauauuugggugacccgggagcccuaugucucuugugacccugauaaaugcuaccaauucgcucucggccaggggacgacucugaauaaccgccauucgaaugacaccgugcacgaucgaacaccauaucguacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaagacugguagauagcaucggcuccuggucaaagaaaauccucaggacgcaggaaagugagugcguuuguauuaacggcacuugcacaguggucaugaccgacgggagcgcaucuggacgggccgauacuaagauauuauuuaucgaggaagguaagauugugcacaucuccccucugcuuggcucagcucaacauguggaggaaugcagcuguuauccacgcuacccgggggucagaugcguuuguagggacaauuggaaaggaaguaaccggcccauaguggauauuaacguaaaggacuacucuaucguguccagcuaugucugcucgggcuuggugggugacacaccucgcaaaaaugaucgaucuuccucaaguaacugucugaauccaaacaaugaggaagggggacacggcguuaagggcugggccuucgacgaugggaacgacguguggaugggaagaaccaucagcgagaaacuaagguccgguuacgagacguuuaaggucauugaaggcuggucuaaacccaauagcaagcuccagaucaaccggcaagugauuguagaucguggggaccgcucaggauauaguggcauauucuccguugaggguaagagcugcaucaauagauguuuuuacguggaacugauuagggggcggaaacaggagaccgaagucugguggacaucuaacucaaucguggucuucugcggcaccaguggaacuuauggcacagggagcuggccugauggagcggacaucaaucuuaugccaauuuga

SEQ ID NO: 136055 - RNA, 1410 nt, Artificial Sequence
  derived and/or modified sequence opt3 from neuraminidase__InfluenzaA__AAK71688
augaaccccaaucagaagaucauuaccauaggcagcgugucccugacaaucgccacuaugugcuuccucaugcaaauugcuauccuugucacgaccguuacacugcacuuuaaacaguacgaguguaacucuccuccaaauaaccaggugauuuugugcgaaccgacuaucauagagagaaauaucaccgaaauuguauauuuaacaaacgcaaccaucgagaaggaaauuugucccaaacuggccgaguacaggaauuggucaaagccucagugcaaaaucacuggguucgcgccauuuaguaaggacaacagcauacggcuauccgcuggaggugauauuugggugacacgcgagcccuaugucucuugugacccugauaagugcuaccaauucgcccucggccaggggaccacgcugaauaaccgacauucgaaugacacugugcacgaucguaccccauauagaacacuucugaugaacgaauugggaguucccuuucaucucggcacuaaacagguguguaucgcauggucaagcaguuccugccacgacgguaaggccuggcugcaugucugugugaccgggcacgaugagaaugcuacagcaucuuucauuuacgacggaaggcugguagauagcaucggcuccuggaguaaaaagauccuccggacccaggaaucagagugcguuuguauuaacggcacgugcacuguggucaugacagacgggagcgccucuggacgcgcugauaccaaaauauuauuuaucgaggaagguaagauugugcacaucuccccucugcuuggcucagcccaacauguggaggaaugcagcuguuauccaagauacccgggggucaggugcguuugucgggacaauuggaagggaaguaaccgccccauaguggauauuaacguaaaagacuacucuaucguguccagcuaugucugcucgggcuuggugggugacacuccucgaaagaaugauagaucuuccucaaguaacugucugaauccaaacaaugaggaagggggacacggcguuaaaggcugggcguucgacgaugggaacgacguguggaugggaaggacaaucagcgaggagcuacgguccgguuacgaaaccuuuaaggucauugagggcuggucuaaacccaauagcaagcuccagaucaaccgucaggugauuguagaucgcggggacagaucaggauauaguggcauauucuccguugaagguaaaagcugcaucaauagguguuuuuacguggagcugauucgggggcgaaagcaggaaacggaggucugguggaccucuaacucaaucguggucuucugcggcacaaguggaacuuauggcaccgggagcuggccugauggagcagacaucaaucuuaugccaauuuga

SEQ ID NO: 136056 - RNA, 1410 nt, Artificial Sequence
  derived and/or modified sequence opt3 from neuraminidase__InfluenzaA__AAN01169
augaaccccaaucagaagaucauuaccauaggcagcgugucccugacaaucgccacuauuugcuuccucaugcaaaucgcuauucuugucacgaccguuacacugcacuuuaaacaguacgaguguaacucuuugccuaauaaccaggugauguuaugcgaaccaacuaucauagagagaaauaucaccgaaauuguauaucugacaaacaccacuaucgagaaggaaauuuguccgaaacuagcagaguacaggaauuggucaaagccccagugcaaaaucacaggguucgccccuuuuaguaaggacaacagcauacggcucuccgcgggaggugauauuugggugacccgcgagccauaugucucuugugaccccgauaagugcuaccaauucgcucugggccaggggacgacucuuaauaaccgacauucgaaugacaccgugcacgaucguacaccuuauagaacucuguugaugaacgaacucggaguuccauuucaucugggcaccaaacagguguguaucgccuggucaagcaguuccugccacgacgguaaggcauggcugcaugucugugugacagggcacgaugagaaugccaccgcuucuuucauuuacgacggaaggcucguagauagcaucggcuccuggaguaaaaagaucuuacggacgcaggaaucagagugcguuuguauuaacggcacuugcacaguggucaugaccgacgggagcgcaucuggacgcgccgauacuaaaauacuguuuaucgaggaagguaagauuauccacauaucccaacuuucaggcagcgcucagcauguggaggaaugcaguuguuaucccagauacccuggggugaggugcgucugucgggacaauuggaagggaucuaaccgcccaauuguugauaucaacgugaaagacuacuccaucguaagcucguaugugugcucuggcuuggucggugacacaccgcgaaagaaugauuccucaaguagcucccacugucugaaccccaauaacgaggaagggggacauggcgugaaaggcugggccuucgacgaugggaaugacguuuggaugggaagaaccauuucugagaaguuuaggagcgguuacgagacguucaaagugaucgaaggcuggucaaagccuaacaguaaacuacagauuaaucggcaggucauaguggaucgugacaaccgcuccggguauagcggaaucuuuucuguagagggcaagucaugcauuaauagauguuucuacguugaacucaucaggggucggaagcaagagaccgaagugugguggacaaguaacagcaucgucguguuuugcgggacuuccggcaccuauggaacaggcucuuggccagauggggcggacauuaaucugaugcccauauga

SEQ ID NO: 136057 - RNA, 1410 nt, Artificial Sequence; identical to SEQ ID NO: 136056
  derived and/or modified sequence opt3 from neuraminidase__InfluenzaA__AAN01170

SEQ ID NO: 136058 - RNA, 1410 nt, Artificial Sequence
  derived and/or modified sequence opt3 from neuraminidase__InfluenzaA__AAN01171
augaaccccaaucagaagaucauuaccauaggcagcgugucccugacaaucgccacuauuugcuuccucaugcaaaucgcuauucuugucacgaccguuacacugcacuuuaaacaguacgaguguaacucuuugccuaauaaccaggugauguuaugcgaaccaacuaucauagagagaaauaucaccgaaauuguauaucugacaaacaccacuaucgagaaggaaauuuguccgaaacuagcagaguacaggaauuggucaaagccccagugcaaaaucacaggguucgccccuuuuaguaaggacaacagcauacggcucuccgcgggaggugauauuugggugacccgcgagccauaugucucuugugaccccgauaagugcuaccaauucgcucugggccaggggacgacucuuaauaaccgacauucgaaugacaccgugcacggacguacaccuuauagaacucuguugaugaacgaacucggcguuccauuucaucuggguaccaaacagguguguaucgccuggucaagcaguuccugccacgaugggaaggcauggcugcaugucugugugacaggacacgacgagaaugccaccgcuucuuucauuuacgauggcaggcucguagacagcaucggcuccuggaguaaaaagaucuuacggacgcaggaaucagagugcguuuguauuaacgggacuugcacaguggucaugaccgauggaagcgcaucuggucgcgccgacacuaaaauacuguuuaucgaggaaggcaagauuauccacauaucccaacuuucagggagcgcucagcauguggaggaaugcaguuguuaucccagauacccuggagugaggugcgucugucgggauaauuggaagggcucuaaccgcccaauuguugacaucaacgugaaagauuacuccaucguaagcucguaugugugcucugguuuggucggggacacaccgcgaaagaaugacuccucaaguagcucccacugucugaaccccaauaacgaggaaggaggccauggcgugaaagggugggccuucgaugacggaaaugauguuuggauggguagaaccauuucugagaaguuuaggagcggcuacgagacguucaaagugaucgaaggguggucaaagccuaacaguaaacuacagauuaaucggcaggucauaguggaccgugauaaccgcuccggauauagcggcaucuuuucuguagaggguaagucaugcauuaauagauguuucuacguugaacucaucagggggcggaagcaagagaccgaagugugguggacaaguaacagcaucgucguguuuugcggcacuuccggaaccuauggcacagggucuuggccagacggagcggauauuaaucugaugcccauauga

SEQ ID NO: 136059 - RNA, 1410 nt, Artificial Sequence; identical to SEQ ID NO: 136056
  derived and/or modified sequence opt3 from neuraminidase__InfluenzaA__AAN01172

SEQ ID NO: 136060 - RNA, 1410 nt, Artificial Sequence
  derived and/or modified sequence opt3 from neuraminidase__InfluenzaA__AAN01173
augaaccccaaucagaagaucauuaccauaggcagcgugucccugacaaucgccacuauuugcuuccucaugcaaaucgcuauucuugucacgaccguuacacugcacuuuaaacaguacgaguguaacucuuugccuaauaaccaggugauguuaugcgaaccaacuaucauagagagaaauaucaccgaaauuguauaucugacaaacaccacuaucgagaaggaaauguguccgaaacuagcagaguacaggaauuggucaaagccccagugcaaaauuacaggguucgccccuuuuaguaaggacaacagcauccggcucuccgcgggaggugauauaugggugacccgcgagccauaugucucuugugaccccgauaagugcuaccaauucgcucugggccaggggacgacucuuaauaaccgacauucgaaugacaccgugcacgaucguacaccuuauagaacucuguugaugaacgaacucggaguuccauuucaucugggcaccaaacagguguguauugccuggucaagcaguuccugccacgacgguaaggcauggcugcaugucugugugacagggcacgaugagaaugccaccgcuucuuucaucuacgacggaaggcucguagauagcauuggcuccuggaguaaaaagaucuuacggacgcaggaaucagagugcguuuguaucaacggcacuugcacaguggucaugaccgacgggagcgcaucuggacgcgccgauacuaaaauucuguuuauagaggaagguaagaucauucacaucucccaacuuucaggcagcgcucagcauguggaggaaugcaguuguuaucccagauacccuggggugaggugcgucugucgggacaauuggaagggaucuaaccgcccaauaguugauauuaacgugaaagacuacuccaucguaagcucguaugugugcucuggcuuggucggugacacaccgcgaaagaaugauuccucaaguagcucccacugucugaaccccaauaacgaggaagggggacauggcgugaaaggcugggccuucgacgaugggaaugacguuuggaugggaagaaccaucucugagaaguuuaggagcgguuacgagacguucaaagugauugaaggcuggucaaagccuaacaguaaacuacagaucaaucggcaggucauuguggaucgugacaaccgcuccggguauagcggaauauuuucuguagagggcaagucaugcaucaauagauguuucuacguugaacucauuaggggucggaagcaagagaccgaagugugguggacaaguaacagcaucgucguguuuugcgggacuuccggcaccuauggaacaggcucuuggccagauggggcggacaucaaucugaugcccauuuga

SEQ ID NO: 136061 - RNA, 1410 nt, Artificial Sequence; identical to SEQ ID NO: 136056
  derived and/or modified sequence opt3 from neuraminidase__InfluenzaA__AAN01174

SEQ ID NO: 136062 - RNA, 1410 nt, Artificial Sequence; identical to SEQ ID NO: 136056
  derived and/or modified sequence opt3 from neuraminidase__InfluenzaA__AAN01175

SEQ ID NO: 136063 - RNA, 1410 nt, Artificial Sequence; identical to SEQ ID NO: 136056
  derived and/or modified sequence opt3 from neuraminidase__InfluenzaA__AAN01176

SEQ ID NO: 136064 - RNA, 1410 nt, Artificial Sequence; identical to SEQ ID NO: 136056
  derived and/or modified sequence opt3 from neuraminidase__InfluenzaA__AAN01177

SEQ ID NO: 136065 - RNA, 1410 nt, Artificial Sequence; identical to SEQ ID NO: 136056
  derived and/or modified sequence opt3 from neuraminidase__InfluenzaA__AAN01178

SEQ ID NO: 136066 - RNA, 1410 nt, Artificial Sequence; identical to SEQ ID NO: 136056
  derived and/or modified sequence opt3 from neuraminidase__InfluenzaA__AAN01179

SEQ ID NO: 136067 - RNA, 1410 nt, Artificial Sequence; identical to SEQ ID NO: 136056
  derived and/or modified sequence opt3 from neuraminidase__InfluenzaA__AAN01180

SEQ ID NO: 136068 - RNA, 1410 nt, Artificial Sequence
  derived and/or modified sequence opt3 from neuraminidase__InfluenzaA__AAN01181
augaaccccaaucagaagaucauuaccauaggcagcgugucccugacaaucgccacuauuugcuuccucaugcaaaucgcuauucuugucacgaccguuacacugcacuuuaaacaguacgaguguaacucuuugccuaauaaccaggugauguuaugcgaaccaacuaucauagagagaaauaucaccgaaauuguauaucugacaaacaccacuaucgagaaggaaauuuguccgaaacuagcagaguacaggaauuggucaaagccccagugcaaaaucacaggguucgccccuuuuaguaaggacaacagcauacggcucuccgcgggaggugauauuugggugacccgcgagccauaugucucuugugaccccgauaagugcuaccaauucgcucugggccaggggacgacucuuaauaaccgacauucgaaugacaccgugcacgaucguacaccuuauagaacucuguugaugaacgaacucggaguuccauuucaucugggcaccaaacagguguguaucgccuggucaagcaguuccugccacgacgguaaggcauggcugcaugucugugugacagggcacgaugagaaugccaccgcuucuuucauuuacgacggaaggcucguagauagcaucggcuccuggaguaaaaagaucuuacggacgcaggaaucagagugcguuuguauuaacggcacuugcacaguggucaugaccgacgggagcgcaucuggacgcgccgauacuaaaauacuguuuaucgaggaagguaagauuauccacauaucccaacuuucaggcagcgcucagcauguggaggaaugcaguuguuaucccagauacccuggggugaggugcgucugucgggacaauuggaagggaucuaaccgcccaauuguugauaucaacgugaaagacuacuccaucguaagcucguaugugugcucuggcuuggucggugacacaccgcgaaagaaugauuccucaaguagcucccacugucugaaccccaauaacgaggaagggggacauggcgugaaaggcugggccuucgacgaugggaaugacguuuggaugggaagaaccauuggugagaaguuuaggucuggcuacgagacguucaaagugaucgaaggguggagcaagccuaacucaaaacuacagauuaaucggcaggucauaguggaucgugacaaccgcaguggauauuccggcaucuuuagcguagaggguaagucuugcauuaauagauguuucuacguugaacucaucagggggcggaagcaagagaccgaagugugguggacaucaaacaguaucgucguguuuugcggcacuagcggaaccuauggcacaggguccuggccagauggagcggacauuaaucugaugcccauauga

SEQ ID NO: 136069 - RNA, 1410 nt, Artificial Sequence; identical to SEQ ID NO: 136056
  derived and/or modified sequence opt3 from neuraminidase__InfluenzaA__AAN01182

SEQ ID NO: 136070 - RNA, 1410 nt, Artificial Sequence; identical to SEQ ID NO: 136056
  derived and/or modified sequence opt3 from neuraminidase__InfluenzaA__AAN01183

SEQ ID NO: 136071 - RNA, 1410 nt, Artificial Sequence; identical to SEQ ID NO: 136056
  derived and/or modified sequence opt3 from neuraminidase__InfluenzaA__AAN01184

SEQ ID NO: 136072 - RNA, 1410 nt, Artificial Sequence; identical to SEQ ID NO: 136056
  derived and/or modified sequence opt3 from neuraminidase__InfluenzaA__AAN01185

SEQ ID NO: 136073 - RNA, 1410 nt, Artificial Sequence
  derived and/or modified sequence opt3 from neuraminidase__InfluenzaA__AAN01186
augaaccccaaucagaagaucauuaccauaggcagcgugucccugacaaucgccacuauuugcuuccucaugcaaaucgcuauucuugucacgaccguuacacugcacuuuaaacaguacgaguguaacucuuugccuaauaaccaggugauguuaugcgaaccaacuaucauagagagaaauaucaccgaaauuguauaucugacaaacaccacuaucgagaaggaaauuuguccgaaacuagcagaguacaggaauuggucaaagccccagugcaaaaucacaggguucgccccuuuuaguaaggacaacagcauacggcucuccgcgggaggugauauuugggugacccgcgagccauaugucucuugugaccccgauaagugcuaccaauucgcucugggccaggggacgacucuuaauaaccgacauucgaaugacaccgugcacgaucguacaccuuauagaacucuguugaugaacgaacucggaguuccauuucaucugggcaccaaacagguguguaucgccuggucaagcaguuccugccacgacgguaaggcauggcugcaugucugugugacagggcacgaugagaaugccaccgcuucuuucauuuacgacggaaggcucguagauagcaucggcuccuggaguaaaaagaucuuacggacgcaggaaucagagugcguuuguauuaacggcacuugcacaguggucaugaccgacgggagcgcaucuggacgcgccgauacuaaaauacuguuuaucgaggaagguaagauuauccacauaucccaacuuucaggcagcgcucagcauguggaggaaugcaguuguuaucccagauacccuggggugaggugcgucugucgggacaauuggaagggaucuaaccgcccaauuguugauaucaacgugaaagacuacuccaucguaagcucguaugugugcucuggcuuggucggugacacaccgcgaaagaaugauuccucaaguagcucccacugucugaaccccaauaacgaggaagggggacauggcgugaaaggcugggccuucgacgaugggaaugacguuuggaugggaagaaccauuucugagaaguuuaggcuagguuacgagacguucaaagugaucgaaggcuggagcaagucaaacaguaaacuccagauuaaucggcaggucauaguggaucgugacaaccgcuccggguauagcggaaucuuuucuguagagggcaagucaugcauuaauagauguuucuacguugaacugaucaggggucggaagcaagagaccgaagugugguggacaaguaacagcaucgucguguuuugcgggacuuccggcaccuauggaacaggcucuuggccugauggggcggacauuaaucuuaugccaauauga

SEQ ID NO: 136074 - RNA, 1410 nt, Artificial Sequence
  derived and/or modified sequence opt3 from neuraminidase__InfluenzaA__AAN01187
augaaccccaaucagaagaucauuaccauaggcagcgugucccugacaaucgccacuauuugcuuccucaugcaaaucgcuauucuugucacgaccguuacacugcacuuuaaacaguacgagugugacucuuugccuaacaaucaggugauguuaugcgaaccaacuaucauagagagaaacaucaccgaaauuguauaucugacaaauaccacuaucgagaaggaaauguguccgaaacuagcagaguacaggaacuggucaaagccccagugcaaaauuacaggguucgccccuuuuaguaaggauaauagcauccggcucuccgcgggaggugacauaugggugacccgcgagccauaugucucuugugaucccgacaagugcuaccaauucgcucugggccaggggacgacucuuaacaaucgacauucgaacgauaccgugcacgaccguacaccuuauagaacucuguugaugaaugaacucggaguuccauuucaucugggcaccaaacagguguguauugccuggucaagcaguuccugccacgaugguaaggcauggcugcaugucugugugacagggcacgacgagaacgccaccgcuucuuucaucuacgauggaaggcucguagacagcauuggcuccuggaguaaaaagaucuuacggacgcaggaaucagagugcguuuguaucaauggcacuugcacaguggucaugaccgaugggagcgcaucuggacgcgccgacacuaaaauucuguuuauagaggaagguaagaucauucacaucucccaaaugucaggcagcgcucagcauguggaggaaugcaguuguuaucccagauacccuggggugaggugcgucugucgggauaacuggaagggaucuaaucgcccaauaguugacauuaacgugaaagacuacuccaucguaagcucguaugugugcucuggccuugucggugauacaccgcgaaagaacgacuccucaaguagcucccacuguuugaaucccaacaaugaggaagggggacauggcgugaaaggcugggccuucgaugacgggaacgauguuuggaugggaagaaccaucucugagaaguuuaggagcgguuacgagacguucaaagugauugaaggcuggucaaagccuaauaguaaacugcagaucaaccggcaggucauuguggaccgugauaaucgcuccggguauagcggaauauuuucuguagagggcaagucaugcaucaacagauguuucuacguugaacuaauuaggggucggaagcaagagaccgaagugugguggacaaguaauagcaucgucguguuuugcgggacuuccggcaccuauggaacaggcucuuggccagacggggcggauaucaaccucaugcccauuuga

SEQ ID NO: 136075 - RNA, 1410 nt, Artificial Sequence; identical to SEQ ID NO: 136056
  derived and/or modified sequence opt3 from neuraminidase__InfluenzaA__AAN01188

SEQ ID NO: 136076 - RNA, 1410 nt, Artificial Sequence
  derived and/or modified sequence opt3 from neuraminidase__InfluenzaA__AAN64883
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacaucccugcuuucagggagcgcucaacacguggaggaaugcaguuguuauccucgguacccaggaguccgcugcguuuguagagacaacuggaagggcucuaauaggccgaucguggauauaaacguaaaagacuacuccauugugagcucguaugucugcucugguuuggugggggacacuccccggaagaaugauuccucaaguagcucccauugucuggacccuaacaaugaggaaggaggccacggcguuaaagggugggccuucgaugacggagaugacguguggaugggucgcacgaucucugagaagcuacgaagcggcuacgagaccuuuaaagucaucgaaggguggucaaagccaaacaguaaacuccagauuaauagacaggugaucguagauaggggaaaccgguccggcuauagcgguauuuucucuguugaggggaagucaugcauaaaucguuguuuuuacguggaacugauccgcggcagaaagcaggagacagaaguccuuuggaccaguaacagcauuguggucuucugcggaaccuccggcacauaugggacuggaucuuggcccgacggugcggauaucaaucugaugccuaucuga

SEQ ID NO: 136077 - RNA, 1410 nt, Artificial Sequence
  derived and/or modified sequence opt3 from neuraminidase__InfluenzaA__AAN64884
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacaucccugcuuucagggagcgcucaacacguggaggaaugcaguuguuauccucgguacccaggaguccgcugcguuuguagagacaacuggaagggcucuaauaggccgaucguggauauaaacguaaaagacuacuccauugugagcucguaugucugcucugguuuggugggggacacuccccggaagaaugauuccucaaguagcucccauugucuggacccuaacaaugaggaaggaggccacggcguuaaagggugggccuucgaugacggaaacgauguguggaugggucgcacgaucucugagaagcuacgaagcggcuacgagaccuuuaaagucaucgaaggguggucaaagccaaauaguaaacuccagauuaacagacaggugaucguagacaggggaaaucgguccggcuauagcgguauuuucucuguugaggggaagucaugcauaaaccguuguuuuuacguggaacugauccgcggcagaaagcaggagacagaaguccuuuggaccaguaauagcauuguggucuucugcggaaccuccggcacauaugggacuggaucuuggcccgauggugcggacaucaaccugaugccuaucuga

SEQ ID NO: 136078 - RNA, 1410 nt, Artificial Sequence; identical to SEQ ID NO: 136077
  derived and/or modified sequence opt3 from neuraminidase__InfluenzaA__AAN64885

SEQ ID NO: 136079 - RNA, 1410 nt, Artificial Sequence; identical to SEQ ID NO: 136077
  derived and/or modified sequence opt3 from neuraminidase__InfluenzaA__AAN64886

SEQ ID NO: 136080 - RNA, 1410 nt, Artificial Sequence; identical to SEQ ID NO: 136077
  derived and/or modified sequence opt3 from neuraminidase__InfluenzaA__AAN64887

SEQ ID NO: 136081 - RNA, 1410 nt, Artificial Sequence
  derived and/or modified sequence opt3 from neuraminidase__InfluenzaA__AAN64888
augaaccccaaucagaagaucauuaccauaggcagcgugucccugacaaucgccacuauuugcuuccucaugcaaaucgucauucuuguuacgaccgugacacugcacuuuaaacaguacgaguguaacucuccuccaaauaaccagguaauguugugcgaaccgacuaucauagagagaaauaucaccgaaauuguguauuuaacaaacaccacuaucgagaaggaaauuugucccaaacuggcugaguacaggaauuggucaaagccucagugcaacaucacaggguucgcaccauuuaguaaagacaauagcauacggcuauccgccggaggugauauuugggucacccgcgagcccuaugugucuugugacccugauaagugcuaccaauucgcgcucggccaggggacgacucugaacaauggacauucgaacgacaccguucacgaucgaacaccauaucguacucuucugaugaaugaauugggcgugcccuuucaucucgguaccaagcaggucuguaucgcuuggucaagcaguuccugccacgacgggaaagccuggcugcauguguguguaacaggagaugacaagaacgcaaccgccucuuucauuuacaauggcagacugguugauagcaucggcuccuggaguaaaaagauccucaggacgcaggagucagaaugcguguguauuaacgggacuugcacagucgugaugaccgacggaagcgcuucugguaaagcagauacuaagauauuauuuaucgaggagggcaagauugugcacacaucccugcuuucagggagcgcccaacacgucgaagagugcaguuguuauccucgguacccaggaguucgcugcguguguagagacaacuggaaaggcucuaauaggccgaucguagauauaaacgugaaggacuacuccauugucagcucguaugugugcucugguuugguuggggacacuccccggaaaaaugauuccucaaguagcucccauugucuggacccuaacaaugaagagggaggccacggcgugaaggggugggcuuucgaugacggaaacgaugucuggaugggucgcacgaucucugaaaaacuacgaagcggcuacgagaccuuuaaggugaucgagggguggucaaaaccaaauaguaagcuccagauuaacagacagguaaucguugacaggggaaaucgguccggcuauagcgguauuuucucuguggaagggaagucaugcauaaaccguuguuuuuacgucgagcugauccgcggcagaaaucaggaaacagaggugcuuuggaccaguaacagcauugucguguucugcggaaccuccggcacauaugggacuggaucuuggcccgauggugccgacaucaaucugaugccuaucuga

SEQ ID NO: 136082 - RNA, 1410 nt, Artificial Sequence; identical to SEQ ID NO: 136077
  derived and/or modified sequence opt3 from neuraminidase__InfluenzaA__AAN64889

SEQ ID NO: 136083 - RNA, 1410 nt, Artificial Sequence
  derived and/or modified sequence opt3 from neuraminidase__InfluenzaA__AAN64890
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggaaauguugugcgagccgacuaucauagaaagaaauaucaccgagauuguguauuuaacaaacaccacuaucgaaaaggagauuugucccaaacuggcagaguacaggaauuggucaaagccucagugcaacaucacaggguucgccccauuuaguaaagacaauagcauacggcuauccgcgggaggugauauuuggguaacccgcgaacccuaugugucuugugacccugauaagugcuaccaauucgcucucggccaggggacgacucugaacaauggacauucgaacgacaccguccacgaucgaacaccauaucguacucuucugaugaaugaguugggcgugcccuuucaucucgguaccaagcagguuuguaucgccuggucaagcaguuccugccacgacgggaaagcauggcugcaugugugugucacaggagaugacgaaaacgccaccgcuucuuucauuuacaauggcagacugguggauagcaucggcuccuggucaaagaaaauccucaggacgcaggagagugagugcguauguauuaacgggacuugcacaguugugaugaccgacggaagcgcaucugguaaggccgauacuaaaauauuauuuaucgaagagggcaagauuguccacacaucccugcuuucagggagcgcucaacacguggaagagugcaguuguuauccucgguacccaggagugcgcugcgucuguagagacaacuggaagggcucuaauaggccgaucguugauauaaacgugaaagacuacuccauuguaagcucguaugugugcucugguuuggucggggacacuccccggaagaaugauuccucaaguagcucccauugucuggacccuaacaaugaagagggaggccacggcgugaaagggugggccuucgaugacggaaacgauguuuggaugggucgcacgaucucugagaagcuacgaagcggcuacgaaaccuuuaaagugaucgagggguggucaaagccaaauaguaaacuccagauuaacagacaggucaucguggacaggggaaaucgguccggcuauagcgguauuuucucuguagaagggaagucaugcauaaaccguuguuuuuacguugagcugauccgcggcagaaagcaggaaacagaggugcuuuggaccaguaauagcauugucguguucugcggaaccuccggcacauaugggacuggaucuuggcccgauggugcggacaucaaccugaugccuaucuga

SEQ ID NO: 136084 - RNA, 1410 nt, Artificial Sequence; identical to SEQ ID NO: 136077
  derived and/or modified sequence opt3 from neuraminidase__InfluenzaA__AAN64891

SEQ ID NO: 136085 - RNA, 1410 nt, Artificial Sequence
  derived and/or modified sequence opt3 from neuraminidase__InfluenzaA__AAO46212
augaaccccaaucagaagaucauuaccauaggcagcgugucccugacaaucgagacugucugcuuccucaugcaaauugccauccuugcuacgaccguuacacugcacuuuaaacagcaugaaugugacucuccugcaucaaaccaggugaugccaugcgagccgauuaucauagaaagaaauaucacugagauuguauacuugaacaauaccacaaucgaaaaggagauuugucccgagguggucgaauauaggaacuggaguaaaccucagugccaaaucaccggguucgccccauuuagcaaggauaauuccauacgguuaucugcgggaggugacauuugggugacucgcgagcccuacguuucgugugauacaggcaaaugcuaucaguucgcucuggggcagggaaccacgcuagacaacaagcacucaaauggcacuauccaugaucguauuccucaccgaacccuccugaugaacgaacuuggugugccauuucaucuggggacaaagcaggucuguguggccuggagcaguuccucuugccacgacggaaaagcaugguugcacguauguguuacuggcgaugacagaaaugccaccgcuagcuucaucuacgauggcaggcucguggacuccaucgggucauggagucaaaacauucugcggacacaggagagcgagugcgucuguauaaauggaaccugcacgguggugaugacugaugguucugcauccggccgcgccgacacaagaauccuguuuauuaaggaagggaaaaucguccauauaucaccccucagcggaagugcucagcacauugaggaaugcucuuguuauccuagguacccagauguucggugcaucugucgcgacaacuggaagggcuccaaucgaccggugaucgacauuaacauggaggauuauagcaucgacucgucuuacguaugcuccgguuuagugggggauacccccagaaacgacgauucaaguagcaauuccaacuguagggacccuaauaacgaacggggaaauccaggcgucaaaggcugggccuucgauaacggggacgauguguggaugggacguacuauuucuaaggaccugcgcagcgguuacgagacauuuaagguuauaggcggguggucaacccccaauaguaaaucccaggugaacagacaagucaucguggauaauaacaauuggagcggauauucuggcauuuucucaguagaggguaagaguugcaucaacagguguuuuuacguugaacuuauccgggggcgaccucaggagacgcgcgugugguggaccagcaauuccauugucguguucugcggcacaucuggaacuuauggcaccgggucguggccagacggagcgaacauaaauuuuaugcccaucuga

SEQ ID NO: 136086 - RNA, 1410 nt, Artificial Sequence
  derived and/or modified sequence opt3 from neuraminidase__InfluenzaA__AAO46213
augaaccccaaucagaagaucauuaccauagacagcgugucccugacaaucgccacugucugcuuccucaugcaaauugcuauccuugcaacgaccguuacacugcacuuuaaacagcaugagugugauucuccugccucaaaccaggugaugccaugcgaaccgauuaucauagagagaaauaucacugaaauuguauacuugaacaauaccacaaucgagaaggaaauuugucccgagguggucgaguauaggaacuggaguaaaccucagugccaaaucaccggcuucgcgccauuuagcaaggacaauuccauacgguuaucugcugggggagauauuugggugacucgcgaacccuacguuucgugugacacagguaaaugcuaucaguucgcccugggccaggggaccacgcuagauaacaagcacucaaauggaacuauccaugaccguauuccucaccgaacccuccugaugaacgagcuuggcgugccauuucaucuggguacaaagcaggucuguguggcauggagcaguuccucuugccacgaugggaaagccugguugcacguauguguuacuggagacgauagaaaugcuaccgccagcuucaucuacgacggcaggcucguggauuccaucggcucauggagucaaaacauucugcggacacaggaaagcgagugcgucuguauaaaugggaccugcacgguggugaugacugacggaucugcauccggucgcgcugauacaagaauccuguuuauuaaggagggcaaaaucguccauauaucaccccucagcgggagugcccagcacauugaagagugcucuuguuauccuagguacccagacguucggugcaucugucgcgacaacuggaagggauccaaucgaccggugaucgauauuaacauggaagacuauagcaucgauucgucuuacguaugcuccggcuuagugggugacacccccagaaacgaugacucaaguagcaauuccaacuguagggauccuaauaacgagcgggggaauccaggagucaaaggcugggcguucgacaacggcgaugacguguggauggggcguacuauuucuaaggaucugcgcagcggauacgaaacauuuaagguuauagguggcuggucaacccccaauaguaaaucccaggugaacagacaagucaucguggacaauaacaauuggagcggguauucuggaauuuucucaguagagggcaagaguugcaucaacagguguuuuuacguugagcuuauccggggucgaccucaggaaacgcgcgugugguggaccagcaauuccauugucguguucugcgggacaucuggcacuuauggaaccggcucguggccagacggggcaaacauaaauuuuaugcccaucuga

SEQ ID NO: 136087 - RNA, 1410 nt, Artificial Sequence
  derived and/or modified sequence opt3 from neuraminidase__InfluenzaA__AAO46214
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgaggcgguggaguauaggaacuggaguaaaccucagugccaaaucaccggguucgcuccauuuagcaaggauaauuccauacgguuaucugccggaggugacauuugggucacucgcgaacccuacgugucgugugauccuggcaaaugcuaucaguucgcacuggggcagggaacaacccuagacaacaagcacucaaauggcacgauccaugaucgaaucccacaccguacucuccugaugaacgagcuugguguucccuuucaucuggggaccaaacaggugugugucgccuggagcaguuccucuugccacgacggaaaggcuugguugcacguguguguaacaggcgaugacagaaaugcaacugccagcuucauuuacgauggcaggcucguugacuccaucgggucauggagucaaaacauucugcggacccaggaaagcgagugcguguguauaaauggaaucugcacagucgugaugaccgaugguucugcuuccggccgcgccgacacgaggauucuguuuaucgaggaagggaagauagugcauauuucaccucucagcggaagugcgcagcacgucgaggaaugcucuuguuauccaagauacccggauguucggugcaucugucgcgacaacuggaaaggcuccaaucgacccgugaucgacauuaacauggaggauuauagcaucgacucgucuuacguaugcuccgguuuagugggggauacuccuagaaacgacgauaggucaaguaauagcaacugucgggacccaaauaacgaacguggaaaucccggcgucaagggcugggcauucgauaacggggacgauguguggaugggacgcacaauuuccaaagaccugagaucugguuacgagaccuuuaagguuauaggcggguggagcacuccuaauucaaagagucaggugaacaggcaagucaucguggauaauaacaauugguccggauauagcggcauuuucucuguagaggguaaaucaugcaucaaccgguguuuuuacguugaacuuauccgagggcgccagcaggagacaagagugugguggaccaguaauagcauugucguguucugcggcacguccggaaccuauggcacagggucuuggccagacggagccaacauaaauuuuaugcccaucuga

SEQ ID NO: 136088 - RNA, 1410 nt, Artificial Sequence
  derived and/or modified sequence opt3 from neuraminidase__InfluenzaA__AAO46215
augaaccccaaucagaagaucauuaccauaggcagcgugucccugacaaucgccacugucugcuuccucaugcaaauugcuauccuugcaacgaccguuacacugcacuuuaaacagcaugagugugacucuccuacuucaaaccaggugaugccaugcgaaccgauuaucauagagagaaauaucaccgaaauuguauacuugaacaauacaaccaucgagaaggaaauuugucccgagguggucgaguauaggaacuggaguaaaccucagugccaaaucacuggguucgccccauuuagcaaggauaauuccauacgguuaucugcgggaggugacauuugggugacacgcgaacccuacguuucgugugauccuggcaaaugcuaucaguucgcucuggggcagggaaccacgcuagacaacaagcacucaaauggcacuauccaugaucguauuccacaccgaacccuccugaugaacgagcuuggugugcccuuucaucuggggacaaagcaggucuguguggccuggagcaguuccucuugccacgacggaaaagcaugguugcacguauguguuacuggcgaugacagaaaugccaccgcuagcuucaucuacgauggcaggcucguggacuccaucgggucauggagucaaaacauucugcggacacaggaaagcgagugcgucuguauaaauggaaccugcacgguggugaugacugaugguucugcauccggccgcgccgacacaagaauccuguuuauuaaggaggggaaaaucguccauauaucaccucucagcggaagugcucagcacauugaagagugcucuuguuauccaagguacccggauguucggugcaucugucgcgacaacuggaagggcuccaaucgacccgugaucgacauuaacauggaagauuauagcaucgacucgucuuacguaugcuccgguuuagugggggauaccccuagaaacggagacucaaguagcaauuccaacuguagggauccaaauaacgagcggggcaaucccggcgucaaagggugggccuucgacaacggagaugacguguggaugggucguacuauuucuaaggaaagccgcucaggcuacgagacauuuaagguuauagggggauggaguaccccuaauuccaaaagccaggugaacagacaagucaucguggauaauaacaauuggucuggcuauucagguauuuucaguguagagggcaagagcugcaucaacagguguuuuuacguugaacugauccgggggcgaccacaggagacgcgcgugugguggaccuccaauucuauugucguguucugcggaacaucgggcacuuaugggaccggaagcuggcccgacggugcgaacauaaauuuuaugccgaucuga

SEQ ID NO: 136089 - RNA, 1410 nt, Artificial Sequence
  derived and/or modified sequence opt3 from neuraminidase__InfluenzaA__AAO46216
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgagguggucgaguauaggaacuggaguaaaccucagugccaaaucaccggguucgcgccauuuagcaaggauaauuccauacgguuaucugcuggaggugacauuugggugacucgcgaacccuacguuucgugugauccuucaaaaugcuaucaguucgcccugggccaggggacaacccuagagaacaagcacagcaauggaacgaagcaugaccgaaucccacaccguacucuccugaugaacgaacuuggcgugcccuuucaucuggguaccaaacaggucuguguggcauggaguuccucuagcugccacgaugggaaggccugguugcacguauguguuacaggagacgauagaaaugcuacugcauccuucauuuacgagggcaggcucguggacucaaucgucaguuggagccaaaacauccugcggacccaggagucugaaugcguguguauuaauggcacaugcaccguggucaugacggauggguccgccucaggacgcgcugacacuagaauacuguuuaucaaagaggguaagauuguucauaucagcccucucaguggcucugcccagcacauagaagagugcuccuguuauccaagguacccggaugugcggugcauuugucgcgacaacuggaaagggagcaaucgacccguaaucgauaucaacauggaagacuauucgauugacucuuccuacgugugcucaggauuagucggcgauacaccuagaaacgacgauaguagcuccaauucuaacuguagggacccaaauaacgagcgggguaaucccggggugaagggaugggcguucgauaacggcgacgauguuuggaugggccguaccaucagcaaggacucacgcaguggguacgagacuuuuaaagugauuggagguugguccacaccuaauagcaagucucaggucaacagacaagugauaguagauucaaauaacuggaguggcuauagcgggaucuucuccguugaaggaaaaucuugcauuaauagguguuuuuacguggagcugauccggggccgaccacaggaaacccgcgucugguggacgucgaacagcaucguggucuucugcgguaccuccgggacauauggcacuggaucauggcccgacggcgcaaauauuaacuuuaugccgauauga

SEQ ID NO: 136090 - RNA, 1410 nt, Artificial Sequence
  derived and/or modified sequence opt3 from neuraminidase__InfluenzaA__AAO46217
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgagguggucgaguauaggaacuggaguaaaccucagugccaaaucaccggguucgcgccauuuagcaaggauaauuccauacgguuaucugcuggaggugacauuugggugacucgcgaacccuacguuucgugugauccuucaaaaugcuaucaguucgcccugggccaggggacaacccuagacaacaagcacagcaauggaacgauccaugaucguauuccacaccgaacucuccugaugaacgagcuuggcgugcccuuucaucuggguaccaagcaggucuguguggcauggaguuccucuagcugccacgacgggaaagccugguugcacguauguguuacaggagaugacagaaaugcuacugcauccuucaucuacgauggcaggcucgaagacucaaucggcaguuggagccaaaacauucugcggacccaggagucugagugcguguguauaaaugggacaugcaccgucgugaugacggauggauccgccucaggucgcgcugacacuagaauccuguuuauuaaggaaggcaaaaucgugcauauaagcccucucagugggucugcccagcacauugaggaaugcuccuguuauccaagguacccggauguccggugcaucugucgcgacaacuggaagggaagcaaucgacccguuuuagacaucucgauggaggauuauucuauugacuccucauacgugugcaguggccugguaggugauacaccuagaaacgacgauagcuccucuaacagcaauuguagggacccaaacaaugaacgggggaaccccggagugaaaggcugggcguucgauaauggcgacgaugucuggauggggcguaccaucucaaaggaccuucgcaguggauacgagacuuuuaaggugauugguggcugguccacaccuaacagcaaaucucagguuaauagacaagugauagucgauaacaauaacuggucaggguauaguggaaucuucagcguggagggcaaguccugcauuaauagguguuuuuacguagaauugauccggggucgaucucaggagacccgcguuugguggacgucgaacagcaucguggucuucugcgggaccuccggcacauauggaacuggcucauggccagacggggcaaauauuaacuuuaugcccauauga

SEQ ID NO: 136091 - RNA, 1410 nt, Artificial Sequence
  derived and/or modified sequence opt3 from neuraminidase__InfluenzaA__AAO46218
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgagguggucgaguauaggaacuggaguaaaccucagugccaaaucaccggguucgcgccauuuagcaaggauaauuccauacgguuaucugcuggaggugacauuugggugacucgcgaacccuacguuucgugugauccuggcaaaugcuaucaguucgcccuggggcagggaacaacccuagacaacaagcacucaaauggcacgauccaugaucguauuccacaccgaacucuccugaugaacgagcuuggugugcccuuucaucuggggaccaagcaggucuguguggcauggagcaguuccucuugccacgacggaaaagccugguugcacguauguguuacaggcgaugacagaaaugcuacugccagcuucaucuacgauggcaggcucgaagacuccaucgggucauggagucaaaacauucugcggacccaggagagcgagugcguguguauaaauggaacaugcaccgucgugaugacggaugguucugcauccggccgcgcugacacuagaauccuguuuauuaaggaagggaaaaucgugcauauaucaccucucagcggaagugcccagcacauugaggaaugcucuuguuauccaagguacccggauguccggugcaucugucgcgacaacuggaagggcuccaaucgacccguuuuagacaucagcauggaggauuauucgauugguucuuccuacgugugcucagggcugguaggagacacaccuagaaacgaugacaguagcuccaacucuaauuguagggauccaaacaaugaacggggcaaccccggcgugaaagggugggcguucgacaauggagaugacgucuggaugggucguaccaucagcaaggaucuucgcucaggcuacgagacuuuuaaggugauugggggauggaguacaccuaacuccaaaagccagguuaauagacaagugauagucgacaacaauaacuggucuggcuauucagguaucuucaguguggagggcaagagcugcauuaauagguguuuuuacguagaauugauccgggggcgaucccaggagacccgcguuugguggacgucuaacucgaucguggucuucugcggaaccagcggcacauaugggacuggauccuggccagauggugcaaauauuaacuuuaugcccauauga

SEQ ID NO: 136092 - RNA, 1410 nt, Artificial Sequence
  derived and/or modified sequence opt3 from neuraminidase__InfluenzaA__AAO46220
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgaggcgguggaguauaggaacuggaguaaaccucagugccaaaucaccggguucgcuccauuuagcaaggauaauuccauacgguuaucugccggaggugacauuugggucacucgcgaacccuacgugucgugugauccuggcaaaugcuaucaguucgcacuggggcagggaacaacccuagacaacaagcacucaaaugauacgauccaugaccguauuccacaccgaacucuccugaugaacgagcuuggcguucccuuucaucuggguaccagacaggugugugucgccuggagcaguuccucuugccacgaugggaaggcuugguugcacguguguguaacaggagacgauaggaaugcaacugccagcuucaucuacgacggccggcucguugauuccaucggcucauggagucaaaacauucugcgcacccaggaaagcgagugcguguguauaaaugggaucugcacagucgugaugaccgacggaucugcuuccgguagagccgauacgaggauucuguuuaucgaggaaggcaaaauagugcauauuucaccucucagcgggagugcgcagcacgucgaggaaugcucuuguuauccacgguacccggacguucgcugcaucugucgagacaacuggaagggauccaauagacccgugaucgauauuaacauggaggacuauagcaucgauucgucuuacguaugcuccggcuuagugggugacacuccuaggaacgaugaccggucaaguaauagcaacugucgugauccaaauaacgaacgcgggaaucccggagucaaaggcugggcauucgacaacggcgaugacguguggauggggagaacaauuuccaaggaucugaggucuggauacgagaccuuuaaaguuauagguggcuggagcacuccuaauucaaagagucaggugaaccggcaagucaucguggacaauaacaauugguccggguauagcggaauuuucucuguagagggcaagucaugcaucaaccgauguuuuuacguugaacuuauccgcgguagacagcaggagacaagggugugguggaccaguaauagcauugucguguucugcgggacguccggcaccuauggaacaggcucuuggccagacggggccaacauaaauuuuaugcccaucuga

SEQ ID NO: 136093 - RNA, 1410 nt, Artificial Sequence
  derived and/or modified sequence opt3 from neuraminidase__InfluenzaA__AAO46221
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgaggcggcugaguauaggaacuggaguaaaccucagugccaaaucaccggguucgccccauuuagcaaggauaauuccauacgguuaucugcaggaggugacauuugggugacucgcgaacccuacgucucgugugauccuggcaaaugcuaucaguucgcccuggggcagggaacaacccuagacaacaagcacucaaaugauacgauccaugaccguauuccacaccgaacucuccugaugaacgagcuuggcgugcccuuucaucuggguaccagacagguuuguguggcuuggagcaguuccucuugccacgaugggaaggcaugguugcacgucugugugacaggagacgauaggaaugccacugcuagcuucaucuacgacggccggcucguagauuccaucggcucauggagucaaaacauucugcgcacccaggaaagcgagugcguuuguauaaaugggaucugcacaguggucaugaccgacggaucugccuccgguagagcggauacgaggauucuguuuaucgaggaaggcaaaauagugcauauuucaccucucagcgggagugcacagcacguggaggaaugcucuuguuauccacgguacccggacguccgcugcaucugucgagacaacuggaagggauccaauagacccguuaucgauauuaacauggaggacuauagcaucgauucgucuuacgugugcuccggcuuaguaggugacacuccuaggaacgaugaccggucaaguaauagcaacugucgugauccaaauaacgaacgcgggaaucccggagugaaaggcugggccuucgacaacggcgaugacgucuggauggggagaacaauuuccaaggaucugaggucuggauacgagaccuuuaaagugauagguggcuggagcacuccuaauucaaagagucagguuaaccggcaagugaucgucgacaauaacaauugguccggguauagcggaauuuucucuguggagggcaagucaugcaucaaccgauguuuuuacguagaacuuauccgcgguagacagcaggagacaaggguuugguggaccaguaauagcauuguggucuucugcgggacguccggcaccuauggaacaggcucuuggccagacggggcuaacauaaauuuuaugcccaucuga

SEQ ID NO: 136094 - RNA, 1410 nt, Artificial Sequence
  derived and/or modified sequence opt3 from neuraminidase__InfluenzaA__AAO46223
augaaccccaaucagaagaucauuaccauaggcagcgugucccugacaaucgccacugucugcuuccucaugcaaauugcuauccuuguuacgaccgugacacugcacuuuaaacagcaugagugugacucuccugcaucaaaccagguaaugccaugcgaaccgauuaucauagagagaaauaucacugaaauuguguacuugaacaauaccacaaucgagaaggaaauuugucccgaggucguggaguauaggaacuggaguaaaccucagugccaaaucaccggguucgccccauuuagcaaggauaauuccauacgguuaucugcgggaggugacauuuggguuacucgcgaacccuacgugucgugugauccuggcaaaugcuaucaguucgcucuggggcagggaacaacccuagacaacaagcacucaaaugauacgauccaugaccguauuccacaccgaacucuccugaugaacgagcuuggcguccccuuucaucuggguaccagacagguguguguagccuggagcaguuccucuugccacgaugggaaggcaugguugcacguuugugugacaggagacgauaaaaaugccacugcuagcuucaucuacgacggcaggcucgucgauuccaucggcucauggagucaaaacauucugcggacccaggaaagcgagugcguguguauaaaugggacaugcaccguggucaugacggacggaucugcauccggucgcgccgauacuagaauccuguuuauugaggaaggcaagaucguucauauaucaccucucagcgggagugcucagcacguggaggaaugcucuuguuauccaagguacccggacguacggugcauuugucgcgacaacuggaaaggauccaaucgacccgugaucgauaucaacauggaggacuauagcauugauucgucuuacgucugcuccggcuuagugggugacacaccuagaaacgaugacaggucaaguaauagcaacugucgggauccaaauaacgaacgugggaaucccggaguuaagggcugggccuucgacaacggcgaugacguguggauggggcgcaccaucuccaaagaucugagaucuggauacgagacuuuuaaggucauugguggcuggagcacaccuaauucaaagagucagauaaacaggcaagugaucguagacuccaauaacuggagcggguauucuggaauuuucucaguugagggcaaaaguugcaucaaucgguguuuuuacguggaacuuauccgaggucgcaagcaggagaccagagucugguggacgagcaacuccauuguggucuucugcgggaccucuggcacauauggaacuggcucguggccagacggggcgaauauaaacuuuaugcccaucuga

SEQ ID NO: 136095 - RNA, 1410 nt, Artificial Sequence; identical to SEQ ID NO: 136094
  derived and/or modified sequence opt3 from neuraminidase__InfluenzaA__AAO46224

SEQ ID NO: 136096 - RNA, 1410 nt, Artificial Sequence
  derived and/or modified sequence opt3 from neuraminidase__InfluenzaA__AAO46225
augaaccccaaucagaagaucauuaccauaggcuucgugagccugaucauugccacagucugcuuucucaugcaaaucgcuauucuugcaacuacgguuacccugcacuucaaacagcaugagugugacuccccugccucuaaccaggugaugccaugcgaaccgaucauaaucgagagaaauauuacaaagaucguauacuugaacaauacuaccauugaaaaagagaucugucccgaaguggucgaguauaggaacuggucaaagccucagugccacauaacaggguuugcgccauucaguaaagauaauagcauucgguuauccgcuggaggugacaucugggugacccgcgagcccuacguuucuugugauccuggcaagugcuaucaauuugcccuggggcagggaacuacacuagacaacaagcauucgaaugauaccauucacgaccgaaucccacaucguacgcuccugaugaacgaacuuggcgugcccuuccaccuggguacuagacaggucuguguggcauggucaagcaguuccugccacgaugggaaagccugguugcauguauguguuaccggagacgauaagaaugcuacagcaucuuuuaucuacgacggcaggcucguggauagcauuggcuccuggucacacaacauacugcggacucaggagagugaaugcgucuguaucaaugggaccugcacaguggugaugaccgacggaagcgccucuggucgcgcugauacgaggauucuguucaucaaagagggcaagauaguccauauuuccccucucucagggagcgcccaacacguugaggaaugcaguuguuauccaagauacccggacgugcggugcaucugucgcgacaacuggaaaggaucuaaucgacccguaaucgauauuaacauggaggacuauuccaucgauagcucguacgugugcucuggcuuagucggugacacuccuagaaacaaugauggguccucaaacaguaauuguagggacccaaacaaugaacggggaaaccccggcgugaagggcugggcguuugauaauggggacgauguuuggaugggacguacaauuagcaaggaccugcgcuccgguuacgagaccuucaaagugauaggcggguggucuacuccuaacagcaagucacaggucaauagacaggugaucguagauaacaauaacuggaguggauauuccggcauuuuuagcguugaagguaaaucuugcaucaauagguguuucuacguggagcuuauccgggggcgacagcaagagacacgcgucugguggaccucaaacaguauuguggucuuuugcggcacgagcggaaccuauggcacaggguccuggccagacggagcaaauauaaacuucaugcccaucuga

SEQ ID NO: 136097 - RNA, 1410 nt, Artificial Sequence
  derived and/or modified sequence opt3 from neuraminidase__InfluenzaA__AAO46226
augaaccccaaucagaagaucauuaccauaggcagcgugucccugacaaucgccacugucugcuuccucaugcaaauugcuauccuuguuacgaccgugacacugcacuuuaaacagcaugagugugacucuccugcaucaaaccagguaaugccaugcgaaccgauuaucauagagagaaauaucacugaaauuguguacuugaacaauaccacaaucgagaaggaaauuugucccgaggucguggaguauaggaacuggaguaaaccucagugccaaaucaccggguucgccccauuuagcaaggauaauuccauacgguuaucugcgggaggugacauuuggguuacucgcgaacccuacgugucgugugauccuggcaaaugcuaucaguucgcucuggggcagggaacaacccuagacaacaagcacucaaaugauacgauccaugaccguauuccacaccgaacucuccugaugaacgagcuuggcguccccuuucaucuggguaccagacagguguguguagccuggagcaguuccucuugccacgaugggaaggcaugguugcacguuugugugacaggagacgaugaaaaugccacugcuagcuucaucuacgacggcaggcucgucgauuccaucggcucauggagucaaaacauucugcggacccaggagagcgagugcguguguauaaaugggacaugcaccguggucaugacggacggaucugcauccggucgcgccgauacuagaauccuguuuauugaagagggcaaaaucguucauauaucaccucucagcgggagugcucagcacguggaagagugcucuuguuauccaagguacccggacguacggugcauuugucgcgacaacuggaagggauccaaucgacccgugaucgauaucaacauggaagacuauagcauugauucgucuuacgucugcuccggcuuagugggugacacaccuagaaacgaugacaggucaaguaauagcaacugucgggauccaaauaacgagcgugggaaucccggaguuaaaggcugggccuucgacaacggcgaugacguguggauggggcgcaccaucuccaaggaucugagaucuggauacgagacuuuuaaagucauugguggcuggagcacaccuaauucaaagagucagauaaacaggcaagugaucguagacuccaauaacuggagcggguauucuggaauuuucucaguugaaggcaagaguugcaucaaucgguguuuuuacguggagcuuauccgaggucgccagcaggaaaccagagucugguggacgagcaacuccauuguggucuucugcgggaccucuggcacauauggaacuggcucguggccagacggggcgaauauaaacuuuaugcccaucuga

SEQ ID NO: 136098 - RNA, 1410 nt, Artificial Sequence
  derived and/or modified sequence opt3 from neuraminidase__InfluenzaA__AAO46229
augaaccccaaucagaagaucauuaccauaggcagcgugucccugacaaucgccacugucugcuuccucaugcaaauugcuauccuuguuacgaccgugacacugcacuuuaaacagcaugagugugacucuccugcaucaaaccagguaaugccaugcgaaccgauuaucauagagagaaauaucacugaaauuauguacuugaacaauaccacaaucgagaaggaaauuugucccgagguggucgaguauaggaacuggaguaaaccucagugccaaaucaccggguucgccccauuuagcaaggauaauuccauacgguuaucugcgggaggugacauuugggugacucgcgaacccuacguuucgugugauccuggcaaaugcuaucaguucgcucuggggcagggaacaacccuagacaacaagcacucaaaugauacgauccaugaccguauuccacaccgaacucuccugaugaacgagcuuggcgugcccuuucaucuggguaccagacaggucuguguggccuggagcaguuccucuugccacgaugggaaggcaugguugcacguauguguuacaggagacgauaaaaaugccacugcuagcuucaucuacgacggcaggcucguggauuccaucggcucauggagucaaaacauucugcggacccaggaaagcgagugcgucuguauaaaugggacaugcaccguggugaugacggacggaucugcauccggucgcgccgauacuagaauccuguuuauugaggaaggcaagaucguccauauaucaccucucagcgggagugcucagcacguugaggaaugcucuuguuauccaagguacccggacgugcggugcauuugucgcgacaacuggaaaggauccaaucgacccaucaucgauauuaacauggaggacuauagcaucgauucgucuuacguaugcuccggcuuagugggugacacaccuagaaacgaugacaggucaaguaauagcaacugucggaauccaaacaaugaacgugggaaccccggagucaagggcugggccuucgauaauggcgacgauguguggauggggcgcaccauuuccaaagaccugagaucuggauacgagacuuuuaagguuauagguggcuggagcacaccuaacucaaagagucagaucaauaggcaagugauugucgauuccaacaauuggagcggguauucuggaaucuucucaguggagggcaaaaguugcaucaaccgguguuuuuacguagaacuuauucgaggucgccagcaggagaccagaguuugguggacgagcaauuccauaguggucuucugcgggaccucuggcacauauggaacuggcucguggccagacggggcgaacaucaauuuuaugcccauuuga

SEQ ID NO: 136099 - RNA, 1410 nt, Artificial Sequence
  derived and/or modified sequence opt3 from neuraminidase__InfluenzaA__AAO46230
augaaccccaaucagaagaucauuaccauaggcagcgugucccugacaaucgccacugucugcuuccucaugcaaauugcuauccuuguuacgaccgugacacugcacuuuaaacagcaugagugugacucuccugcaucaaaccagguaaugccaugcgaaccgauuaucauagagagaaauuugacugaaaucguguacuuaaacaauaccacaauugagaaggaaaucugucccgaggucguggaguauaggaacuggaguaaaccucagugccaaauuaccggguucgccccauuuagcaaggauaauuccauccggcugucugcgggaggugacauauggguuacucgcgaacccuacgugucgugugauccuggcaaaugcuaucaguucgcucuagggcagggaacaacccucgacaacaagcacucaaaugauacgauucaugaccgaaucccacaccguacucugcuuaugaacgagcugggcguccccuuucauuuggguaccagacagguguguguagccuggagcaguuccucuugccacgaugggaaggcauggcuccacguuugugugacaggagacgauaaaaaugccacugcuagcuucauuuacgacggcaggcuggucgauuccaucggcucauggagucaaaacauccugcggacccaggaaagcgagugcguguguauuaaugggacaugcaccguggucaugacggacggaucugcauccggucgcgccgauacuagaauacucuuuaucgaggaaggcaagauuguucauaucucaccuuuaagcgggagugcucagcacguggaggaaugcucuuguuauccaagguacccggacguacggugcauaugucgcgacaacuggaaaggauccaaucgacccgugauugauaucaacauggaggacuauagcaucgauucgucuuacgucugcuccggccuggugggugacacaccuagaaacgaugacaggucaaguaauagcaacugucgggauccaaauaacgaacgugggaaucccggaguuaagggcugggccuucgacaacggcgaugacguguggauggggcgcaccauuuccaaagaucuuagaucuggauacgagacuuuuaaggucaucgguggcuggagcacaccuaauucaaagagucagauuaacaggcaagugauaguagacuccaauaacuggagcggguauucuggaaucuucucaguugagggcaaaaguugcauuaaucgguguuuuuacguggaauugauccgaggucgccagcaggagaccagagucugguggacgagcaacuccaucguggucuucugcgggaccucuggcacauauggaacuggcucguggccagacggggcgaauauuaacuuuaugcccauauga

SEQ ID NO: 136100 - RNA, 1410 nt, Artificial Sequence
  derived and/or modified sequence opt3 from neuraminidase__InfluenzaA__AAO46231
augaaccccaaucagaagaucauuaccauaggcagcgugucccugacaaucgccacugucugcuuccucaugcaaauugcuauccuuguuacgaccgugacacugcacuuuaaacagcaugacugugauucuccugcaucaaaccagguaaugccaugcgagccgauuaucauagaaagaaauaucacugagauuguguacuugaacaauaccacaaucgaaaaggagauuugucccaaagucguggaauauaggaacuggaguaagccucagugccaaaucaccggguucgccccauuuagcaaagacaauuccauacgguuaucugcgggaggugauauuuggguuacucgcgagcccuacgugucgugugacccugucaagugcuaucaguucgcucugggccaggggacaacccuagauaacaagcacucaaaugacacggugcaugaucgaaucccacaccguacucuccugaugaacgagcuuggaguacccuuucaucugggcaccagacagguuuguauugccuggagcaguuccucuugccacgacgguaaagcaugguugcacgugugugucacaggggaugacaagaaugccacugcuagcuucaucuacgauggaaggcucguggacuccaucggcucauggagucaaaacauucugcggacccaggaaagcgagugcguguguauaaauggcacaugcaccgucguuaugacggaugggucugcauccggacgcgccgacacuagaauccuguuuauugaagaggguaaaaucgugcauauaucaccucucagcggcagugcucagcacguagaggaaugcucuuguuauccaagguacccggacgugcggugcauuugucgcgauaacuggaagggguccaaucgacccgucaucgacaucaacauggaggauuauagcauugacucgucuuacgugugcuccggauuaguuggcgauacaccuagaaacgacgauaggucaaguaauagcaacugucggaauccaaacaaugaacgugguaaccccggggugaaaggaugggccuucgacaauggcgaugacgucuggaugggccgcaccaucuccaaggaucugagaucuggguacgagacuuuuaaggugauuggagguuggagcacaccuaacucaaaaagucagauaaauaggcaaguaaucguugacuccaacaauuggagcggcuauucugggauuuucucaguggaaggaaagaguugcaucaaccgguguuuuuacgucgagcuuauccgaggccgccagcaggagaccagagugugguggacgagcaauuccauugucguguucugcgguaccucugggacauauggcacuggaucguggccagacggcgcgaacauaaauuuuaugcccaucuga

SEQ ID NO: 136101 - RNA, 1410 nt, Artificial Sequence
  derived and/or modified sequence opt3 from neuraminidase__InfluenzaA__AAO46232
augaaccccaaucagaagaucauuaccauaggcagcgugucccugacaaucgccacugucugcuuccucaugcaaauugcuauccuuguuacgaccgugacacugcacuuuaaacagcaugagugugacucuccugcaucaaaccagguaaugccaugcgaaccgacuauuaucgagagaaauauaaccgaaaucguguacuugaacaauacaaccauugagaaggaaaucugucccaaagucguggaguauaggaacuggaguaagccucagugccaaauuacuggguucgccccauuuagcaaagauaauuccauccgguuaucugcgggaggugacauauggguuacacgcgagcccuacgugucgugugauccuggcaagugcuaucaguucgcucuggggcagggaaccacgcuagacaacaagcacucaaaugauacuauucaugaccgaaucccacaccguacccuccugaugaacgaacuuggcguccccuuucaucuggguacaagacagguguguauugccuggagcaguuccucuugccacgaugggaaagcaugguugcacguauguguuacuggagacgauaagaaugccaccgcuagcuucaucuacgacggcaggcucguggauuccaucggcucauggagucaaaacauucugcggacacaggagagcgaaugcgucuguauaaaugggaccugcacgguggugaugacugacggaucugcauccggucgcgccgauacaagaauccuguuuauugaggagggcaaaaucguccauauaucaccucucagcgggagugcucagcacguugaagagugcucuuguuauccaagguacccggacgugcggugcauuugucgcgacaacuggaagggauccaaucgacccaucaucgauauuaacauggaagacuauagcaucgauucgucuuacguaugcuccggcuuagugggugacaccccuagaaacgaugacaggucaaguaauagcaacugucggaauccaaacaaugagcgugggaaccccggagucaaaggcugggccuucgauaauggcgacgauguguggauggggcgcacuauuuccaaggaccugagaucuggauacgaaacauuuaagguuauagguggcuggagcaccccuaacucaaaaagucagaucaauaggcaagugauugucgauuccaacaauuggagcggguauucuggaaucuucucaguggagggcaagaguugcaucaaccgguguuuuuacguagagcuuauucgaggucgccagcaggaaacgagaguuugguggaccagcaauuccauaguggucuucugcgggacaucuggcacuuauggaaccggcucguggccagacggggcgaacaucaauuuuaugcccauuuga

SEQ ID NO: 136102 - RNA, 1410 nt, Artificial Sequence
  derived and/or modified sequence opt3 from neuraminidase__InfluenzaA__AAO46233
augaaccccaaucagaagaucauuaccauaggcagcgugucccugacaaucgccgcugucugcuuccucaugcaaauugcaauccuuguuacuacggugacccugcacuuuaaacagcaugagugugacucuccugccucaaaccagguaaugccaugcgaaccgauuaucauagagagaaauaucacagaaauuguguacuugaacaauacuaccaucgagaaggaaauuugucccaaagucguggaguauaggaacuggaguaagccucagugccaaaucacaggguucgcgccauuuagcaaagauaauuccauacgguuaucugcuggaggugacauuuggguuacccgcgagcccuacgugucgugugauccuggcaagugcuaucaguucgcccuggggcagggaacuacacuagacaacaagcacucaaaugauaccauccaugaccgaaucccacaccguacgcuccugaugaacgaacuuggcguccccuuucaucuggguacuagacagguguguauugcauggagcaguuccucuugccacgaugggaaagccugguugcacguauguguuaccggagacgauaagaaugcuacagccagcuucaucuacgacggcaggcucguggauuccauuggcucauggagucaaaacauacugcggacucaggagagcgaaugcgucuguaucaaugggaccugcacaguggugaugaccgacggaucugcauccggucgcgcugauacgaggauucuguuuaucgaggagggcaaaauaguccauauuucaccucucagcgggagugcccagcacguugaagagugcucuuguuauccaagauacccggacgugcggugcaucugucgcgacaacuggaagggauccaaucgacccguaguggauaucaacauggaagacuauagcauugauucgucuuacgucugcuccggcuuagugggugacacuccuagaaacgaugacaggucaaguaauagcaacugucggaauccaaacaaugagcgugggaaccccggaguuaaaggcugggcguucgauaauggcgacgauguguggauggggcgcacaaucuccaaggaccugagaucuggauacgaaaccuuuaaggucauugguggcuggagcacuccuaacucaaaaagucagauaaauaggcaagugaucguagauuccaacaaucggagcggguauucuggaauuuucucaguugagggcaaggguugcaucaaccgauguuuuuacguggagcuuauccgcgggagacagcaggaaacaagggucugguggaccaguaauagcauuguggucuucugcggcacguccggaaccuauggcacagggucuuggccagacggagcaaacauaaauuuuaugcccaucuga

SEQ ID NO: 136103 - RNA, 1410 nt, Artificial Sequence
  derived and/or modified sequence opt3 from neuraminidase__InfluenzaA__AAO46235
augaaccccaaucagaagaucauuaccauaggcagcgugucccugacaaucgccacugucugcuuccucaugcaaauugcuauccuuguuacgaccgugacacugcacuuuaaacagcaugagugugacucuccugcaucaaaccagguaaugccaugcgaaccgauuaucauagagagaaauaucacugaaauuguguacuugaacaauaccacaaucgagaaggaaauuugucccaaagucguggaguauaggaacuggaguaagccucagugccaaaucaccggguucgccccauuuagcaaagauaauuccauacgguuaucugcgggaggugacauuuggguuacucgcgagcccuacgugucgugugauccuggcaagugcuaucaguucgcucuggggcagggaacaacccuagacaacaagcacucaaaugauacgauccaugaccguauuccacaccgaacucuccugaugaacgaacuuggcguccccuuucaucuggguaccagacagguguguaucgccuggagcaguuccucuugccacgaugggaaagcaugguugcacguauguaucacaggagacgauaagaaugccacugcuagcuucauuuacgacggcaggcucguugauuccauaggcucauggagucaaaacauccugcggacccaggagagcgaaugcguguguauuaaugggacaugcaccgucgugaugacggacggaucugcauccggucgcgccgauacuagaauccuguuuauagaggagggcaaaauugugcauaucucaccucucagcgggagugcucagcacgucgaagagugcucuuguuauccaagguacccgggaguucggugcaucugucgcgacaacuggaagggcuccaaucgacccgugguagacauuaacauggaagauuauagcaucgacucgucuuacgugugcuccgguuuagucggggauacaccuagaaacgacgauaggucaaguaauagcaacugucggaauccaaacaaugagcguggaaaccagggcgugaaaggcugggccuucgacaauggggaugacguuuggaugggacgcaccauuuccaaggaucugagaucugguuacgaaacuuuuaaggugauaggcggguggagcacacccaacucaaaaagucaaaucaauaggcaggucauuguggacuccgauaaccggagcggauauucuggcaucuucucaguagaggguaagaguugcaucaaucgauguuuuuacguugagcuuauucgcgggagaaaacaggaaaccagggugugguggacgagcaacuccauagucguguucugcggcaccucuggaacauauggcacugggucguggccugacggagcgaauaucaacuuuaugccaauuuga

SEQ ID NO: 136104 - RNA, 1410 nt, Artificial Sequence
  derived and/or modified sequence opt3 from neuraminidase__InfluenzaA__AAO46236
augaaccccaaucagaagaucauuaccauaggcagcgugucccugacaaucgccacugucugcuuccucaugcacauugcuauccuuguuacgaccgugacacugcauuuuaaacaacacgagugugacucuccugcaucaaaccagguaaugccaugcgaaccgauuaucauagagagaaauaucacugaaauuguguacuugaacaauaccacaaucgagaaggaaauuugucccaaagucguggaguauaggaacuggaguaagccucagugccagaucaccggguucgccccauuuagcaaagauaauuccauacgguuaucugcgggaggugacauuuggguuacucgcgagcccuacgugucgugugauccuggcaagugcuaucaauucgcucuggggcagggaacaacccuagacaacaagcauucaaaugauacgauccacgaccguauuccacaucgaacucuccugaugaacgaacuuggcguccccuuucaccuggguaccagacagguguguaucgccuggagcaguuccucuugccacgaugggaaagcaugguugcauguauguaucacaggagacgauaagaaugccacugcuagcuucauuuacgacggcaggcucguugauuccauaggcucauggagucagaacauccugcggacccaagagagcgaaugcguguguauuaaugggacaugcaccgucgugaugacggacggaucugcauccggucgcgccgauacuagaauccuguuuauagaggagggcaaaauugugcacaucucaccucucagcgggagugcucagcaugucgaagagugcucuuguuauccaagguacccgggaguucggugcaucugucgcgacaacuggaagggcuccaaucgacccgugguagacauuaacauggaagauuauagcaucgacucgucuuacgugugcuccgguuuagucggggauacaccuagaaacgacgauaggucaaguaauagcaacugucggaauccaaacaaugagcguggaaaccagggcgugaaaggcugggccuucgacaauggggaugacguuuggaugggacgcaccauuuccaaggaucugagaucugguuacgaaacuuuuaaggugauaggcggguggagcacacccaacucaaaaagucagaucaauaggcaagucauuguggacuccgauaaccggagcggauauucuggcaucuucucaguagaggguaagaguugcaucaaucgauguuuuuacguugagcuuauucgcgggagaaaacaggaaaccagggugugguggacgagcaacuccauagucguguucugcggcaccucuggaacauauggcacugggucguggccugacggagcgaauaucaacuuuaugccaauuuga

SEQ ID NO: 136105 - RNA, 1410 nt, Artificial Sequence
  derived and/or modified sequence opt3 from neuraminidase__InfluenzaA__AAO46237
augaaccccaaucagaagaucauuaccauaggcagcgugucccugacaaucgccacugucugcuuccucaugcagauugcuauccuuguuacgaccgugacacugcacuuuaaacagcaugagugugacucuccugcaucaaaccagguaaugccaugcgaaccgauuaucauagagagaaauaucacugaaauuguguacuugaacaauaccacaaucgagaaggaaauuugucccaaaaucgucgaguauaggaacuggaguaagccucagugccaaauaaccggguucgccccauuuagcaaagauaauuccauucgguuaucugcgggaggugacaucugggugacucgcgagcccuacguuucgugugauccuggcaagugcuaucaguucgcucuggggcagggaacaacccuagacaacaagcacucaaaugauacgauucaugaccgaaucccacaccguacucuccugaugaacgaacuuggcgugcccuuucaucuggguaccagacaggucuguaucgccuggagcaguuccucuugccacgaugggaaagcaugguugcacguguguauuacaggagacgauaagaaugccacugcuagcuucauauacgacggcaggcucguagauuccaucggcucauggagucaaaacauucugcggacccaggagagcgaaugcguuuguaucaaugggacaugcaccguggucaugacggacggaucugcauccggucgcgccgauacuagaauacuguuuauugaggagggcaaaaucgugcauaucucaccucucagcgggagugcucagcacguggaagagugcucuuguuauccaagguacccgggaguccggugcauuugucgcgacaacuggaagggcuccaaucgacccguuguggacaucaacauggaagauuauagcauugacucgucuuacguaugcuccgguuuagugggggauacaccuagaaacgacgauaggucaaguaauagcaacugucggaauccaaacaaugagcguggaaaccagggcgucaaaggcugggccuucgacaauggggaugacguguggaugggacgcaccauauccaaggaucugagaucugguuacgaaacuuuuaagguuaucggcggguggagcacacccaacucaaaaagucaaauuaauaggcaagugaucgucgacuccgauaaccggagcggauauucuggcaucuucucaguggaggguaagaguugcauuaaucgauguuuuuacguagagcuuauacgcgggagaaaacaggaaaccaggguuugguggacgagcaacuccaucguggucuucugcggcaccucuggaacauauggcacugggucguggccugacggagcgaauauuaacuuuaugccaaucuga

SEQ ID NO: 136106 - RNA, 1410 nt, Artificial Sequence
  derived and/or modified sequence opt3 from neuraminidase__InfluenzaA__AAO46238
augaaccccaaucagaagaucauuaccauaggcagcgccucccugacaaucgcuacugugugcuuccucaugcaaauugcaauccuugucacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccaaaaucguggaguauaggaacuggaguaagccucagugcaaaauaaccggguucgcgccauuuagcaaggauaauuccauucgguuaucugcuggaggugacaucugggucacucgcgagcccuacgugucgugugauccuggcaagugcuaucaauucgcccuggggcagggaacaacccuagacaacaaacacucaaaugauacgauucaugaccgaaucccacaccguacucuccugaugaacgaacuuggcguucccuuucaucuggguaccagacagguguguaucgcauggagcaguuccucuugccacgaugggaaggccugguugcacgucugugugacaggagacgauaaaaaugcuacugccagcuucauuuacgacggcaggcucguagauuccauaggcucauggagucagaacauccugcggacccaagagagcgaaugcguuuguauuaaugggacaugcaccguggucaugacggacggaucugcauccggucgcgcugauacuagaauccuguuuauagaggagggcaagauugugcauaucucaccucucagcgggagugcccagcacguggaagagugcucuuguuauccaagguacccggacguccggugcaucugucgcgacaacuggaaaggauccaaucgacccguuguggauauuaacauggaagacuauagcaucgauucgucuuacguaugcuccggcuuagugggugacacaccuagaaacgaugacaggucaaguaauagcaacugucggaauccaaacaaugagaaggggaaccagggagucaagggcugggcguucgauaauggcgacgauguguggauggggcguaccauuuccaaagaccugcgcucuggauacgaaacuuuuaagguuauagguggcuggagcacacccaacucaaaaagucagaucaauagacaagugauugucgauuccgacaacaggagcggguauucuggaaucuucucaguggagggcaagaguugcaucaaucgguguuuuuacguagagcuuauucgaggucgcaaacaggaaaccagaguuugguggacgagcaacuccauaguggucuucugcgggaccucuggcacauauggaacuggcucguggccugacggggcaaauaucaacuugaugccaauuuga

SEQ ID NO: 136107 - RNA, 1410 nt, Artificial Sequence
  derived and/or modified sequence opt3 from neuraminidase__InfluenzaA__AAO46241
augaaccccaaucagaagaucauuaccauaggcagcgugucccugacaaucgccacugucugcuuccucaugcaaauugcuauccuuguuacgaccgugacacugcacuuuaaacagcaugagugugacucuccugcaucaaaccagguaaugccaugcgaaccgauuaucauagagagaaauaucacugaaauuguguacuugaacaauaccacaaucgagaaggaaauuugucccaaagucgugggguauaggaacuggaguaagccucagugccaaaucaccggauucgccccauuuagcaaagauaauuccauacgguuaucugcggguggcgacauuuggguuacucgcgagcccuacgugucgugugauccugggaagugcuaucaguucgcucugggacagggcacaacccuagacaacaagcacucaaaugauacgauccaugaccguauuccacaccgaacucuccugaugaacgagcuugguguccccuuucaucuggggaccagacagguguguaucgccuggagcaguuccucuugccacgauggaaaagcaugguugcacguauguaucacaggcgacgauaagaaugccacugcuagcuucauuuacgacggcaggcucguugauuccauagggucauggagucaaaacauccugcggacccaggaaagcgagugcguguguauuaauggaacaugcaccgucgugaugacggacgguucugcauccggccgcgccgauacuagaauccuguuuauagaagaggggaaaauugugcauaucucaccucucagcggaagugcucagcacgucgaggaaugcucuuguuauccaagguacccgggcguucggugcaucugucgcgacaacuggaaggguuccaaucgacccgugguagacauuaacauggaggauuauagcaucgacucgucuuacgugugcuccggguuagucggagauacaccuagaaacgacgauaggucaaguaauagcaacugucggaauccaaacaaugaacguggcaaccagggcgugaaagggugggccuucgacaauggagaugacguuuggaugggucgcaccauuuccaaggaucugagaucuggcuacgagacuuuuaaggugauagggggauggagcacacccaacucaaaaagucaaaucaauaggcaggucauuguggacuccgauaaccggagcggcuauucugguaucuucucaguagaagggaagaguugcaucaaucgauguuuuuacguugagcuuauucgcggcagaaaacaggagaccagggugugguggacgagcaacuccauagucguguucugcggaaccucuggcacauaugggacuggaucguggccugacggugcgaauaucaacuuuaugccaauuuga

SEQ ID NO: 136108 - RNA, 1410 nt, Artificial Sequence
  derived and/or modified sequence opt3 from neuraminidase__InfluenzaA__AAO46245
augaaccccaaucagaagaucauuaccauaggcagcgugucccugacaaucgccacugucugcuuccucaugcaaauugcuauccuuguuacgaccgugacacugcacuuuaaacagcaugacugugauucuccugcaucaaaccagguaaugccaugcgagccgauuaucauagaaagaaauaucacugagauuguguacuugaacaauaccacaaucgaaaaggagauuugucccaaagucguggaauauaggaacuggaguaagccucagugccaaaucaccggguucgccccauuuagcaaagacaauuccauacgguuaucugcgggaggugauauuuggguuacucgcgagcccuacgugucgugugacccugucaagugcuaucaguucgcucugggccaggggacaacccuagauaacaagcacucaaaugacacggugcaugaucgaaucccacaccguacucuccugaugaacgagcuuggaguacccuuucaucugggcaccagacagguuuguauugccuggagcaguuccucuugccacgacgguaaagcaugguugcacguguguaucacaggggaugacaagaaugccacugcuagcuucaucuacgauggaaggcucgucgacuccauuggcucauggagucaaaacauacugcggacccaggaaagcgagugcguguguaucaauggcacaugcaccguggucaugacggaugggucugcauccggacgcgccgacacuaggauucuguuuaucgaagaggguaaaauaguucauauuucaccucucgcuggcagcgcccagcacguggaggaaugcaguuguuauccaagguacccggggguacggugcaucugucgcgacaacuggaagggaucuaaucgacccguggucgauaucaacauggaggacuauuccauugauagcucguacgugugcucuggcuuaguuggugacacaccuagaaacgaugacagguccucaaauaguaacugucggaauccaaacaaugaacgugggacccagggagugaaaggcugggcguucgauaacggcaaugaccuguggauggggcgcacuaucagcaaggaucuuagauccggauacgagacauuuaaggucauugguggcuggucuacccccaacagcaaaucacaaauaaauagacaggugaucguagacagugauaaccgguccggguauagcggaauuuucucuguugaaggcaagucaugcaucaaucgauguuuuuacguggaguugauccgcgguagaaaacaggagacgagggucugguggaccaguaacagcauuguggucuucugcgggacauccggcacuuauggaaccggcucuuggccugacggggcaaauauaaacuuuaugccaaucuga

SEQ ID NO: 136109 - RNA, 1410 nt, Artificial Sequence
  derived and/or modified sequence opt3 from neuraminidase__InfluenzaA__AAO46246
augaaccccaaucagaagaucauuaccauaggcagcgugucccugacaaucgccacugucugcuuccucaugcagauugcuauccuugcaacgaccguuacacugcacuuuaaacagcaugagugugacucuccugccucaaaccaggugaugccaugcgaaccgauuaucauagagagaaauaucacugaaauuguauacuugaacaauaccaucauugagaaggaaaucugucccaaaguggucgaguauaggaacuggaguaagccucagugccaaauaacaggguucgcgccauuuagcaaagauaauuccauucgguuaucugcuggaggugacaucugggugacccgcgagcccuacguuucgugugauccuggcaagugcuaucaguucgcccuggggcagggaacuacacuagacaacaagcacucaaaugauaccauucaugaccgaacgccacaccguacucuccugaugaacgaacuuggcgugcccuuucaucuggguaccagacaggucuguaucgcauggagcaguuccucuugccacgaugggaaagccugguugcacguguguaucacaggagacgauaagaaugcuacugccagcuucauuuacgacggcaggcucguagauuccauaggcucauggagucaaaacauccugcggacccaggagagcgaaugcguuuguauuaaugggacaugcaccguggucaugacggacggaucugcauccggucgcgcugauacuagaauccuguuuauagaggagggcaaaauugugcauaucucaccucucagcgggagugcccagcacguggaagagugcucuuguuauccaagguacccgggaguccggugcaucugucgcgacaacuggaagggcuccaaucgacccguuguggacauuaacauggaagauuauagcaucgacucgucuuacguaugcuccgguuuagugggggauacaccuagaaacgacgauaggucaaguaauagcaacugucggaauccaaacaaugagcguggaaaccagggcgucaaaggcugggcguucgacaauggggaugacguguggaugggacgcaccauuuccaaggaucugagaucugguuacgaaacuuuuaagguuauaggcggguggagcacacccaacucaaaaagucaaaucaauaggcaagugauugucgacuccgauaaccggagcggauauucuggcaucuucucaguggaggguaagaguugcaucaaucgauguuuuuacguagagcuuauucgcgggagaaaacaggaaaccaggguuugguggacgagcaacuccauagcaguguucugcggcaccucuggaacauauggcacugggucguggccugacggagccaauaucaacuuuaugccaauuuga

SEQ ID NO: 136110 - RNA, 1410 nt, Artificial Sequence
  derived and/or modified sequence opt3 from neuraminidase__InfluenzaA__AAO46247
augaaccccaaucagaagaucauuaccauaggcagcgugucccugacaaucgccacugucugcuuccucaugcaaauugcuauccuuguuacgaccgugacacugcacuuuaaacagcaugagugugacucuccugcaucaaaccagguaaugccaugcgaaccgauuaucauagagagaaauaucacugaaauuguguacuugaacaauaccacaaucgagaaggaaauuugucccaaagucguggaguauaggaacuggaguaagccucagugccaaaucaccggguucgccccauuuagcaaagauaauuccauacgguuaucugcgggaggugacauuuggguuacucgcgagcccuacgugucgugugauccuggcaagugcuaucaguucgcucuggggcagggaacaacccuagacaacaagcacucaaaugauacgauccaugacaggauuccacaccguacucuccugaugaacgaacuuggcguccccuuucaucuggguaccagacagguguguaucgccuggagcaguuccucuugccacgaugggaaagcaugguugcacguauguaucacaggagacgauaagaaugccacugcuagcuucauuuacgacggcaggcucguugauuccauaggcucauggagucaaaacauccugcggacccaggagagcgaaugcguguguauuaaugggacaugcaccgucgugaugacggacggaucugcauccggucgcgccgauacuagaauccuguuuauagaggagggcaaaauugugcauaucucaccucucagcgggagugcucagcacgucgaagagugcucuuguuauccaagguacccgggaguucggugcaucugucgcgacaacuggaagggcuccaaucgacccgugauugacaucaacauggaagauuauagcauugacucgucuuacguaugcuccgguuuagugggggauacaccuagaaacgacgauaggucaaguaauagcaacugucggaauccaaacaaugagcguggaaaccagggcgucaaaggcugggccuucgacaauggggaugacguguggaugggacgcaccauauccaaggaucugagaucugguuacgaaacuuuuaagguuaucggcggguggagcacacccaacucaaaaagucaaauuaaucgacaggugaucgucgacuccgauaaccggagcggauauucuggcaucuucucaguggaggguaagaguugcauuaaucgauguuuuuacguagagcuuauacgcgggagaaaacaggaaaccaggguuugguggacgagcaacuccaucguggucuucugcggcaccucuggaacauauggcacugggucguggccugacggagcgaauauuaacuuuaugccaaucuga

SEQ ID NO: 136111 - RNA, 1410 nt, Artificial Sequence
  derived and/or modified sequence opt3 from neuraminidase__InfluenzaA__AAO46462
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuaucauagagagaaauaucacugaaauuguguauuugaacaauaccacaaucgagaaggaaauuugucccaaagucguggaguacaggaacuggaguaagccucagugccaaaucaccggguucgccccauuuagcaaagauaauuccauacgguuaucugcgggaggugacauuuggguuacucgcgagcccuaugugucgugugaucauggcaagugcuaccaguucgcucuggggcagggaacaacccuagacaacaagcacucaaaugauacgauccaugaccguauuccucaccgaacucuccugaugaacgaacuuggcgucccauuucaucuggguaccagacagguguguaucgccuggagcaguuccucuugccacgaugggaaagcaugguugcacguauguaucacaggagacgauaagaaugccacugcuagcuucauuuaugacggcaggcucguugauuccauaggcucauggagucaaaacauccugcggacccaggagagcgaaugcguguguauuaaugggacaugcaccgucgugaugacggacggaucugcauccggucgcgccgauacuagaauccuguuuauagaggagggcaaaauugugcauaucucaccccucagcgggagugcucagcacgucgaagagugcucuuguuacccuagguauccaggaguucggugcaucugucgcgacaacuggaagggcuccaaucgaccggugguagacauuaacauggaagauuacagcaucgacucgucuuacgugugcuccgguuuagucggggauacacccagaaacgacgauaggucaaguaauagcaacugucggaauccuaacaaugagcguggaaaccagggcgugaaaggcugggccuucgacaauggggaugacguuuggaugggacgcaccauuuccaaggaucugagaucugguuaugaaacuuuuaaggugauaggcggguggagcacaccaaacucaaaaagucaaaucaauaggcaggucauuguggacuccgauaaccggagcggauacucuggcaucuucucaguagaggguaagaguugcaucaaucgauguuuuuauguugagcuuauucgcgggagaaaacaggaaaccagggugugguggacgagcaacuccauagucguguucugcggcaccucuggaacauacggcacugggucguggcccgacggagcgaauaucaacuuuaugccuauuuga

SEQ ID NO: 136112 - RNA, 1410 nt, Artificial Sequence; identical to SEQ ID NO: 136111
  derived and/or modified sequence opt3 from neuraminidase__InfluenzaA__AAO46463

SEQ ID NO: 136113 - RNA, 1410 nt, Artificial Sequence; identical to SEQ ID NO: 136111
  derived and/or modified sequence opt3 from neuraminidase__InfluenzaA__AAO46464

SEQ ID NO: 136114 - RNA, 1410 nt, Artificial Sequence; identical to SEQ ID NO: 136111
  derived and/or modified sequence opt3 from neuraminidase__InfluenzaA__AAO46465

SEQ ID NO: 136115 - RNA, 1410 nt, Artificial Sequence; identical to SEQ ID NO: 136111
  derived and/or modified sequence opt3 from neuraminidase__InfluenzaA__AAO46466

SEQ ID NO: 136116 - RNA, 1410 nt, Artificial Sequence
  derived and/or modified sequence opt3 from neuraminidase__InfluenzaA__AAO46467
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuaucauagagagaaauaucacugaaauuguguauuugaacaauaccacaaucgagaaggaaauuugucccaaagucguggaguacaggaacuggaguaagccucagugccaaaucaccggguucgccccauuuagcaaagauaauuccauacgguuaucugcgggaggugacauuuggguuacucgcgagcccuaugugucgugugaucauggcaagugcuaccaguucgcucuggggcagggaacaacccuagacaacaagcacucaaaugauacgauccaugaccguauuccucaccgaacucuccugaugaacgaacuuggcgucccauuucaucuggguaccagacagguguguaucgccuggagcaguuccucuugccacgaugggaaagcaugguugcacguauguaucacaggagacgauaagaaugccacugcuagcuucauuuaugacggcaggcucguugauuccauaggcucauggagucaaaacauccugcggacccaggagagcgaaugcguguguauuaaugggacaugcaccgucgugaugacggacggaucugcauccggucgcgccgauacuagaauccuguuuauagaggagggcaaaauugugcauaucucaccccucacagggagcgcucagcacgucgaagagugcaguuguuacccuagguauccaggaguucggugcaucugucgcgacaacuggaagggcucuaaucgaccggugguagacauuaacauggaagauuacuccaucgacagcucguacgugugcucugguuuagucggggauacccccagaaacgacgauagguccucaaauaguaacugucggaauccuaacaaugagcguggaaaccagggcgugaaaggcugggccuucgacaauggggaugacguuuggaugggacgcacuauuagcaaggaucugagauccgguuaugaaacauuuaaggugauaggcggguggucuaccccaaacagcaaaucacaaaucaauaggcaggucauuguggacagugauaaccgguccggauacagcggcaucuucucuguagaggguaagucaugcaucaaucgauguuuuuauguugagcuuauucgcgggagaaaacaggaaacgagggugugguggaccaguaacagcauagucguguucugcggcacauccggaacuuacggcaccgggucuuggcccgacggagcgaauaucaacuuuaugccuauuuga

SEQ ID NO: 136117 - RNA, 1410 nt, Artificial Sequence
  derived and/or modified sequence opt3 from neuraminidase__InfluenzaA__AAO46468
augaaccccaaucagaagaucauuaccauaggcagcgugucccugacaaucgccacugucugcuuccucaugcaaauugcuauccuuguuacgaccgugacacugcacuuuaaacaguacgagugugacuucccugcaucuaaccagguaaugccaugcgaaccgauuaucauagagagaaauaucacugaaauuguguauuugaacaauaccacaaucgagaaggaaauuugucccaaagucguggaguacaggaacuggucaaagccucagugccaaaucaccggguuugccccauucaguaaagauaauagcauacgguuauccgcgggaggugacauuuggguuacucgcgagcccuaugugucuugugaucauggcaagugcuaccaguuugcucuggggcagggaacaacccuagacaacaagcacucgaaugauacgauccaugaccguauuccucaccgaacucuccugaugaacgaacuuggcgucccauuccaucuggguaccagacagguguguaucgccuggucaagcaguuccugccacgaugggaaagcaugguugcacguauguaucacaggagacgauaagaaugccacugcuucuuuuauuuaugacggcaggcucguugauagcauaggcuccuggucacaaaacauccugcggacccaggagagugaaugcguguguauuaaugggacaugcaccgucgugaugacggacggaagcgcaucuggucgcgccgauacuagaauccuguucauagaggagggcaaaauugugcauaucucaccccucuccgggagcgcucagcacgucgaagagugcaguuguuacccuagguauccaggaguucggugcaucugucgcgacaacuggaagggcucuaaucgaccggugguagacauuaacauggaagauuacuccaucgacagcucguacgugugcucugguuuagucggggauacacccagaaacgacgauagguccucaaauaguaacugucggaauccuaacaaugagcguggaaaccagggcgugaaaggcugggccuuugacaauggggaugacguuuggaugggacgcaccauuagcaaggaucugagauccgguuaugaaacuuucaaggugauaggcggguggucuacaccaaacagcaaaucacaaaucaauaggcaggucauuguggacagugauaaccgguccggauacagcggcaucuuuucuguagaggguaagucaugcaucaaucgauguuucuauguugagcuuauucgcgggagaaaacaggaaaccagggugugguggacgaguaacagcauagucguguuuugcggcaccuccggaacauacggcacugggucuuggcccgacggagcgaauaucaacuucaugccuauuuga

SEQ ID NO: 136118 - RNA, 1410 nt, Artificial Sequence; identical to SEQ ID NO: 136111
  derived and/or modified sequence opt3 from neuraminidase__InfluenzaA__AAO46469

SEQ ID NO: 136119 - RNA, 1410 nt, Artificial Sequence
  derived and/or modified sequence opt3 from neuraminidase__InfluenzaA__AAO46471
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuaucauagagagaaauaucacugaaauuguguauuugaacaauaccacaaucgagaaggaaauuugucccaaagucguggaguacaggaacuggaguaagccucagugccaaaucaccggguucgccccauuuagcaaagauaauuccauacgguuaucugcgggaggugacauuuggguuacucgcgagcccuaugugucgugugauccuggcaagugcuaccaguucgcucuggggcagggaacaacccuagacaacaagcauucaaaugauacgauccacgaccguauuccacaucgaacucuccugaugaacgaacuuggcguccccuuucaccuggguaccagacagguguguaucgccuggagcaguuccucuugccaugaugggaaagcaugguugcacguauguaucacaggagacgauaagaaugccacugcuagcuucauuuaugacggcaggcucguugauuccauaggcucauggagucaaaacauccugcggacccaggagagcgaaugcguguguauuaaugggacaugcaccgucgugaugacggacggaucugcauccggucgcgccgauacuagaauccuguuuauagaggagggcaaaauugugcacaucucaccucucagcgggagugcucagcaugucgaagagugcucuuguuacccaagguauccgggaguucggugcaucugucgcgacaacuggaagggcuccaaucgacccgugguagacauuaacauggaagauuacagcaucgacucgucuuacgugugcuccgguuuagucggggauacaccuagaaacgacgauaggucaaguaauagcaacugucggaauccaaacaaugagcguggaaaccagggcgugaaaggcugggccuucgacaauggggaugacguuuggaugggacgcaccauuuccaaggaucugagaucugguuaugaaacuuuuaaggugauaggcggguggagcacacccaacucaaaaagucaaaucaauaggcaggucauuguggacuccgauaaccggagcggauacucuggcaucuucucaguagaggguaagaguugcaucaaucgauguuuuuauguugagcuuauucgcgggagaaaacaggaaaccagggugugguggacgagcaacuccauagucguguucugcggcaccucuggaacauacggcacugggucguggccugacggagcgaauaucaacuuuaugccaauuuga

SEQ ID NO: 136120 - RNA, 1410 nt, Artificial Sequence
  derived and/or modified sequence opt3 from neuraminidase__InfluenzaA__AAO46472
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuacuaucgagagaaauauaaccgaaaucguguauuugaacaauacaaccauugagaaggaaaucugucccaaagucguggaguacaggaacuggaguaagccucagugccaaauuacuggguucgccccauuuagcaaagauaauuccauccgguuaucugcgggaggugacauauggguuacacgcgagcccuaugugucgugugauccuggcaagugcuaccaguucgcucuggggcagggaaccacgcuagacaacaagcauucaaaugauacuauucacgaccgaaucccacaucguacccuccugaugaacgaacuuggcguccccuuucaccuggguacaagacagguguguauugccuggagcaguuccucuugccaugaugggaaagcaugguugcacguauguaucacuggagacgauaagaaugccaccgcuagcuucaucuaugacggcaggcucguugauuccauuggcucauggagucaaaacauacugcggacacaggagagcgaaugcguguguaucaaugggaccugcacggucgugaugacugacggaucugcauccggucgcgccgauacaaggauucuguuuaucgaggagggcaaaauagugcacauuucaccucucagcgggagugcucagcaugucgaagagugcucuuguuacccaagauauccgggaguucggugcaucugucgcgacaacuggaagggcuccaaucgacccgugguagacaucaacauggaagauuacagcauugacucgucuuacgugugcuccgguuuagucggggauaccccuagaaacgacgauaggucaaguaauagcaacugucggaauccaaacaaugagcguggaaaccagggcgugaaaggcugggccuucgacaauggggaugacguuuggaugggacgcacuaucuccaaggaucugagaucugguuaugaaacauuuaaggugauuagcggcuggucaacccccaacaguaaaucccaaauaaauaggcaggucaucguggacagcgauaaccggucuggguacucaggaauuuucaguguagagggcaagagcugcaucaaucgauguuuuuauguugagcuuauccgcgguagaaaacaggaaacgagggugugguggaccuccaacucuauugucguguucugcgggacaucgggcacuuacggaaccggcagcuggccugacggggcgaauauaaacuuuaugccaaucuga

SEQ ID NO: 136121 - RNA, 1410 nt, Artificial Sequence; identical to SEQ ID NO: 136111
  derived and/or modified sequence opt3 from neuraminidase__InfluenzaA__AAO46473

SEQ ID NO: 136122 - RNA, 1410 nt, Artificial Sequence; identical to SEQ ID NO: 136111
  derived and/or modified sequence opt3 from neuraminidase__InfluenzaA__AAO46474

SEQ ID NO: 136123 - RNA, 1410 nt, Artificial Sequence; identical to SEQ ID NO: 136111
  derived and/or modified sequence opt3 from neuraminidase__InfluenzaA__AAO46475

SEQ ID NO: 136124 - RNA, 1410 nt, Artificial Sequence
  derived and/or modified sequence opt3 from neuraminidase__InfluenzaA__AAO46476
augaaccccaaucagaagaucauuaccauaggcagcgugucccugacaaucgccacugucugcuuccucaugcaaauugcuauccuuguuacgaccgugacacugcacuuuagacaguacgagugugacucuccugcaaacaaucagguaaugccaugcgaaccgacuauuaucgagaggaacauaaccgaaaucguguauuugaauaacacaaccauugagaaagaaaucugucccaaguuagucgaguaccggaauuggucaaaaccucagugcaagauuacuggguucgccccauuuaguaaagauaacagcauccgccuguccgcgggaggugacauaugggugacacgagagcccuauguuucuugugauccuggcaagugcuaccaauucgcucuagggcagggaaccacgcucgacaauaagcauucgaacgauacuauucacgaccguaucccacauagaacccugcuuaugaaugaacugggcgugcccuuucacuuggguacaaggcaggucuguauugccuggucaagcaguuccugccaugaugggaaagcauggcuccacguguguguaacuggagacgauaagaacgccaccgcuucuuucaucuaugacggccggcugguugauagcaucggcuccuggucacagaauauucugcgcacacaagagagugaaugcguguguauaaacgggaccugcacggucgugaugacugacggaagcgcaucugguagagccgauacaaggauccucuuuauugaggagggcaaaaucgugcacauauccccuuuaucagggagcgcucagcaugucgaagagugcaguuguuacccacgguauccgggaguucgcugcauuugucgagacaauuggaagggcucuaacagacccgugguagacaucaacguggaagauuacuccaucgacagcucguacgucugcucuggucuggugggggauaccccuaggaauaacgaccgguccucaaauaguaacugucguaauccaaacaaugagcgcggaaaccacggcguuaaaggcugggccuucgaugacgggaaugauguguggaugggaagaacuauuagcaaggaccuuagguccgguuaugaaacauuuaaggucaucggcggguggucuacccccaacagcaaaucacagauuaaucgacaggugauaguagauagugacaaccgguccggauacagcggcaucuucucuguugaggguaagucaugcauuaaucgcuguuuuuauguggaguugaucagagggagggaacaagagacgcgggucugguggaccaguaacagcaucguggucuucugcggcacauccggaacuuacggcaccgggucuuggccugauggagcggacauuaaucugaugccaauauga

SEQ ID NO: 136125 - RNA, 1410 nt, Artificial Sequence; identical to SEQ ID NO: 136111
  derived and/or modified sequence opt3 from neuraminidase__InfluenzaA__AAO46477

SEQ ID NO: 136126 - RNA, 1410 nt, Artificial Sequence
  derived and/or modified sequence opt3 from neuraminidase__InfluenzaA__AAO46478
augaaccccaaucagaagaucauuaccauaggcagcgugucccugaucauugccacagucugcuuccucaugcaaaucgcuauucuuguuacuacggugacccugcacuuuaaacagcaugagugugacucuccuucaaguaaccagguaaugccaugcgaaccgaucauaaucgagagaaauauuacagaaaucguguacuugaacaauacuaccauugagaaggaaacaugucccaaauuagucgaguauaggaacuggagcaagccucagugcaaaaucaccggguucgcaccauuuuccaaggauaauucuauacggcugucggccggaggugacauuugggugacucgcgagcccuacguuucaugugauccuggcaagugcuaucaauucgcgcuagggcagggaacaacccucgacaacaaacacagcaaugauacgauccaugaccgaaucccacaccguacucugcuuaugaacgaacugggcgugcccuuucauuuggguaccagacaggucuguauugcuuggaguuccucuagcugccacgaugggaaggccuggcuccacguguguguaacaggagacgauaaaaaugcaacugccuccuucaucuacgacggcaggcugguugauucaauuggcaguuggagccagaacauacugcggacccaagagucugaaugcguguguaucaaugggacaugcaccgucgugaugacggacggaaacgcuuccggucgcgcagauacuaggauucucuuuaucgaggagggcaagauagugcauauuucaccuuuaagcgggagugcccagcacgucgaagagugcucuuguuauccaagguacccggacguucggugcaucugucgcgacaauuggaaaggauccaaccgacccaucguggauauuaacaugaaggacuauagcaucgauucgucuuacguaugcuccggccuggugggugacacaccuagaaaugaugacaggucaaguaagagcaacugucggaauccaaacaaugaacgugggaaccauggagucaaaggcugggcuuucgauaauggcaacgacguguggauggggcgcaccauuuccaaggaucuuagaucuggauacgagacuuuuaaaguuauagguggcuggagcacacccaauucaaagagucagaucaacagacaggugauugucgacuccgauaaucggagcggguauucuggaaucuucucaguggaaggcaaaaguugcaucaaccgauguuuuuacguagaguugauucgcgguagagagcaagaaaccaggguuugguggacgagcaauuccauaguggucuucugcgggaccucuggcacauauggaacuggcucguggccugacggggccaacaucaauuuuaugccaauuuga

SEQ ID NO: 136127 - RNA, 1410 nt, Artificial Sequence
  derived and/or modified sequence opt3 from neuraminidase__InfluenzaA__AAO46479
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaacagaguaaugccaugcgaaccgauuaucauagagaggaauaucacugaaauuguguauuugaacaauaccacaaucgagaaggaaauuugucccaaagucguggaguaccggaacuggaguaagccucagugccagaucaccggguucgccccauuuagcaaagauaauuccauacgcuuaucugcgggaggugacauuuggguuacucgagagcccuaugugucgugugauccuggcaagugcuaccaauucgcucuggggcagggaacaacccuagacaacaagcauucaaaugauacgauccacgaccguauuccacauagaacucuccugaugaacgaacuuggcguccccuuucaccuggguaccaggcaaguguguaucgccuggagcaguuccucuugccaugaugggaaagcaugguugcacguauguaucacaggagacgauaagaaugccacugcuagcuucauuuaugacggccggcucguugauuccauaggcucauggagucagaacauccugcgcacccaggagagcgaaugcguguguauuaaugggacaugcaccgucgugaugacggacggaucugcauccgguagagccgauacuaggauccuguuuauagaggagggcaaaauugugcacaucucaccucucagcgggagugcucagcaugucgaagagugcucuuguuacccacgguauccgggaguucgcugcaucugucgagacaacuggaagggcuccaauagacccgugguagacauuaacauggaagauuacagcaucgacucgucuuacgugugcuccgguuuagucggggauacaccuaggaacgacgaucggucaaguaauagcaacugucguaauccaaacaaugagcgcggaaaccagggcgugaaaggcugggccuucgacaauggggaugacguuuggaugggaagaaccauuuccaaggaucugaggucugguuaugaaacuuuuaaggugauaggcggguggagcacacccaacucaaaaagucagaucaaucggcaagucauuguggacuccggaaaccgaagcggcuacucugguaucuucucaguagaggggaagaguugcaucaaucgcuguuuuuauguugagcuuauuagaggcaggaaacaggaaacccgggugugguggacgagcaacuccauagucguguucugcggaaccucuggcacauacgggacuggaucguggccugauggugcgaauaucaacuuuaugccaauuuga

SEQ ID NO: 136128 - RNA, 1410 nt, Artificial Sequence
  derived and/or modified sequence opt3 from neuraminidase__InfluenzaA__AAO46481
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaaacaaucagguaaugccaugcgaaccgauuaucauagagagaaacaucacugaaauuguguauuugaccaauacaaccaucgagaaggaaauuugucccaaauuagucgaguacaggaacuggucaaagccucagugcaaaaucacuggguucgccccauuuaguaaggauaauagcauacggcuguccgcgggaggugacauuugggugacacgcgagcccuauguuucuugugauccuggcaagugcuaccaauucgcucuagggcagggaaccacgcucgacaacaaacauucgaaugauacuauccacgaccgaaucccacaucguacccugcuuaugaacgaacugggcgugcccuuucacuuggguacaagacaggucuguauugccuggucaagcaguuccugccaugaugggaaggcauggcuccacguguguguaacuggagacgauaaaaaugccaccgcuucuuucaucuaugacggcaggcugguugauagcauuggcuccuggucacagaacauacugcggacacaagagagugaaugcguguguaucaaugggaccugcacggucgugaugacugacggaagcgcaucuggucgcgccgauacacggauucucuuuaucgaggagggcaagauagugcacauuuccccuuuaucagggagcgcucagcaugucgaagagugcaguuguuacccaagguauccgggaguucggugcaucugucgcgacaacuggaaaggcucuaaucgacccgugguagacaucaacgugaaggauuacuccauugacagcagauacgucugcucgggucuggugggggauaccccuaggaacaaugaccggucuuccaacucaaauugucguaacccaaauaacgaacgcggaaaucacggcguuaagggcugggccuucgaugacgggaacgauguguggaugggaagaacuaucaguaaagacagcagguccgguuaugagacauuuaaggucauuggcggguggucuacccccaauagcaaaucacagauaaacagacaggugaucguagauagugacaaucgauccggauacagcggcauuuucucuguugaaucaaagaguugcaucaaccgcuguuuuuauguggagcuuaucagagguagggagcaagaaacgcgggucugguggaccagcaauuccauuguggucuucugcgggacaucuggcacuuacggaaccggcucguggccugauggggcggacauaaacuugaugccaaucuga

SEQ ID NO: 136129 - RNA, 1410 nt, Artificial Sequence
  derived and/or modified sequence opt3 from neuraminidase__InfluenzaA__AAO46482
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaaacaaucagguaaugccaugcgaaccgaugauuaucgagagaaacauaacugaaaucguguauuugaccaauacaaccauugagaaggaaaucugucccaaauuagucgaguacaggaacuggucaaagccucagugcaaaauuacuggguucgccccauuuaguaaggauaauagcauccggcuguccgcgggaggugacauaugggugacacgcgagcccuauguuucuugugauccuggcaagugcuaccaauucgcucuagggcagggaaccacgcucgacaacaaacauucgaaugauacuauucacgaccgaaucccacaucguacccugcuuaugaacgaacugggcgugcccuuucacuuggguacaagacaggucuguauugccuggucaagcaguuccugccaugaugggaaggcauggcuccacguguguguaacuggagacgauaaaaaugccaccgcuucuuucaucuaugacggcaggcugguugauagcaucggcuccuggucacagaacauucugcggacacaagagagugaaugcguguguauaaaugggaccugcacggucgugaugacugacggaagcgcaucuggucgcgccgauacaagaauccucuuuauugaggagggcaagaucgugcacauauccccuuuaucagggagcgcucagcaugucgaagagugcaguuguuacccaagguauccgggaguucggugcauuugucgcgacaacuggaaaggcucuaaucgacccgugguagacaucaacgugaaggauuacuccaucgacagcagauacgucugcucgggucuggugggggauaccccuaggaacaaugaccggucuuccaacucaaauugucguaacccaaauaacgauaagggaaaucacggcguuaaaggcugggccuucgacgaugggaacgacguguggaugggacgcacuauuaguaaggauagcagauccgguuaugaaacauuuaaagucaucggcggguggucuacccccaauagcaagucacagauuaacaggcaagugauaguagacagugauaaucgguccggauacagcggcaucuucucuguugaggguaaaucaugcauuaaccgauguuuuuauguggaacuuauccgcgggagagagcaggagacgagggucugguggaccaguaauagcaucguggucuucugcggcacauccggaacuuacggcaccgggucuuggccugacggagcggacauuaacuugaugccaauauga

SEQ ID NO: 136130 - RNA, 1410 nt, Artificial Sequence
  derived and/or modified sequence opt3 from neuraminidase__InfluenzaA__AAO46483
augaaccccaaucagaagaucauuaccauaggcagcgugucccugacaaucgccacugucugcuuccucaugcaaauugcuauccuuguuacgaccgugacacugcacuuuagacaguacgagugugacucuccugcaaacaaucagguaaugccaugcgaaccgauuaucauagagaggaacaucacugaaauuguguauuugaauaacaccacaaucgagaaagaaauuugucccaaguuagucgaguaccggaauuggucaaaaccucagugcaagaucaccggguucgccccauuuaguaaagauaacagcauacgccuguccgcgggaggugacauuugggugacucgagagcccuauguuucuugugauccuggcaagugcuaccaauucgcucuagggcagggaacaacccucgacaauaagcauucgaacgauacgauccacgaccguauuccacauagaacucugcuuaugaaugaacugggcgugcccuuucacuuggguaccaggcaggucuguaucgccuggucaagcaguuccugccaugaugggaaagcauggcuccacguguguguaacaggagacgauaagaacgccacugcuucuuucaucuaugacggccggcugguugauagcauuggcuccuggucacagaauauacugcgcacccaagagagugaaugcguguguaucaacgggacaugcaccgucgugaugacggacggaagcgcaucugguagagccgauacuaggauucucuuuaucgaggagggcaaaauagugcacauuuccccuuuaucagggagcgcucagcaugucgaagagugcaguuguuacccacgguauccgggaguucgcugcaucugucgagacaauuggaagggcucuaacagacccgugguagacaucaacguggaagauuacuccauugacagcucguacgucugcucuggucuggugggggauacaccuaggaauaacgaccgguccucaaauaguaacugucguaauccaaacaaugagcgcggaaaccacggcguuaaaggcugggccuucgaugacgggaaugauguguggaugggaagaaccaucagcaaggaccuuagguccgguuaugaaacuuuuaaggucauuggcggguggucuacacccaacagcaaaucacagauaaaucgacaggugaucguagauagugacaaccgguccggauacagcggcauuuucucuguugaggguaagucaugcaucaaucgcuguuuuuauguggaguugaucagagggagggaacaagagacccgggucugguggacgaguaacagcauuguggucuucugcggcaccuccggaacauacggcacugggucuuggccugauggagcggacauaaaucugaugccaaucuga

SEQ ID NO: 136131 - RNA, 1410 nt, Artificial Sequence
  derived and/or modified sequence opt3 from neuraminidase__InfluenzaA__AAO46485
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaaacaaucagguaaugccaugcgaaccgauuaucauagagagaaacaucacugaaauuguguauuugaccaauacaaccaucgagaaggaaauuugucccaaauuagucgaguacaggaacuggucaaagccucagugcaaaaucacuggguucgccccauuuaguaaggauaauagcauacggcuguccgcgggaggugacauuugggugacacgcgagcccuauguuucuugugauccuggcaagugcuaccaauucgcucuagggcagggaaccacgcucgacaacaaacauucgaaugauacuauccacgaccgaaucccacaucguacccugcuuaugaacgaacugggcgugcccuuucacuuggguacaagacaggucuguauugccuggucaagcaguuccugccaugaugggaaggcauggcuccacguguguguaacuggagacgauaaaaaugccaccgcuucuuucaucuaugacggcaggcugguugauagcauuggcuccuggucacagaacauacugcggacacaagagagugaaugcguguguaucaaugggaccugcacggucgugaugacugacggaagcgcaucuggucgcgccgauacaaggauucucuuuaucgaggagggcaagauagugcacauuuccccuuuaucagggagcgcucagcaugucgaagagugcaguuguuacccaagguauccgggaguucggugcaucugucgcgacaacuggaaaggcucuaaucgacccgugguagacaucaacgugaaggauuacuccauugacagcagauacgucugcucgggucuggugggggauaccccuaggaacaaugaccggucuuccaacucaaauugucguaacccaaauaacgauaagggaaaucacggcguuaaaggcugggccuucgacgaugggaacgacguguggaugggacgcacuaucaguaaggauagcagauccgguuaugaaacauuuaaagucauuggcggguggucuacccccaauagcaagucacagauaaacagacaggugaucguagacagugauaaucgguccggauacagcggcauuuucucuguugaggguaaaucaugcaucaaccgauguuuuuauguggaacuuauccgcgggagagagcaagagacgagggucugguggaccaguaauagcauuguggucuucugcggcacauccggaacuuacggcaccgggucuuggccugacggagcggacauaaacuugaugccaaucuga

SEQ ID NO: 136132 - RNA, 1410 nt, Artificial Sequence
  derived and/or modified sequence opt3 from neuraminidase__InfluenzaA__AAO46486
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaucccacaucguacccugcuuaugaacgaacugggcguucccuuucacuuggguacaagacagguguguaucgccuggucaagcaguuccugccaugaugggaaggcauggcuccacgucugugugacuggagacgauaaaaaugccaccgcuucuuucauuuaugacggcaggcugguagauagcauaggcuccuggucacagaacauccugcggacacaagagagugaaugcguuuguauuaaugggaccugcacgguggucaugacugacggaagcgcaucuggucgcgccgauacaagaauccucuuuauagaggagggcaagauugugcacaucuccccuuuaucagggagcgcucagcauguggaagagugcaguuguuacccaagguauccgggaguccggugcaucugucgcgacaacuggaaaggcucuaaucgacccguuguggacauuaacguaaaggauuacuccaucgacagcucguacgugugcucuggucuggucggggauaccccuagaaacaaugacagguccucaaacaguuauugucggaauccaaacaaugaacguggaaaccacggcgugaagggcugggccuucgaugacgggaaugauguuuggaugggacgcacuauuagcaaagacuccagaucugguuacgagacauuuaaggugauaggcggguggagcacccccaacucaaaaagucagaucaauaggcaggucauuguggauuccgacaaccggagcggauauucuggcaucuucucaguagaagguaagaguugcaucaaucgauguuuuuacguugagcuuauucgcgggagagagcaagaaacgagggugugguggaccagcaacuccauagucguguucugcggcacaucuggaacuuauggcaccgggucguggccugauggagcggacaucaauuugaugccaauuuga

SEQ ID NO: 136133 - RNA, 1410 nt, Artificial Sequence
  derived and/or modified sequence opt3 from neuraminidase__InfluenzaA__AAO46489
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucaacaauaaacauucgaacgacacuauucacgaucgaaucccacaucguacccugcuuaugaaugaacugggcguucccuuucacuuggguacaagacagguguguaucgccuggucaagcaguuccugccaugacgggaaggcauggcuccacgucugugugacuggagaugacaaaaacgccaccgcuucuuucauuuaugauggcaggcugguagacagcauaggcuccuggucacagaauauccugcggacacaagagagugaaugcguuuguauuaacgggaccugcacgguggucaugacugauggaagcgcaucugguaaggccgacacacgcauccucuuuauagaggagggcaaaauugugcacaucuccccuuuaucagggagcgcucagcauguggaagagugcaguuguuacccaagauauccgggagucaggugcaucugucgggauaauuggaagggcucuaaccgccccguuguggacauuaacguaaaggacuacuccaucgauagcucguacgugugcucuggucuggucggggacaccccucgaaauaacgauagauccucaaguagcuauuguaggaauccaaacaaugaacggggaaaccacggcgugaaaggcugggccuucgacgaugggaaugacguuuggaugggacguacuauuuccaaggauucucgcagcgguuacgagacauuuaaagugauaggcggguggucaacccccaacaguaagucccagaucaauagacaggucauuguggacagcgauaacaggucuggauauucaggcaucuucaguguagaagguaaaagcugcaucaaucgguguuuuuacguugagcuuauucgagggcgcgagcaagaaacgagagugugguggaccuccaacucuauagucguguucugcggcacaucgggaacuuauggcaccgggagcuggccugacggagcggauaucaauuugaugccaauuuga

SEQ ID NO: 136134 - RNA, 1410 nt, Artificial Sequence
  derived and/or modified sequence opt3 from neuraminidase__InfluenzaA__AAO46491
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaccccacaucguacacugcuuaugaacgaacugggcguucccuuucacuuggguacuagacagguguguaucgccuggucaagcaguuccugccaugaugggaaggcauggcuccacgucugugugaccggauaugacaaaaaugccacagcuucuuucaucuacgauggcaggcugguagacagcauuggcuccuggucacagaacauacugcggacccaagagagugaaugcguuuguaucaaugggacgugcacuguggucaugacagauggaagcgcaucuggucgcgccgacaccaagauucucuuuaucgaggagggcaaaauagugcacauuuccccuuuaucagggagcgcucagcauguggaagagugcaguuguuauccaagauacccgggagucaggugcaucugucgggauaacuggaagggcucuaaucgccccguuguggacaucaacguaaaggacuacuccauugauagcucguaugugugcucuggucuggucggggacacuccucgaaacaaugauagauccucaaacaguuacuguaggaauccaaacaaugaaaaaggaaaccacggcgugaagggcugggccuucgacgaugggaaugacguuuggaugggacggacaaucagcgaggauucccguucugguuaugaaaccuuuaaagugauuggcggguggagcacgcccaacucaaaacuucagauaaaucgccaggucaucguggacagugauaacagauccggauacagcggcauuuucucuguagaggguaagucaugcaucaauagguguuuuuauguugaguugauccgggggcgagaacaagagacccgcgugugguggacaaguaacagcauugucguguucugcggcacuuccggaaccuacggcacagggucuuggccugacggagcggauauaaaucugaugccaaucuga

SEQ ID NO: 136135 - RNA, 1410 nt, Artificial Sequence; identical to SEQ ID NO: 136134
  derived and/or modified sequence opt3 from neuraminidase__InfluenzaA__AAO46492

SEQ ID NO: 136136 - RNA, 1410 nt, Artificial Sequence
  derived and/or modified sequence opt3 from neuraminidase__InfluenzaA__AAO88264
augaacaccaaucagagaaucauuacaauaggcacugugugccugaucgucgggauuguuagccuccuucugcaaaucggaaacauuguguccuuguggaucucucacucaauacagacggguaagaaaaauuacaguaagaucuguagcaaauccguaauuaccuaugagaacaauacaugggugaaccagacuuacgucaauaucucuaacauuaauaucgccgacggccagggggugaacucgauaauuuuagcuggaaauucaagccugugccccaucaguggcugggcaauuuauuccaaggauaacucuaucaggaucgguagcaaaggggacauuuucguuauacgggaaccuuuuaucuccuguucacaucuagagugccgcaccuucuuucucacacaaggagcccugcuuaaugaucgacacaguaacggcaccgugaaggaccguagcccauacagaacucugaugucuuguccgauuggcgaagcgcccuccccuuauaauucaagguucgagagcgucgcuuggagugccucugcaugccaugaugggaugggaugguugacaaucgguauauccggcccagacaacggggccguggcuguacucaaguacaacggaauuaucaccgauacgaucaaaagcuggcggaauaagauucugcgcacucaggaaucggaguguguuugcaucaacggcucuuguuuuaccauuaugacagacggucccuccaaugggcaggcaucauauaaaauauucaagauggagaaaggaaagaucauuaagaguguggaacuggaugccccuaacuaccacuacgaggaaugcagcuguuauccagacacuggcaaagucgugugcgugugcuccgauaauuggcaugcuucuaacagacccugggucagcuuugaccagaaucucgauuaccaaaucggcuauaucuguucagggguuuucggagacaacccuaggaguaaugacggucggggcaacugcgggccaguguuauccaauggagccaacggcguaaaggguuuuagcuuccgcuacgggaauggcguguggauuggacgaaccaaaucuauaucaaguagaagcggcuuugagaugaucugggauccgaacggguggacagagaccgacuccucuuucucgauuaagcaggaugucaucgcgcugacggacuggagcggauauuccgguucauuugugcagcaccccgaacuuacuggcaugaauuguauuaggccuugcuucuggguugaguugauccgggggcagccaaaagaaaguacaauauggaccucuggaagcuccaucucauucuguggcguggauagcgagacugcaucuugguccuggcccgacggugccgaucugccuuuuacaauugacaaguga

SEQ ID NO: 136137 - RNA, 1410 nt, Artificial Sequence
  derived and/or modified sequence opt3 from neuraminidase__InfluenzaA__AAQ10334
augaaccccaaucagaagaucauuaccauaggcagcgugucccugacaaucgccacuauuugcuuccucaugcaaaucgcuauucuugucacgaccguuacacugcacuuuaaacaguacgaguguaacccuccaccgaauaaccaggugauguugugcgaacccacuaucauagagagaaauaucaccgaaauuguauauuuaacaaacaccacuaucgagaaggaaauuuguccuaaacuggcagaguacaggaauuggucuaagccacagugcaaaaucacaggguucgcccccuuuucaaaggacaacaguauacggcuaagcgcgggaggugauauuugggugacccgcgagccuuaugucuccugugacccaggcaagugcuaccaauucgcucucgggcagggaacgacucugaauaaccgacauucuaaugauaccgugcacgaccguacacccuauagaacucuucugaugaacgaauugggcguuccuuuucaucucgguaccaaacagguguguaucgccuggucgucaagcaguugccacgaugggaaggcauggcugcaugucugugugacaggacacaaugagaacgccaccgcuuccuucauuuacaauggcaggcugguagacucuaucggcagcugguccaaaaacauccuccggacgcaggaaucagagugcguuuguauuaacgggacuugcacaguggucaugaccgauggaagugcaagcggucgcgccgacacuaagauauuauuuaucgaggaaggcaaaauugugcacaucucuccacuguccgggucagcucaacauguggaggaaugcagcuguuauccgagauaccccggagucaggugcguuugucgggauaauuggaagggcaguaaccgcccuauaguggacauuaauguaaaggauuacucuaucguguccagcuaugucugcucgggucuugugggggacacaccacggaaaaacgauucuuccucaaguagcuacuguuugaaucccaacaaugaggaaggaggccacggcguuaaggggugggccuucgacgacggaaacgauguguggauggguagaaccaucuccgagaaacugaggucuggcuaugagacguuuaaggucauugggggauggagcaaaccuaauucaaagcuacagaucaaccgacaggugauuguagaccguggcaaucgcagugguuacuccgggauauucagcguugaaggcaaaucuugcaucaacagauguuuuuauguggagcucauuaggggacggaagcaggaaaccgaggucugguggacaucaaauaguaucguggucuucugcggcacuagcgggaccuacggaacagguuccuggccagauggcgcggacaucaaccugaugcccauuuga

SEQ ID NO: 136138 - RNA, 1410 nt, Artificial Sequence; identical to SEQ ID NO: 136137
  derived and/or modified sequence opt3 from neuraminidase__InfluenzaA__AAQ10335

SEQ ID NO: 136139 - RNA, 1410 nt, Artificial Sequence
  derived and/or modified sequence opt3 from neuraminidase__InfluenzaA__AAQ10336
augaaccccaaucagaagaucauuaccauaggcagcgugucccugacaaucgccacuauuugcuuccucaugcaaaucgcuauucuugucacgaccguuacacugcacuuuaaacaguacgaguguaacccuccaccgaauaaccaggugauguugugcgaacccacuaucauagagagaaauaucaccgaaauuguauauuuaacaaacaccacuaucgagaaggaaauuuguccuaaacuggcagaguacaggaauuggucuaagccacagugcaaaaucacaggguucgcccccuuuucaaaggacaacaguauacggcuaagcgcgggaggugauauuugggugacccgcgagccuuaugucuccugugacccaggcaagugcuaccaauucgcucucgggcagggaacgacucugaauaaccgacauucuaaugauaccgugcacgaccguacacccuauagaacucuucugaugaacgaauugggcguuccuuuucaucucgguaccaaacagguguguaucgccuggucgucaagcaguugccacgaugggaaggcauggcugcaugucugugugacaggacacaaugagaacgccaccgcuuccuucauuuacaauggcaggcugguagacucuaucggcagcugguccaaaaacauccuccggacgcaggaaucagagugcguuuguauuaacgggacuugcacaguggucaugaccgauggaagugcaagcggucgcgccgacacuaagauauuauuuaucgaggaaggcaaaauugugcacaucucuccacuguccgggucagcucaacauguggaggaaugcagcuguuauccgagauaccccggagucaggugcguuugucgggauaauuggaagggcaguaaccgcccuauaguggacauuaauguaaaggauuacucuaucguguccagcuaugucugcucgggucuugugggggacacaccacggaaaaacgauucuuccucaaguagcuacuguuugaaucccaacaaugaggaaggaggccacggcguuaaggggugggccuucgacgacggaaacgauguguggauggguagaaccaucuccgagaaacugaggucuggcuaugagacguuuaaggucauugggggauggagcaaaccuaauucaaagcuacagaucaaccgacaggugauuguagaccguggcaaucgcagugguuacuccgggauauucagcguugaaggcaaaucuugcaucaacagauguuuuuauguggagcucauuaggggacggaagcaggaaaccgaggucugguggacaucaaauaguaucguggucuucugcggcacuagcgggaccuacggaacagguuccuggccagauggcgcggaaaucaaccugaugcccauuuga

SEQ ID NO: 136140 - RNA, 1410 nt, Artificial Sequence; identical to SEQ ID NO: 136137
  derived and/or modified sequence opt3 from neuraminidase__InfluenzaA__AAQ10337

SEQ ID NO: 136141 - RNA, 1410 nt, Artificial Sequence
  derived and/or modified sequence opt3 from neuraminidase__InfluenzaA__AAQ10339
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaaggcugguagauagcaucggcuccuggaguaaaaagauccuccggacgcaggaaagugagugcguuuguauuaacggcacuugcacaguggucaugaccgacgggagcgcaucuggacgcgccgauacuaaaauauuauuuaucgaggaagguaagauugugcacaucuccccucugucaggcagcgcucaacauguggaggaaugcaguuguuauccaagauacccgggggucaggugcguuugucgggacaauuggaagggaucuaaccgccccauaguggauauuaacguaaaagacuacuccaucgugagcucguaugucugcucuggccuugugggugacacaccucgaaagaaugauuccucaaguagcucccacuguuugaacccaaauaacgaggaagggggacauggcguuaaaggcugggccuucgacgaugggaaugacguguggaugggaagaaccaucucugagacgcugaggagcgguuacgagaccuuuaaggucauugaaggcuggucaaaacccaacaguaagcuacagaucaaucgucaggugauuguagaucgggggaaccgcuccggauauagcggcauauucucuguugaggguaaaucaugcaucaauagauguuuuuacguggaacucauuagggggcggaagcaggagacagaagucugguggacuucaaacagcaucguggucuucugcggcaccuccggaacauauggcacugggucuuggccugacggagcggauaucaaucugaugccaauuuga

SEQ ID NO: 136142 - RNA, 1410 nt, Artificial Sequence
  derived and/or modified sequence opt3 from neuraminidase__InfluenzaA__AAQ10341
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaaggcugguagauagcaucggcuccuggaguaaaaagauccuccggacgcaggaaucagagugcguuuguauuaacggcacuugcacaguggucaugaccgacgggagcgcaucuggacgcgccgauacuaaaauauuauuuaucgaggaagguaagauugugcacaucuccccucugucaggcagcgcucaacauguggaggaaugcaguuguuauccaagauacccgggggucaggugcguuugucgggacaauuggaagggaucuaaccgccccauaguggauauuaacguaaaagacuacuccaucgugagcucguaugucugcucuggccuugugggugacacaccucgaaagaaugauuccucaaguagcucccacuguuugaacccaaauaacgaggaagggggacauggcguuaaaggcugggccuucgacgaugggaaugacguguggaugggaagaaccaucucugagaagcugaggagcgguuacgagacguuuaaagucauugaaggcuggucaaagcccaacaguaaacuacagaucaaucgucaggugauuguagaucgggggaaccgcuccggauauagcggcauauucucuguugaggguaagucaugcaucaauagauguuuuuacguggaacucauuagggggcggaagcaggagaccgaagucugguggacaaguaacagcaucguggucuucugcggcacuuccggaaccuauggcacagggucuuggccugacggagcggauaucaaucugaugccaauuuga

SEQ ID NO: 136143 - RNA, 1410 nt, Artificial Sequence
  derived and/or modified sequence opt3 from neuraminidase__InfluenzaA__AAQ10343
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaaaaucacaggguucgccccauuuagcaaggacaauuccauacggcuaucugcgggaggugauauuugggugacccgcgagcccuaugucucgugugacccugauaagugcuaccaauucgcucucggccaggggacgacucugaacaaucgacauucaaacgacaccgugcacgaucguacaccauauagaacucuucugaugaaugaauugggaguucccuuucaucucggcaccaaacagguguguaucgccuggagcaguuccucuugccacgacgguaaggcauggcugcaugucugugugacagggcacgaugagaacgccaccgcuagcuucauuuacgacggaaggcugguagauuccaucggcucauggaguaaaaagauccuccggacgcaggaaagcgagugcguuuguauuaauggcacuugcacaguggucaugaccgacgggucugcauccggacgcgccgauacuaaaauauuauuuaucgaggaagguaagauugugcacaucucaccucugagcggcagugcucaacauguggaggaaugcucuuguuauccaagauacccgggggucaggugcguuugucgggacaacuggaagggauccaaucgccccauaguggauauuaacguaaaagacuacagcaucgugucgucuuaugucugcuccggccuugugggugacacaccucgaaagaacgauucaaguagcuccucucacuguuugaauccaaacaaugaggaagggggacauggcguuaaaggcugggccuucgacgaugggaacgacguguggaugggaagaaccaucagcgagaaguuuaggucagguuacgagacguucaaagucauugaaggcuggaguaagcccaauuccaaacugcagaucaaccgucaggugauuguagaucgggggaaucgcagcggauauucuggcauauuuucaguugaggguaagaguugcaucaacagauguuucuacguggaacuaauuagggggcggaagcaggagaccgaagucugguggacaagcaauuccaucguggcguuuugcggcacuucuggaaccuauggcacagggucguggccugacggagcagauaucaaccucaugccaauuuga

SEQ ID NO: 136144 - RNA, 1191 nt, Artificial Sequence
  derived and/or modified sequence opt3 from neuraminidase__InfluenzaA__AAQ10344
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggcaauguugugcgaaccgacuaucauagagagaaauaucaccgaaauuguguauuuaacaaacaccacuaucgagaaggaaauuugucccaaacuggccgaguacaggaauuggucaaagccucagugcaaaaucacaggguucgcgccauuuaguaaggacaacagcauacggcuauccgcuggaggugauauuuggguaacccgcgagcccuaugugucuugugacccugauaagugcuaccaauucgcccucggccaggggacgacucugaauaaccgacauucgaaugacaccguccacgaucguacaccauauagaacucuucugaugaacgaauugggagugcccuuucaucucggcaccaaacagguuuguaucgcauggucaagcaguuccugccacgacgguaaggccuggcugcaugugugugucacagggcacgaugagaaugcuaccgcaucuuucauuuacgacggaaggcugguggauagcaucggcuccuggaguaaaaagauccuccggacgcaggaaucagagugcguauguauuaacggcacuugcacaguugugaugaccgacgggagcgccucuggacgcgcugauacuaaaauauuauuuaucgaggaagguaagauuguccacacauccaagcugucaggcagcgcccaacauguggaggaaugcaguuguuauccuagauacccaggggugaggugcgucugucgggacaauuggaaaggaucuaaccgcccgaucguugauauaaacgugaaggacuacuccauuguaagcucguaugugugcucuggccuugucggugacacccccagaaagaaugauuccucaaguagcucccacuguuugaacccuaauaacgaggaagggggacauggcgugaaaggcugggcguucgacgaugggaaugacguuuggaugggacgaacgaucucugagaaauuuaggagcgguuacgagaccuucaaggugaucgaaggcuggucaaaaccaaacaguaagcugcagauuaauuccaagagcuga

SEQ ID NO: 136145 - RNA, 1416 nt, Artificial Sequence
  derived and/or modified sequence opt3 from neuraminidase__InfluenzaA__AAR11366
augaaccccaaucagaagcuguucgcccucagcggcguggcuaucgcacuuuccguccugaacuuguuaauugggauaucuaauguuggacugaacgugucacuacaccucaaagagaaggguccuaaacaagaagagaaucugaccugcacaacuaucaaccagaauaacacgaccguaguggaaaauacauacgucaacaauacuaccauuaucacaaagggcaccgaccuuaaaacuccaaguuaucuguugcucaacaagagccuguguaauguggagggguggguugugauugccaaggauaacgcggucagauuuggagaauccgagcagaucauagugacaagggagccguacguaucuugcgaccccaccggcuguaaaauguaugcucugcaucaggguacgacuauccggaauaagcacucgaacgggaccauucaugaucgcacagccuuccgaggacucaucucaacuccuuuaggcaccccacccacaguuagcaacagugacuuuaugugcgugggcugguccucuaccacgugucacgaugggauugcacguaugacuaucugcauacaaggaaauaacgacaaugccacagcuaccgucuacuauaacagaaggcugacuacaaccauuaaaacgugggcacggaauauccuucgcacccaggaaagcgagugugugugccauaacgguacaugugccguggucaugacugauggcuccgcuucaagucaggccuacaccaagguuauguauuuccacaaaggguuggugguaaaggaagaggagcugagaggaagcgcgaggcacauugaagagugcucuuguuacggccauaaucagaaggugacaugcgucugccgggacaacuggcaaggugcaaaucgcccuaucaucgaaauugauaugaacacucuagagcacaccucccgauacguguguacagggauacucaccgacacuucaagaccaggagauaaaagcaguggcgacugcucuaaucccaucacgggcuccccuggggccccaggaguuaaggguuuuggcuuccugaacggggauaauacauggcuuggaaggaccauuagcccgcggucgcguucuggcuuugaaaugcugaaaauccccaacgcugguacugacccuaauucccgcauagccgagagacaggagauuguggacaacaacaauuggucaggguauaguggcagcuucaucgauuacuggaacgacaauuccgaauguuauaacccaugcuuuuacgucgaguugaucaggggacggcccgaagaggcaaaguaugugugguggaccucuaauagccucauugcucuguguggcucaccuuucccaguagggcccggaaguuuuccggauggugcccagauccaguacuucuccuga

SEQ ID NO: 136146 - RNA, 1350 nt, Artificial Sequence
  derived and/or modified sequence opt3 from neuraminidase__InfluenzaA__AAS89005
augaaccccaauaagaaaaucauuaccauaggcagcaucugcauggugacagggauggucucccugaugcuccagauuggaaaccuuaucucuauuuggguuucacacaguauccauacugguaaucaacagaaggccgagccuauaagcaacacgaauuuccugaccgaaaaagcuguggcauccguaaaguuggccggcaacucuucguuauguccaaucaaugggugggcgguguacucaaaagacaacagcauuagaaucggaaguaagggcgaugucuuugugauuagggagccguucaucuccugcucucaccuggaaugucggacauuuuuccuaacucagggugcucuccugaaugacaagcauagcaacgggaccguuaaagaucgcagcccccaccgaacacuuaugucaugcccugugggagaggccccaagucccuauaauagccguuuugaaucugucgcaugguccgccucagcuugucaugacggcaccagcuggcugacuauaggcauuagugggccugauucuggagcaguggccguauugaaguacaacgguaucauuacagacaccaucaaauccuggagaaauaacauccucaggacgcaggagagcgagugcgcuuguguuaauggcucgugcuucacugugaugaccgaugggccaucuaacggacaagccucccacaagauuuuuaaaauggaaaagggcaaggucgugaaaucaguggagcuggacgcgcccaacuaucacuacgaagaguguaguugcuauccugaugccggugagauaacaugugucugccgggacaauuggcaugggagcaaccgcccauggguuuccuucaaucagaaccuggaauaccagaucggauauauuugcucuggcguguuuggcgauaauccgagacccaacgacgggacuggaagcugugguccuguaucaaguaauggcgcauacggggugaagggauucuccuuuaaauacggcaacggugucuggaucgggaggaccaagagcacaaauucucggucaggcuucgagaugauaugggauccaaacggauggauugaaaccgacaguagcuuuuccgugaaacaggacaucguugcuaucacggauuggucuggcuauucggggagcuucgugcaacaccccgagcucacuggauuagacugcauucgcccuuguuucugggucgaacugauccgagguagaccaaaggaguccacaauuuggaccucaggcaguucuauauccuuuugcgggguaaauuccgauacugugggauggucauggcccgacggcgccgagcuuccguucacaaucgauaaauga

SEQ ID NO: 136147 - RNA, 1350 nt, Artificial Sequence
  derived and/or modified sequence opt3 from neuraminidase__InfluenzaA__AAS89006
augaaccccaauaagaaaaucauuaccauaggcagcaucugcauggugacagggauggucucccugaugcuccagauuggaaaccuuaucucuauuuggguuucacacaguauccauacugguaaucaacacaaggccgagccuauaagcaacacgaauuuccugaccgaaaaagcuguggcauccguaaaguuggccggcaacucuucguuauguccaaucaaugggugggcgguguacucaaaagacaacagcauuagaaucggaaguaagggcgaugucuuugugauuagggagccguucaucuccugcucucaucuggaaugucggacauuuuuccuaacucagggugcucuccugaaugacaagcacagcaacgggaccguuaaagaucgcucaccccaucgaacacuuauguccugcccugugggagaggccccaagucccuauaauagccguuuugaaucugucgcaugguccgccucagcuugucacgacggcaccagcuggcugacuauaggcauuagugggccugauaacggagcaguggccguauugaaguacaaugguaucauuacagacaccaucaaaucuuggagaaacaauauccucaggacgcaggaguccgagugcgcuuguguuaacggcagcugcuucacugugaugaccgaugggccaucgaacggacaggccucucacaagauuuuuaaaauggaaaagggcaaggucgugaaauccguggagcuggacgcgcccaauuaucauuacgaagaguguucaugcuauccugaugccggugagauaacaugugucugccgggacaacuggcacgggaguaaucgcccauggguuagcuucaaccaaaaucuggaauaccagaucggauauauuugcuccggcguguuuggcgauaacccgagacccaaugacgggacuggaucuugugguccuguaagcucaaacggcgcauacggggugaagggauucaguuuuaaauacggcaauggugucuggaucgggaggaccaaguccacaaacagccggucuggcuucgagaugauaugggauccaaauggauggaccgaaacggacucaaguuuuagcgugaaacaggacauuguugcuaucacugauugguccggcuauucugggucguucgugcagcaucccgagcucacaggauuagacugcauccgcccuuguuucugggucgaacugauucgagguagaccaaaggagagcaccaucuggacuuccggcucaaguauuucuuuuugcggggugaacagcgauacaguaggaugguccuggcccgacggcgccgagcuuccguucaccauagauaaauga

SEQ ID NO: 136148 - RNA, 1410 nt, Artificial Sequence
  derived and/or modified sequence opt3 from neuraminidase__InfluenzaA__AAT38822
augaaccccaaucagaagaucauuaccauaggcguggucaacacaacucugagcacgaucgcccucuucauugggguuggaaaucuuguguuuaacaccguaauccacgagaaaauuggugaccaucaaaucgugacacacccuacuauaaugaccccagaagucccgaauugcuccgauacaaucauuaccuacaacaauacugugaucaacaauauuacaaccacgaucauaacugaggcugaaagacccuucaagucuccucugccauugugucccuuuaggggcuucuuuccuuuccauaaagacaacgcaauucgguuaggggagaauaaggauguuaucgugacccgcgaaccauaugucucaugcgacaacgauaauuguuggaguuuugcccuggcgcagggagcucuacucggcacaaaacacagcaacgguacuauuaaggaccgaacccccuaccguucccugaucagauucccuaucgggacagccccagugcuuggaaauuauaaggagauuugcauagcauggucuucgucaagcuguuuugauggcaaagaguggaugcauguaugcaugaccggcaacgacaacgaugccagugcucagaucauuuacgggggaaggaugacggacuccaucaagucuuggcggaaagauauacugcgcacucaggaaagcgagugucaaugcauugacgguacauguguuguggcagucaccgauggcccggccgcuaauuccgccgaccacagaguguauuggaucagggaagggcggaucauuaaguacgagaacgugcccaaaacuaagauccagcacuuggaggaaugcucauguuaugucgacauugauguuuacugcauaugccgcgacaauuggaagggaaguaaccgaccuuggaugagaaucaauaacgagacaauucucgaaaccggcuacguguguagcaaauuccauucugauacgccaaggcccgcggacccuuccaucaugucaugcgauagcccaaguaauguaaacggugggcccggagugaagggcuuuggcuucaaagcagggaaugacgucuggcugggacggaccgugucuacauccggucguagcggcuuugagaucauuaagguuacugaaggguggauaaacucgccgaaucacgugaaaucuaucacccagacacuggucuccaacaaugauuggucaggauauaguggcagcuucauugugaaggccaaagacuguuuccagccuugcuuuuacguagagcucauccgcgguagacccaacaagaaugaugacguuuccuggacuucuaacagcauugugaccuucuguggguuagauaacgagccaggcucaggaaauuggccugacggcaguaacaucggguuuaugcccaaguga

SEQ ID NO: 136149 - RNA, 1350 nt, Artificial Sequence; identical to SEQ ID NO: 136147
  derived and/or modified sequence opt3 from neuraminidase__InfluenzaA__AAV65827

SEQ ID NO: 136150 - RNA, 1410 nt, Artificial Sequence
  derived and/or modified sequence opt3 from neuraminidase__InfluenzaA__AAX11488
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauugugcacaucuccgcccugucagggagcgcgcaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacuccccgcaagaaugauuccuucucaaguagccacuguuuggacccuaacaaugaagagggaggccauggcguuaaagggugggcauuugaugacggaaacgauguguggaugggucgaacaaucuccgaaaagcugagaucuggcuaugagaccuucaaagucauugagggguggagcaagccaaauucaaaacuacagaucaacaggcaagugauuguagaacggggaaaucguaguggcuacuccgguauauuuagcguugaggggaagucuugcaucaaccgcuguuucuauguggaacucauuagaggcaggaaggaggaaacggaggucugguggaccucaaauaguaucguggucuuuugcggaacaagcggcacuuacgggaccggauccuggcccgacggugccgauaucaaccugaugccuauuuga

SEQ ID NO: 136151 - RNA, 1410 nt, Artificial Sequence
  derived and/or modified sequence opt3 from neuraminidase__InfluenzaA__AAX11508
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacaauaccgugcaugaccgaacaccauaccguacucuucugaugaacgaauugggcguucccuuucaccucgguaccagacagguguguaucgccuggucaagcaguuccugccaugaugggaaggcauggcugcacgucugugugacaggagacgauaaaaaugccaccgcuucuuucauuuauaacggcaggcugguagacagcaucggcuccuggucaaagaaaauccuccggacgcaggagagugaaugcguuuguauuaacgggacuugcacaguggucaugaccgauggaagcgcaucugguaaggccgacacuaaaauauuauuuaucgaggagggcaagauugugcacaucuccacacugucagggagcgcucaacauguggaagagugcaguuguuacccucgcuauccaggagucagaugcguuuguagggauaauuggaagggcucuaaccggccgauaguggacauuaauguaaaagauuacuccaucgugagcucguacgucugcucuggucuugugggggacacccccaggaagaacgacuccuucucaaguagccacuguuuggauccuaauaacgaagagggaggccauggcguuaaagggugggccuuugacgauggaaaugacguguggaugggucgaacgaucuccgaaaagcugagaucuggcuaugagaccuucaaagucauugagggguggagcaagccaaacucaaaacuacagaucaaucgccaggugauuguagaacggggaaaccguaguggcuacuccgguauauuuagcguugaggggaagucuugcaucaaucgcuguuucuauguggaacucauuagaggcaggaaggaggaaacagaggucugguggacuucaaacaguaucguggucuuuugcggaaccagcggcacauacgggacuggauccuggcccgauggugcggacaucaaucugaugccuauuuga

SEQ ID NO: 136152 - RNA, 1410 nt, Artificial Sequence
  derived and/or modified sequence opt3 from neuraminidase__InfluenzaA__AAX11538
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaacgaacaccauaccguacucuucugaugaaugaguugggcguucccuuucaccucgguaccagacagguguguaucgccuggucaagcaguuccugccaugaugggaaggcauggcugcacgucugugugacaggagacgauaaaaacgccaccgcuucuuucauuuauaauggcaggcugguagacagcaucggcuccuggucaaagaaaauccuccggacgcaggaaagugagugcguuuguauuaacgggacuugcacaguggucaugaccgauggaagcgcaucugguaaggccgacacuaaaauauuauuuaucgaggaaggcaagauugugcacaucuccacacugucagggagcgcucaacauguggaggaaugcaguuguuacccucgcuauccaggagucagaugcguuuguagggauaacuggaagggcucuaaucggccgauaguggacauuaacguaaaagauuacuccaucgugagcucguacgucugcucuggucuugugggggacacccccaggaagaaugacuccucaaguagcucccacuguuuggauccuaacaaugaggaaggaggccauggcguuaaagggugggccuucgacgauggaaacgacguguggaugggucgaacgaucucugagaagcugagaagcggcuaugagaccuuuaaagucauugaaggguggucaaagccaaauaguaaacuacagaucaaccgccaggugauuguagagcggggaaaucguuccggcuacagcgguauauucucuguugaagggaagucaugcaucaaccgcuguuuuuauguggagcucauuagaggcaggaaggaagagacagaggucugguggaccaguaauagcaucguggucuucugcggaacuuccggcacauacgggacuggaucuuggcccgauggugcggacaucaaccugaugccuauuuga

SEQ ID NO: 136153 - RNA, 1410 nt, Artificial Sequence
  derived and/or modified sequence opt3 from neuraminidase__InfluenzaA__AAX11548
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaucgaacaccauaccguacucuucugaugaaugaauugggcguucccuuucaccucgguaccagacagguguguaucgccuggucaagcaguuccugccaugacgggaaggcauggcugcacgucugugugacaggagaugacaaaaacgccaccgcuucuuucauuuauaauggcaggcugguagauagcaucggcuccuggucaaagaaaauccuccggacgcaggagagugaaugcguuuguauuaacgggacuugcacaguggucaugaccgacggaagcgcaucugguaaggccgauacuaaaauauuauuuaucgaggagggcaagauugugcacaucuccacacugucagggagcgcucaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacccccaggaagaaugauuccucaaguagcucccacuguuuggacccuaacaaugaagagggaggccauggcguuaaagggugggccuucgaugacggaaacgauguguggaugggucgaacgaucucugaaaagcugagaagcggcuaugagaccuuuaaagucauugagggguggucaaagccaaauaguaaacuacagaucaaccgccaggugauuguagaacggggaaaucguuccggcuacagcgguauauucucuguugaggggaagucaugcaucaaccgcuguuuuuauguggaacucauuagaggcaggaaggaggaaacagaggucugguggaccaguaauagcaucguggucuucugcggaacuuccggcacauacgggacuggaucuuggcccgacggugcggauaucaaccugaugccuauuuga

SEQ ID NO: 136154 - RNA, 1410 nt, Artificial Sequence; identical to SEQ ID NO: 136151
  derived and/or modified sequence opt3 from neuraminidase__InfluenzaA__AAX11558

SEQ ID NO: 136155 - RNA, 1410 nt, Artificial Sequence
  derived and/or modified sequence opt3 from neuraminidase__InfluenzaA__AAX11568
augaaccccaaucagaagaucauuaccauaggcagcgugucccugacaaucgccacuauuugcuuccucaugcaaaucgcuauucuugucacgaccguuacacugcacuuuaaacagcaugaguguuacucuccuccaaacaaucaggugauguugugcgaaccgacuaucauagagagaaacaucaccgaaauuguauauuuaacaaauaccacuaucgagaaggaaauuugucccaaacuggcagaguacaggaacuggucaaagccucagugcaauaucacaggguucgccccauuuaguaaagacaacagcauacggcuauccgcgggaggugauauuugggugacccgcgagcccuaugucucuugugacccugauaagugcuaccaauucgcucucggccaggggacgacucugaauaacggacacucgaaugacaccgugcaugaucgaacaccauaucguacucuucugaugaacgaauugggcguucccuuucaccucgguaccagacagguguguaucgccuggucaagcaguuccugccaugacgggaaggcauggcugcacgucugugugacaggagaugacaaaaaugccaccgcuucuuucauuuacaacggcaggcugguagauagcaucggcuccuggucaaagaaaauccuccggacgcaggagagugaaugcguuuguauuaaugggacuugcacaguggucaugaccgacggaagcgcaucugguaaggccgauacuaaaauauuauuuaucgaggagggcaagauugugcacaucuccacacugucagggagcgcucaacauguggaagagugcaguuguuauccucgcuacccaggagucagaugcguuuguagggacaacuggaagggcucuaaccggccgauaguggauauuaauguaaaagacuacuccaucgugagcucguaugucugcucuggucuugugggggacacccccaggaagaacgauuccuucucaaguagccacuguuuggacccuaauaacgaagagggaggccauggcguuaaagggugggccuuugaugacggaaaugauguguggaugggucgaacgaucuccgaaaagcugagaucuggcuacgagaccuucaaagucauugagggguggagcaagccaaacucaaaacuacagaucaaucgccaggugauuguagaacggggaaaccguaguggcuauuccgguauauuuagcguugaggggaagucuugcaucaaucgcuguuucuacguggaacucauuagaggcaggaaggaggaaacagaggucugguggacuucaaacaguaucguggucuuuugcggaaccagcggcacauaugggacuggauccuggcccgacggugcggauaucaaucugaugccuauuuga

SEQ ID NO: 136156 - RNA, 1410 nt, Artificial Sequence; identical to SEQ ID NO: 136151
  derived and/or modified sequence opt3 from neuraminidase__InfluenzaA__AAX11578

SEQ ID NO: 136157 - RNA, 1410 nt, Artificial Sequence
  derived and/or modified sequence opt3 from neuraminidase__InfluenzaA__AAX11588
augaaccccaaucagaagaucauuaccauaggcagcgugucccugacaaucgccgcuauuugcuuccucaugcaaaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucggcuccuggucaaagaaaauccuccggacccaggagagugaaugcauuuguauaaacgggacgugcacuguugugaugacagacggaagcgccucugguaaggcugauaccaaaaucuuauuuauugaggagggcaagaucguccacauauccacucugucagggagcgcccaacauguggaagagugcaguuguuacccucgcuauccaggagugagaugcgucuguagggacaacuggaagggcucuaaucggccgauuguugauaucaacgugaaagacuacuccaucguaagcucguacgugugcucuggucuugucggggacacaccccgcaagaaugauuccuucucaaguagccacuguuuggacccuaacaaugaagagggaggccauggcgugaaagggugggcguuugaugacggaaacgauguuuggaugggucgaaccauuuccgaaaagcugagaucuggcuaugagacguucaaagugaucgagggguggagcaagccaaauucaaaacuacagauuaacaggcaggucauaguggaacggggaaaucguaguggcuacuccgguaucuuuagcguagaggggaagucuugcauuaaccgcuguuucuauguugaacucaucagaggcaggaaggagaaaaccgaagugugguggacaucaaauaguaucgucguguuuugcggaacuagcggcaccuacgggacaggauccuggcccgacggugcagauauuaaccugaugccuauauga

SEQ ID NO: 136158 - RNA, 1410 nt, Artificial Sequence; identical to SEQ ID NO: 136153
  derived and/or modified sequence opt3 from neuraminidase__InfluenzaA__AAX11598

SEQ ID NO: 136159 - RNA, 1410 nt, Artificial Sequence; identical to SEQ ID NO: 136153
  derived and/or modified sequence opt3 from neuraminidase__InfluenzaA__AAX11608

SEQ ID NO: 136160 - RNA, 1410 nt, Artificial Sequence
  derived and/or modified sequence opt3 from neuraminidase__InfluenzaA__AAX11618
augaaccccaaucagaagaucauuaccauaggcagcgugucccugacaaucgccacuauuugcuuccucaugcagaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaucgaacaccauaccguacucuucugaugaaugaauugggcguucccuuucaccucgguaccagacagguguguaucgccuggucaagcaguuccugccaugacgggaaggcauggcugcacgucugugugacaggagaugacaaaaacgccaccgcuucuuucauuuauaauggcaggcugguagauagcaucggcuccuggucaaagaaaauccuccggacgcaggagagugaaugcguuuguauuaacgggacuugcacaguggucaugaccgacggaagcgcaucugguaaggccgauacuaaaauauuauuuaucgaggagggcaagauugugcacaucuccgcucugucagggagcgcccaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacaccccgcaagaaugauuccucaaguagcucccacuguuuggacccuaacaaugaagagggaggccauggcguuaaagggugggcguucgaugacggaaacgauguguggaugggucgaaccaucucugaaaagcugagaagcggcuaugagacguuuaaagucauugagggguggucaaagccaaauaguaaacuacagaucaacaggcaagugauuguagaacggggaaaucguuccggcuacagcgguauauucucuguugaggggaagucaugcaucaaccgcuguuuuuauguggaacucauuagaggcaggaaggaggaaaccgaggucugguggacaaguaauagcaucguggucuucugcggaacuuccggcaccuacgggacaggaucuuggcccgacggugcagauaucaaccugaugccuauuuga

SEQ ID NO: 136161 - RNA, 1410 nt, Artificial Sequence
  derived and/or modified sequence opt3 from neuraminidase__InfluenzaA__AAX12744
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaucgaacaccauaccguacucuucugaugaaugaauugggcguucccuuucaccucgguaccagacagguguguaucgccuggucaagcaguuccugccaugacgggaaggcauggcugcacgucugugugacaggagaugacaaaaacgccaccgcuucuuucauuuauaauggcaggcugguagauagcaucggcuccuggucaaagaaaauccuccggacgcaggagagugaaugcguuuguauuaacgggacuugcacaguggucaugaccgacggaagcgcaucugguaaggccgauacuaaaauauuauuuaucgaggagggcaagauugugcacaucuccacacugucagggagcgcucaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacccccaggaagaaugauuccuucucaaguagccacuguuuggacccuaacaaugaagagggaggccauggcguuaaagggugggccuuugaugacggaaacgauguguggaugggucgaacgaucuccgaaaagcugagaucuggcuaugagaccuucaaagucauugagggguggagcaagccaaauucaaaacuacagaucaaccgccaggugauuguagaacggggaaaucguaguggcuacuccgguauauuuagcguugaggggaagucuugcaucaaccgcuguuucuauguggaacucauuagaggcaggaaggaggaaacagaggucugguggacuucaaauaguaucguggucuuuugcggaaccagcggcacauacgggacuggauccuggcccgacggugcggauaucaaccugaugccuauuuga

SEQ ID NO: 136162 - RNA, 1410 nt, Artificial Sequence; identical to SEQ ID NO: 136153
  derived and/or modified sequence opt3 from neuraminidase__InfluenzaA__AAX12754

SEQ ID NO: 136163 - RNA, 1410 nt, Artificial Sequence
  derived and/or modified sequence opt3 from neuraminidase__InfluenzaA__AAX12774
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccggcaaucauagagagaaauaucacugaaauuguauauuuaaccaacacaaccaucgagaaggaaauuugucccaaacuggccgaguacaggaauuggucaaagccucagugcaacaucacuggguucgcgccauuuaguaaagacaauagcauacggcuauccgcuggaggugauauuugggugacacgcgagcccuaugucucuugugacccugauaagugcuaccaauucgcccucggccaggggaccacgcugaacaauggacauucgaacgacacugugcacgaucgaaccccauaucguacacuucugaugaaugaauugggcguucccuuucaucucgguacuagacagguguguaucgcauggucaagcaguuccugccacgacgggaaggccuggcugcaugucugugugaccggagaugacaaaaacgcuacagcaucuuucauuuacaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauugugaacaucuccacucugucagggagcgcccaacacguggaagagugcaguuguuauccucgcuacccaggagucagaugcguuuguagggacaauuggaagggcucuaaccggccgauaguggauauuaauguaaaagacuacuccaucgugagcucguaugucugcucuggucuugugggggacacaccccgcaagaacgauuccuucucaaguagccacuguuuggacccuaauaacgaagagggaggccauggcguuaaagggugggcguuugaugacggaaaugauguguggaugggucgaaccaucuccgaaaagcugagaucuggcuacgagacguucaaagucauugagggguggagcaagccaaacucaaaacuacagaucaauaggcaagugauuguagaacggggaaaccguaguggcuauuccgguauauuuagcguugaggggaagucuugcaucaaucgcuguuucuacguggaacucauuagaggcaggaaggaggaaaccgaggucugguggacaucaaacaguaucguggucuuuugcggaacuagcggcaccuaugggacaggauccuggcccgacggugcagauaucaaucugaugccuauuuga

SEQ ID NO: 136164 - RNA, 1410 nt, Artificial Sequence
  derived and/or modified sequence opt3 from neuraminidase__InfluenzaA__AAX12804
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccaggagucagaugcguuuguagggacaacuggaagggcucuaaucggccgauaguggauauuaacguaaaggacuacuccaucgugagcucguaugucugcucuggucuugugggggacacccccaggaaaaaugauaacuucuccucaagucauuguuuggacccuaauaacgaggaaggaggccacggcguuaaggggugggccuuugaugacggaaaugauguguggaugggucgaacgaucagcgagaaacugagauccggcuacgagaccuucaaggucauugaaggguggucuaaaccaaacagcaagcuacagacaaaucgccaggugaucguagagcggggaaaccguucaggcuauagugguauauuuuccguugaagggaaaagcugcauuaaucgcuguuucuacguggagcucaucagaggcaggaaggaagagacugaggucugguggaccucuaacucaauuguggucuuuugcggaacaaguggcacuuaugggaccggaagcuggcccgacggugcggauaucaaucugaugccuaucuga

SEQ ID NO: 136165 - RNA, 1410 nt, Artificial Sequence
  derived and/or modified sequence opt3 from neuraminidase__InfluenzaA__AAX12814
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccggcaaucauagagagaaauaucacugaaauuguauauuuaaccaacacaaccaucgagaaggaaauuugucccaaacuggccgaguacaggaauuggucaaagccucagugcaacaucacuggguucgcgccauuuaguaaagacaauagcauacggcuauccgcuggaggugauauuugggugacacgcgagcccuaugucucuugugacccugauaagugcuaccaauucgcccucggccaggggaccacgcugaacaauggacauucgaacgacacugugcacgaucgaaccccauaucguacacuucugaugaaugaauugggcguucccuuucaucucgguacuagacagguguguaucgcauggucaagcaguuccugccacgacgggaaggccuggcugcaugucugugugaccggagaugacgagaacgcuacagcaucuuucauuuacaauggcaggcugguagauagcaucggcuccuggaguaaaaagauccuccggacccaggaaucagagugcguuuguauuaacgggacgugcacuguggucaugacagacggaagcgccucugguaaagcugauaccaagauauuauuuaucgaggaaggcaaaauugugaacaucuccacucugucagggagcgcccaacacguggaggaaugcaguuguuauccucgcuacccaggagucagaugcguuuguagggacaauuggaagggcucuaaccggccgauaguggauauuaauguaaaggacuacuccaucgugagcucguaugucugcucuggucuugugggggacacaccccgcaaaaacgauuccuucucaaguagccacuguuuggacccuaauaacgaggaaggaggccauggcguuaaggggugggcguuugaugacggaaaugauguguggaugggucgaaccaucuccgagaaacugagaucuggcuacgagacguucaaggucauugaaggguggagcaaaccaaacucaaagcuacagaucaauaggcaagugauuguagagcggggaaaccguaguggcuauuccgguauauuuagcguugaagggaaaucuugcaucaaucgcuguuucuacguggagcucauuagaggcaggaaggaagagaccgaggucugguggacaucaaacaguaucguggucuuuugcggaacuagcggcaccuaugggacaggauccuggcccgacggugcagauaucaaucugaugccuauuuga

SEQ ID NO: 136166 - RNA, 1410 nt, Artificial Sequence
  derived and/or modified sequence opt3 from neuraminidase__InfluenzaA__AAX34064
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagagggaaauuugucccaagcuggcagaguaucggaauuggucaaaaccucagugcaacaucacaggguucgccccauuuaguaaggacaauagcauacgccuauccgcgggaggugauauuugggugacccgagagcccuacgucucuugugacccugauaaaugcuaucaauucgcucucggccaggggacgacucugaacaauggacacucgaacgacaccgugcaugaucguacaccauacagaacucuucugaugaaugaauugggcguucccuuucaccucgguacccgacagguguguaucgccuggucaagcaguuccugccaugacgggaaggcauggcugcacgucugugugacaggagaugacaagaacgccaccgcuucuuucauuuauaauggccggcugguagauagcaucggcuccuggaguaaaaagauccuccgcacgcaggagagugaaugcguuuguauuaacgggacuugcacaguggucaugaccgacggaagcgcaucugguaaagccgauacuaagauauuauuuaucgaggagggcaaaauugugcacaucuccacacugucagggagcgcucaacauguggaagagugcaguuguuacccuagauauccaggagucaggugcguuugucgggacaacuggaagggcucuaaucgcccgauaguggauauuaacguaaaggacuacuccaucgugagcucguacgucugcucuggucuugugggggacacccccaggaaaaaugauuccucaaguagcucccacuguuuggacccuaacaaugaagagggaggccauggcguuaaggggugggccuucgaugacggaaacgauguguggauggguagaacgaucucugaaaaacugaggagcggcuaugagaccuuuaaggucauugagggguggucaaaaccaaauaguaagcuacagaucaaccgucaggugauuguagaacggggaaaucgcuccggcuacagcgguauauucucuguugaggggaaaucaugcaucaacagauguuuuuauguggaacucauuaggggccggaaggaggaaacagaggucugguggacuucaaauagcaucguggucuucugcggaaccuccggcacauacgggacuggaucuuggcccgacggugcggauaucaaccugaugccuauuuga

SEQ ID NO: 136167 - RNA, 1410 nt, Artificial Sequence
  derived and/or modified sequence opt3 from neuraminidase__InfluenzaA__AAX35824
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuagcaaacacaaccaucgagaaggaaauuugucccaaacuggccgaguacaggaauuggucaaagccucagugcaacaucacuggguucgcgccauuuaguaaagacaauagcauacggcuauccgcuggaggugauauuugggugacacgcgagcccuaugucucuugugacccugauaagugcuaccaauucgcccucggccaggggaccacgcugaacaauggacauucgaacgacacugugcacgaucgaaccccauaucguacacuucugaugaaugaauugggcguucccuuucaucucgguacuagacagguguguaucgcauggucaagcaguuccugccacgacgggaaggccuggcugcaugucugugugaccggagaugacaaaaacgcuacagcaucuuucauuuacaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauuauccacauauccacucugucagggagcgcccaacacguggaagagugcaguuguuauccucgcuacccaggagugagaugcgucuguagggacaacuggaagggcucuaaucggccgauuguugauaucaacgugaaagacuacuccaucguaagcucguaugugugcucuggucuugucggggacacaccccgcaagaaugauuccucaaguagcucccauuguuuggacccuaacaaugaagagggaggccacggcgugaaagggugggcguucgaugacggaaacgauguuuggaugggucgaaccauuucugaaaagcugagaagcggcuacgagacguuuaaagugaucgagggguggucaaagccaaauaguaaacuacagauuaacaggcaggucauaguggaacggggaaaucguuccggcuauagcgguaucuucucuguagaggggaagucaugcauuaaccgcuguuuuuacguugaacucaucagaggcaggaaggaggaaaccgaggugugguggacaaguaauagcaucgucguguucugcggaacuuccggcaccuaugggacaggaucuuggcccgacggugcagauauuaaccugaugccuauauga

SEQ ID NO: 136168 - RNA, 1410 nt, Artificial Sequence; identical to SEQ ID NO: 136151
  derived and/or modified sequence opt3 from neuraminidase__InfluenzaA__AAX35834

SEQ ID NO: 136169 - RNA, 1410 nt, Artificial Sequence
  derived and/or modified sequence opt3 from neuraminidase__InfluenzaA__AAX35844
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccaggagucagaugcguuuguagggacaacuggaagggcucuaaucggccgauaguggauauuaacguaaaggacuacuccaucgugagcucguaugucugcucuggucuugugggggacacccccaggaaaaaugauuccuucucaaacagucauuguuuggacccuaauaacgaggaaggaggccacggcguuaaggggugggccuuugaugacggaaaugauguguggaugggucgaacgaucagcgagaaacugagauccggcuacgagaccuucaaggucauugaagggugguuuaaaccaaacucuaagcuacagaucaaucgccaggugauuguagagcggggaaaccguagcggcuauucagguauauucaguguugaagggaaauccugcaucaaucgcuguuuuuacguggagcucauuagaggcaggaaggaagagacagaggucugguggacuagcaacucuaucguggucuucugcggaaccucaggcacauaugggacuggaaguuggcccgacggugcggauaucaaucugaugccuauuuga

SEQ ID NO: 136170 - RNA, 1410 nt, Artificial Sequence
  derived and/or modified sequence opt3 from neuraminidase__InfluenzaA__AAX35854
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccaggagucagaugcguuuguagggacaacuggaagggcucuaaucggccgauaguggauauuaacguaaaggacuacuccaucgugagcucguaugucugcucuggucuugugggggacacccccaggaaaaaugauuccuucucaaguagccauuguuuggacccuaacaaugaggaaggaggccacggcguuaaggggugggccuuugaugacggaaacgauguguggaugggucgaacgaucuccgagaaacugagaucuggcuacgagaccuucaaggucauugaaggguggagcaaaccaaauucaaagcuacagaucaaccgccaggugauuguagagcggggaaaucguaguggcuauuccgguauauuuagcguugaagggaaaucuugcaucaaccgcuguuucuacguggagcucauuagaggcaggaaggaagagacagaggucugguggacuucaaauaguaucguggucuuuugcggaaccagcggcacauaugggacuggauccuggcccgacggugcggauaucaaccugaugccuauuuga

SEQ ID NO: 136171 - RNA, 1410 nt, Artificial Sequence
  derived and/or modified sequence opt3 from neuraminidase__InfluenzaA__AAX35864
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccggcaaucauagagagaaauaucacugaaauuguauauuuaaccaacacaaccaucgagaaggaaauuugucccaaacuggccgaguacaggaauuggucaaagccucagugcaacaucacuggguucgcgccauuuaguaaagacaauagcauacggcuauccgcuggaggugauauuugggugacacgcgagcccuaugucucuugugacccugauaagugcuaccaauucgcccucggccaggggaccacgcugaacaauggacauucgaacgacacugugcacgaucgaaccccauaucguacacuucugaugaaugaauugggcguucccuuucaucucgguacuagacagguguguaucgcauggucaagcaguuccugccacgacgggaaggccuggcugcaugucugugugaccggagaugacgagaacgcuacagcaucuuucauuuacaauggcaggcugguagauagcaucggcuccuggaguaaaaacauccuccggacccaggaaucagagugcguuuguauuaacgggacgugcacuguggucaugacagacggaagcgccucugguaaggcugauaccaaaauauuauuuaucgaggaaggcaagauugugaauaucuccacucugucagggagcgcccaacacguggaggaaugcaguuguuauccucgcuacccaggagucagaugcguuuguagggacaacuggaaaggcucuaaucggccgauaguggauauuaacguaaaggacuacuccaucgugagcucguaugucugcucuggucuugugggggacacaccccgcaagaaugauuccuucucaaguagccacuguuuggacccuaacaaugaggaaggaggccauggcguuaaagggugggcguuugaugacggaaacgauguguggaugggucgaaccaucuccgagaagcugagaucuggcuacgagacguucaaagucauugaaggguggagcaagccaaauucaaaacuacagaucaacaggcaagugauuguagagcggggaaaucguaguggcuauuccgguauauuuagcguugaagggaagucuugcaucaaccgcuguuucuacguggagcucauuagaggcaggaaagaagagaccgaggucugguggacaucaaauaguaucguggucuuuugcggaacuagcggcaccuaugggacaggauccuggcccgacggugcagauaucaaccugaugccuauuuga

SEQ ID NO: 136172 - RNA, 1410 nt, Artificial Sequence
  derived and/or modified sequence opt3 from neuraminidase__InfluenzaA__AAX47538
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccggcaaucauagagagaaauaucacugaaauuguauauuuaaccaacacaaccaucgaggaagagauuugucccaagcuggccgaguacaggaauuggucaaaaccucagugcaacaucacuggguucgcgccauuuaguaaggacaauagcauacggcuauccgcuggaggugauauuugggugacacgcgaacccuaugucucuugugacccugauaaaugcuaccaauucgcccucggccaggggaccacgcugaacaauggacauucgaacgacacugugcacgaucgaaccccauaucguacacuucugaugaaugaguugggcguucccuuucaucucgguacuagacagguguguaucgcauggucaagcaguuccugccacgacgggaaggccuggcugcaugucugugugaccggagaugacaagaacgcuacagcaucuuucauuuacaauggcaggcugguagauagcaucggcuccuggaguaaaaagauccuccggacccaggaaucagagugcguuuguauuaacgggacgugcacuguggucaugacagacggaagcgccucugguaaagcugauaccaagauauuauuuaucgaggaaggcaaaauugugaacaucuccacucugucagggagcgcccaacacguggaggaaugcaguuguuauccucgcuacccaggagucagaugcguuuguagggacaauuggaagggcucuaaccggccgauaguggauauuaauguaaaggacuacuccaucgugagcucguaugucugcucuggucuugugggggacacaccccgcaaaaacgauuccuucucaaguagccacuguuuggacccuaauaacgaggaaggaggccauggcguuaaggggugggcguuugaugacggaaaugauguguggaugggucgaaccaucuccgagaaacugagaucuggcuacgagacguucaaggucauugaaggguggagcaaaccaaacucaaagcuacagaucaauaggcaagugauuguagagcggggaaaccguaguggcuauuccgguauauuuagcguugaagggaaaucuugcaucaaucgcuguuucuacguggagcucauuagaggcaggaaggaagagaccgaggucugguggacaucaaacaguaucguggucuuuugcggaacuagcggcaccuaugggacaggauccuggcccgacggugcagauaucaaucugaugccuauuuga

SEQ ID NO: 136173 - RNA, 1410 nt, Artificial Sequence; identical to SEQ ID NO: 136151
  derived and/or modified sequence opt3 from neuraminidase__InfluenzaA__AAX56383

SEQ ID NO: 136174 - RNA, 1410 nt, Artificial Sequence
  derived and/or modified sequence opt3 from neuraminidase__InfluenzaA__AAX56393
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggcaaggggacgacucugaacaauggacacucgaacaauaccgugcaugaccgaacaccauaccguacucuucugaugaacgaauugggcguucccuuucaccucgguaccagacagguguguaucgccuggucaagcaguuccugccaugaugggaaagcauggcugcacgucugugugacaggagacgauaagaaugccaccgcuucuuucauuuauaacggcaggcugguagacagcaucggcuccuggaguaaaaagauccuccggacgcaggagucagaaugcguuuguauuaacgggacuugcacaguggucaugaccgauggaagcgcaucugguaaagccgacacuaagauauuauuuaucgaggagggcaagauugugcacaucuccacacugucagggagcgcucagcauguggaagagugcaguuguuacccucgcuauccaggagucagaugcguuuguagggauaauuggaaaggcucuaaccggccgauaguggacauuaauguaaaggauuacuccaucgugagcucguacgucugcucuggucuugugggggacacccccaggaaaaacgacuccuucucaaguagccacuguuuggauccuaauaacgaagagggaggccauggcguuaaggggugggccuuugacgauggaaaugacguguggaugggucgaacgaucuccgaaaaacugagaucuggcuaugagaccuucaaggucauugagggguggagcaaaccaaacucaaagcuacaaaucaaucgccaggugauuguagaacggggaaaccguaguggcuacuccgguauauuuagcguugaggggaagucuugcaucaaucgcuguuucuauguggaacucauuagaggcaggaaagaggaaacagaggucugguggacuucaaacaguaucguggucuuuugcggaaccagcggcacauacgggacuggauccuggcccgauggugcggacaucaaucugaugccuauuuga

SEQ ID NO: 136175 - RNA, 1410 nt, Artificial Sequence; identical to SEQ ID NO: 136151
  derived and/or modified sequence opt3 from neuraminidase__InfluenzaA__AAX56413

SEQ ID NO: 136176 - RNA, 1410 nt, Artificial Sequence; identical to SEQ ID NO: 136153
  derived and/or modified sequence opt3 from neuraminidase__InfluenzaA__AAX56423

SEQ ID NO: 136177 - RNA, 1410 nt, Artificial Sequence; identical to SEQ ID NO: 136151
  derived and/or modified sequence opt3 from neuraminidase__InfluenzaA__AAX56433

SEQ ID NO: 136178 - RNA, 1410 nt, Artificial Sequence; identical to SEQ ID NO: 136170
  derived and/or modified sequence opt3 from neuraminidase__InfluenzaA__AAX56443

SEQ ID NO: 136179 - RNA, 1410 nt, Artificial Sequence
  derived and/or modified sequence opt3 from neuraminidase__InfluenzaA__AAX56473
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccaggagucagaugcguuuguagggacaacuggaagggcucuaaucggccgauaguggauauuaacguaaaggacuacuccaucgugagcucguaugucugcucuggucuugugggggacacccccaggaaaaaugauuccuucucaaguagccauuguuuggacccuaacaaugaggaaggaggccacggcguuaaggggugggccuuugaugacggaaacgauguguggaugggucgaacgaucuccgagaaacugagaucuggcuacgagaccuucaaggucauugaaggguggagcaaaccaaauucaaagcuacagaucaaccgccaggugauuguagagcggggaaaucguaguggcuauuccgguauauuuagcguugaagggaaaaacugcaucaaucgcuguuucuacguggagcucauuagaggcaggaaggaagagacagaggucugguggacuucuaacucaaucguggucuuuugcggaaccaguggcacauaugggacuggaagcuggcccgacggugcggauaucaaucugaugccuauuuga

SEQ ID NO: 136180 - RNA, 1410 nt, Artificial Sequence
  derived and/or modified sequence opt3 from neuraminidase__InfluenzaA__AAX56483
augaaccccaaucagaagaucauuaccauaggcagcgugucccugacaaucgccacuauuugcuuccucaugcaaaucgcuauucuugucacgaccguuacacugcacuuuaaacaguacgagugugacucuccuccaaacaaucaggugauguugugcgaaccgacuaucauagagagaaacaucaccgaaauuguauauuuaacaaauaccacuaucgagaaggaaauuugucccaaacuggcagaguacaggaacuggucaaagccucagugcaauaucacaggguucgccccauuuaguaaagauaacagcauacggcuauccgcgggaggugacauuugggugacccgcgagcccuaugucucuugugauccugacaagugcuaccaauucgcucucggccaggggacgacucugaauaacggacauucgaaugauaccgugcacgaccgaacaccauaucguacucuucugaugaacgaauugggcguucccuuucaucucgguaccagacagguguguaucgccuggucaagcaguuccugccacgaugggaaggcauggcugcaugucugugugacaggagacgaugagaaugccaccgcuucuuucauuuacaacggcaggcugguagacagcaucggcuccuggaguaaaaagauccuccggacgcaggaaucagagugcguuuguauuaaugggacuugcacaguggucaugaccgauggaagcgcaucugguaaagccgacacuaagauauuauuuaucgaggaaggcaaaauugugcacaucuccacacugucagggagcgcucaacacguggaggaaugcaguuguuauccucgcuacccaggagucagaugcguuuguagggauaacuggaagggcucuaaccggccgauaguggacauuaauguaaaggacuacuccaucgugagcucguaugucugcucuggucuugugggggauacccccaggaaaaacgacuccuucucaaguagccauuguuuggauccuaauaacgaggaaggaggccacggcguuaaggggugggccuuugacgauggaaaugacguguggaugggucgaacgaucuccgagaaacugagaucuggcuacgagaccuucaaggucauugaaggguggagcaaaccaaacucaaagcuacagaucaaucgccaggugauuguagagcggggaaaccguaguggcuauuccgguauauuuagcguugaagggaaaucuugcaucaaucgcuguuucuacguggagcucauuagaggcaggaaggaagagacagaggucugguggacuucaaacaguaucguggucuuuugcggaaccagcggcacauaugggacuggauccuggcccgauggugcggacaucaaucugaugccuauuuga

SEQ ID NO: 136181 - RNA, 1410 nt, Artificial Sequence; identical to SEQ ID NO: 136180
  derived and/or modified sequence opt3 from neuraminidase__InfluenzaA__AAX56503

SEQ ID NO: 136182 - RNA, 1410 nt, Artificial Sequence
  derived and/or modified sequence opt3 from neuraminidase__InfluenzaA__AAX56513
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccaggagucagaugcguuuguagggacaacuggaagggcucuaaucggccgauaguggauauuaacguaaaggacuacuccaucgugagcucguaugucugcucuggucuugugggggacacccccaggaaaaaugauuccuucucaaguagccauuguuuggacccuaacaaugaggaaggaggccacggcguuaaggggugggccuuugaugacggaaacgauguguggaugggucgaacgaucuccgagaaacugagaucuggcuacgagaccuucaaggucauugaaggguggagcaaaccaaauucaaagcuacagacaaaccgccaggugaucguagagcggggaaaucguaguggcuauuccgguauuuuuagcguugaagggaaaucuugcauaaaccgcuguuucuacguggagcucaucagaggcaggaaggaagagacugaggucugguggaccucaaauaguauuguggucuuuugcggaacaagcggcacuuaugggaccggauccuggcccgacggugcggauaucaaccugaugccuaucuga

SEQ ID NO: 136183 - RNA, 1413 nt, Artificial Sequence
  derived and/or modified sequence opt3 from neuraminidase__InfluenzaA__AAX56533
augaaccccaaucagaagaucauuaccauaggcagcaucuccguggccauugggaucauuucucugauccuccaaauaggaaacaucauuucaaucugggcuagucacagcauucagacagguucccagaauuacacuggcaucugcaaccagagaauaauuacguaugagaauaggaccugggugaaccaaacauacguuaauaucaacaauacuaacgugguagcagggaaagacaagaccucuaugacacuugccggaaauucgucacuguguccuauucggggcugggcgaucuauaccaaagauaacagcauccgcauugguaguaagggggacguguucgucauacgagaaccauuuaucuccugcucucauuuggagugucguacuuucuuuuuaacacagggagcucugcuaaaugauaaacacagcaacggcaccauuaaggacagauccccguucagggcccucaugucaugcccccugggcgaagcaccuaguccauacaauagccgguuugagucuguggccugguccgcuucagcaugucaugaugggcuuggauggcugacgaucgguauaagcggccccgacaacggggccguugcuguguugaaguauaacggaauuaucacugaaaccaucaaaaguuggaagaaacagauucuccgcacacaggagucugagugcgucugugugaauggcuccugcuucacuaucaugaccgaugguccuagcaacagagccgcgucguacaggauuuuuaagauagaaaaagggcggguaacaaagucuaucgagcuggacgcaccaaauuaucacuacgaagaguguuccugcuaccccgauaccggaacgguuaugugugugugccgcgacaacuggcauggcucaaaucgaccuugggucaguuucaaccaaaaucuggauuaucagauuggcuacaucugcagcgggguguuuggagacaacccaagaccgaaggauggugagggcuccuguaaucccgugacugucgacggggccgacggaguuaaaggcuucucuuauagguacgguaacgggguguggaucggccggacaaagagcaaucgucuccgcaaaggauuugaaaugauuugggauccuaacggcuggaccgacacugauucagacuucaguaugaagcaggauguaguggcuaugaaugacugguccggguauagcggaucuuuuguccagcacccagaguuaacaggucuggauugcaugagacccuguuucuggguggaacuuguuaggggcuugccucgggagaacaccacgauauggaccucagggaguagcaucuccuucugcggagucaauucugaaacagccaacuggucguggccagacggcgcagagcugcccuuuacuauugauaaauga

SEQ ID NO: 136184 - RNA, 1410 nt, Artificial Sequence
  derived and/or modified sequence opt3 from neuraminidase__InfluenzaA__AAX56543
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgucuggagauauuugggugacccgcgagcccuaugucucgugugacccugauaagugcuaccaauucgcucucggucagggcacgacucugaacaaugggcauucaaacgacaccgugcacgaucgaacaccauaucguacucuucugaugaaugaauugggaguucccuuucaucucggcaccaaacagguguguaucgccuggagcaguuccucuugccacgacgguaaggcauggcugcaugucugugugacaggggaugacgagaacgccaccgcuagcuucauuuacaauggaagacugguagauuccaucggcucauggaguaagaaaauccucaggacgcaggaaagcgagugcguuuguauuaacggcacuugcacaguggucaugaccgacgggucugcauccggaaaggccgauacuaaaauauuauuuaucgaggaagguaagauugugcacacaucaagccugaguggcucugcucaacacguggaggaaugcuccuguuauccucgguacccagggguccgcugcguuuguagagacaacuggaagggaagcaauaggccgaucguggauauaaacguaaaagacuacucgauugugucuuccuaugucugcucaggccuugugggugacacgccccggaagaaugauaguagcuccucuagccauuguuuggacccuaacaaugaggaagggggacacggcguuaaaggcugggccuucgaugacgggaacgauguguggaugggacgcaccaucucagaggagcugcgaagugguuacgaaaccuuuaaggucaucgagggcugguccaaaccaaauagcaagcuacagauuaacagacaggugaucguagacagggggaaucggucuggauauucaggcauuuucaguguugaagguaaaagcugcauaaaccguuguuuuuacguggagcucauccgcgggagaaagcaggaaacagagguccuguggacuuccaauucuauuguggucuucugcggcaccucgggaacauauggcacugggagcuggcccgauggagcggacaucaaccuuaugccuaucuga

SEQ ID NO: 136185 - RNA, 1410 nt, Artificial Sequence; identical to SEQ ID NO: 136077
  derived and/or modified sequence opt3 from neuraminidase__InfluenzaA__AAX56553

SEQ ID NO: 136186 - RNA, 1410 nt, Artificial Sequence
  derived and/or modified sequence opt3 from neuraminidase__InfluenzaA__AAX56563
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauugugcacaucuccgcccugucagggagcgcgcaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacuccccgcaagaaugauuccuucucaaguagccacuguuuggacccuaacaaugaagagggaggccauggcguuaaagggugggcauuugaugacggaaacgauguguggaugggucgaacaaucuccgaaaagcugagaucuggcuaugagaccuucaaagucauugagggguggagcaagccaaauucaaaacuacagaucaacaggcaagugauuguagaacgggacaaucguaguggauacuccggcauauuuagcguugaggguaagucuugcaucaaccgcuguuucuauguggaacucauuagagggaggaaggaggaaacggaggucugguggaccucaaauaguaucguggucuuuugcggcacaagcggaacuuacggcaccggguccuggcccgauggagccgacaucaaccugaugccuauuuga

SEQ ID NO: 136187 - RNA, 1410 nt, Artificial Sequence
  derived and/or modified sequence opt3 from neuraminidase__InfluenzaA__AAX56573
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccggcaaucauagagagaaauaucacugaaauuguauauuuaaccaacacaaccaucgagaaggaaauuugucccaaacuggccgaguacaggaauuggucaaagccucagugcaacaucacuggguucgcgccauuuaguaaagacaauagcauacggcuauccgcuggaggugauauuugggugacacgcgagcccuaugucucuugugacccugauaagugcuaccaauucgcccucggccaggggaccacgcugaacaauggacauucgaacgacacugugcacgaucgaaccccauaucguacacuucugaugaaugaauugggcguucccuuucaucucgguacuagacagguguguaucgcauggucaagcaguuccugccacgacgggaaggccuggcugcaugucugugugaccggagaugacgagaacgcuacagcaucuuucauuuacaauggcaggcugguagauagcaucggcuccuggaguaaaaagauccuccggacccaggaaucagagugcguuuguauuaacgggacgugcacuguggucaugacagacggaagcgccucugguaaagcugauaccaagauauuauuuaucgaggaaggcaaaauugugcacaucuccacucugucagggagcgcccaacacguggaggaaugcaguuguuauccucgcuacccaggagucagaugcguuuguagggacaacuggaagggcucuaaucggccgauaguggauauuaacguaaaggacuacuccaucgugagcucguaugucugcucuggucuugugggggacacaccccgcaaaaaugauuccuucucaaguagccauuguuuggacccuaacaaugaggaaggaggccacggcguuaaggggugggcguuugaugacggaaacgauguguggaugggucgaaccaucuccgagaaacugagaucuggcuacgagacguucaaggucauugaaggguggagcaaaccaaauucaaagcuacagaucaacaggcaagugauuguagagcggggaaaucguaguggcuauuccgguauauuuagcguugaagggaaaucuugcaucaaccgcuguuucuacguggagcucauuagaggcaggaaggaagagaccgaggucugguggacaucaaauaguaucguggucuuuugcggaacuagcggcaccuaugggacaggauccuggcccgacggugcagauaucaaccugaugccuauuuga

SEQ ID NO: 136188 - RNA, 1410 nt, Artificial Sequence
  derived and/or modified sequence opt3 from neuraminidase__InfluenzaA__AAX56583
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccaggagucagaugcguuuguagggaccauuggaagggcucuaaccggccgauaguggauauuaauguaaaggacuacuccaucgugagcucguaugucugcucuggucuugugggggacacccccaggaaaaacgauuccuucucaaguagccacuguuuggacccuaauaacgaggaaggaggccauggcguuaaggggugggccuuugaugacggaaaugauguguggaugggucgaacgaucuccgagaaacugagaucuggcuacgagaccuucaaggucauugaaggguggagcaaaccaaacucaaagcuacagacaaaucgccaggugaucguagagcggggaaaccguaguggcuauuccgguauuuuuagcguugaagggaaaucuugcauaaaucgcuguuucuacguggagcucaucagaggcaggaaggaagagacugaggucugguggaccucaaacaguauuguggucuuuugcggaacaagcggcacuuaugggaccggauccuggcccgacggugcggauaucaaucugaugccuaucuga
